United States Patent 8,344,211 (PLANT NUCLEOTIDE SEQUENCES AND CORRESPONDING POLYPEPTIDES) - sequence listing, part 3

SEQ ID NO: 10901 - protein, 78 aa, Zea mays
  misc_feature: Ceres CLONE 1344264-F
  misc_feature (1)..(76): Pfam Name: Ribosomal_S25 Pfam Description: S25 ribosomal protein
MQNVKANLVVIFCQVTYDNLLSHVPIYEQVTPSILSERLRRNGSLARKAILDLMADGLIRMRYLFILISIIYPRVTIS

SEQ ID NO: 10902 - DNA, 832 bp, Zea mays
  misc_feature: Ceres CLONE 1344300-F
  misc_feature: Encodes the peptide sequence at SEQ ID NO. 10903
  misc_feature (348)..(348): n is a, c, t, g, unknown, or other
  misc_feature (378)..(378): n is a, c, t, g, unknown, or other
  misc_feature (399)..(399): n is a, c, t, g, unknown, or other
  misc_feature (433)..(433): n is a, c, t, g, unknown, or other
  misc_feature (441)..(441): n is a, c, t, g, unknown, or other
  misc_feature (495)..(495): n is a, c, t, g, unknown, or other
  misc_feature (521)..(521): n is a, c, t, g, unknown, or other
  misc_feature (592)..(592): n is a, c, t, g, unknown, or other
  misc_feature (680)..(680): n is a, c, t, g, unknown, or other
  misc_feature (681)..(681): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (713)..(713): n is a, c, t, g, unknown, or other
  misc_feature (714)..(714): n is a, c, t, g, unknown, or other
gcggtggcggccgctctagaactagtggatcccccgggctgcaggcccccccccccacccgccgtcggtgtcacttggcacgggcctcaggaaaatccaggaaaaggccagcagtgtcctcaagcggtatatcagtagaagccgcggcggcggcggcagcggcagcagctcctcgtcgaatgtttccccaggaccaggagaggagctacaagccgccgctcgagatggagttggagaagaagagatgagcagggaggtcaaaagatgggtgccaaacctgtacgtgaacagctgcgactacatctgctgcttctacgctgaccgtagcggcgtcgctaccgtcaccgnaggagaagccgttccggagtgcattccaangctgtacgtgatcgccaaggnaccgagcaagttcctggaggctcacgggctgaanccagtggntggtccgatgattctgagctccacttggccgtgcacgacagcaaactcatgtantagggcaccttagtccctctatgttngaacagtagtagagaaggcatttggtacttgtttctcagaaatgcctagtttttcttctctagtccagacnagaaaacatgtaaaccgccggctgatttagagctcccactcttgcaactcctctaagcatatttcttcctctctcgcgtaaaaaaaannaaaaaaaaaaaannnnaaggaaaaaaaaaaannaacacccgagggggggcccggtacccattccccccaatagggagccgattaaagttcctgggccggcgttttcaaaggtcgggagggaaaaaccctggggtacccaatttaatccccg

SEQ ID NO: 10903 - protein, 87 aa, Zea mays
  misc_feature: Ceres CLONE 1344300-F
  misc_feature (35)..(35): Xaa is any aa, unknown, or other
  misc_feature (45)..(45): Xaa is any aa, unknown, or other
  misc_feature (52)..(52): Xaa is any aa, unknown, or other
  misc_feature (63)..(63): Xaa is any aa, unknown, or other
  misc_feature (66)..(66): Xaa is any aa, unknown, or other
  misc_feature (84)..(84): Xaa is any aa, unknown, or other
MSREVKRWVPNLYVNSCDYICCFYADRSGVATVTXGEAVPECIPXLYVIAKXPSKFLEAHGLXPVXGPMILSSTWPCTTANSCXRAP

SEQ ID NO: 10904 - DNA, 874 bp, Zea mays
  misc_feature: Ceres CLONE 1344315-F
  misc_feature: Encodes the peptide sequence at SEQ ID NO. 10905
  misc_feature (400)..(400): n is a, c, t, g, unknown, or other
  misc_feature (519)..(519): n is a, c, t, g, unknown, or other
  misc_feature (755)..(755): n is a, c, t, g, unknown, or other
  misc_feature (874)..(874): n is a, c, t, g, unknown, or other
cgcggtggcggccgctctagaactagtggatcccccgggctgcaggaattcggcaccagcccccccatagtacagtcaggcaaccaaaccgactatgacagcgacgatgagtacatcggcgcaaggtccggaatacagcagccattggtgaaccagcaagctgctgctgctgctgctgatcctagggtgcccaatctcgactaccgcccaatccggaacgacgcatggagccaacggatgagagagaagtacggggtggatagcttcgatccgaacaggtttcagccggccaccatatctcctggagaacaaagaaaccgatgcacgattctctgaggcaagttctacatatatccaaccgcgcaattaacaccgagttgcagagagtatgcgcctgggnttattcggtgttgcctagctgtgtggcatccggagggcttcacattctccgtctgtatttttttttttttttttgggtttacatagtccaaatcacaccacccagggggctgtttttgntaataagtattggaaccccaaagttcgtgttctctaaataaaccgttccaatggtgcaaaaaaaaaaaaaaaaaaaattcccaaggggggggcccccggtacccaattcgcccctattagggaggcgtattacaattcactgggccggcgtttttacaacggtcgtgactgggaaaaaccctggcggttacccaccttaattcgctttggcacacatcccccttttgccagctggngtaaaaaggaaagaggccccaaccgaatgccctttccaacagttggcaagcctgaatggcaaatgccaaattgaaacggttaatatttggtaaaactcccccaaatttttgttaaaccn

SEQ ID NO: 10905 - protein, 111 aa, Zea mays
  misc_feature: Ceres CLONE 1344315-F
RGGGRSRTSGSPGLQEFGTSPPIVQSGNQTDYDSDDEYIGARSGIQQPLVNQQAAAAAADPRVPNLDYRPIRNDAWSQRMREKYGVDSFDPNRFQPATISPGEQRNRCTIL

SEQ ID NO: 10906 - DNA, 874 bp, Zea mays
  misc_feature: Ceres CLONE 1344329-F
  misc_feature: Encodes the peptide sequence at SEQ ID NO. 10907
gctctttactagtggatcccccgggctgcaggctggtgccgctcactagtcccccccccccggcagcctcctcctctcgcagatccccacctgttccgccgccggccaccgcgttgctcccctcggcagccaggatgacagaagcaccatttctgccgcgtgagaagctcttcaagcagcaacattacttccagaacttgaccaagcacacctacctgaaagggcgctacgacgtgatcacatctgtcgccatcccccttgcactcgctgcctccagcatgttcatgattgggcgtggagtttataacatgtctcatggggttgggaagaaagagcgatcttccactggctaactattgcctccgcttggcatggaagtcataccgttgagactgcgaagtcctcttcgcttgcaaaataatacggccaaataacaattcgactacattctcgcatccaaaaaaaaaaaaaaaaaaaactccgggggggggcccggccacccaattcgccctaatagggtgcccccactaccatttcactggcccgacgtttttaccaacgtcgctgaccgggcaaaaaccctggcggttaaccccaatttaattggccccggcagccacactcccccttttccgaccgcgggggcgtacataaccaaagaagggcccccccctgattgccccttctcaaaaaggatgcggcagcccggaatggggcgaagggcctaattggacaacgtttaatttttttgtgaaaaactccgcggttacccctcctgttaatatccccccccttttctatcccccaaccggcgaatagttgtgaaacaccccttctcaatccccaacaaccaacccttgttgcggccttctgg

SEQ ID NO: 10907 - protein, 72 aa, Zea mays
  misc_feature: Ceres CLONE 1344329-F
  misc_feature (9)..(62): Pfam Name: COX7a Pfam Description: Cytochrome c oxidase subunit VIIa
MTEAPFLPREKLFKQQHYFQNLTKHTYLKGRYDVITSVAIPLALAASSMFMIGRGVYNMSHGVGKKERSSTG

SEQ ID NO: 10908 - DNA, 931 bp, Zea mays
  misc_feature: Ceres CLONE 1344354-F
  misc_feature: Encodes the peptide sequence at SEQ ID NO. 10909
gctctttttcagtggatcccccgggctgcaggaattttgcacgagccccatagatcctacatacatggtccgtgctattccaagcaatgcatcagacaatgtctactgtacacttctagcccacagtgctatccatggtgcaatggcggggtacagcttcactgttgggatggtcaacggaagacatacctatatacctttctacagggtgacatccacaaggaacaaggttaaagtcactgacaggatgtgggcaaggcttctgtcgtccaccaaccagccaagttccctgagtcagaaggatatcgacgaagcgagtgaggcggataggctggcaaacaggccaaccactgccaacgggtggcagctctcccgtggtggaggttttttcaacaacttcctcggggtctttccaagggaaaaaaacaatagattttgtgccgccacccccctttttttttccaacccaccctctattactcctctggcatttgcggggtggggggagatcttccctcccccacaacagattattccgctcggttgcagttgtctcctcaccctcccccccatgctcggcttgccgaacgtatcctcgcttggtcctctccccccttcctccgcctcaaaatggaagaacacccccgctgggtcaggcgatcttcctgtgcgagcctccttcaacaatttcccttaccatgcctagtataaaagagacgccacagaagggggcgctcccccaaaaaatcctaacaacagacgccctgccgcctaccccccgatatgtatccgacgactgcggcgaggttttttcctcccctcgcgcgctactgttactgccttcatgagaattatggcactgcgtctctgatctactatttttctcgatcgtgaccctaccttatggccggatataaggatacgcaccccc

SEQ ID NO: 10909 - protein, 234 aa, Zea mays
  misc_feature: Ceres CLONE 1344354-F
LFFSGSPGLQEFCTSPIDPTYMVRAIPSNASDNVYCTLLAHSAIHGAMAGYSFTVGMVNGRHTYIPFYRVTSTRNKVKVTDRMWARLLSSTNQPSSLSQKDIDEASEADRLANRPTTANGWQLSRGGGFFNNFLGVFPREKNNRFCAATPLFFSNPPSITPLAFAGWGEIFPPPQQIIPLGCSCLLTLPPMLGLPNVSSLGPLPPSSASKWKNTPAGSGDLPVRASFNNFPYHA

SEQ ID NO: 10910 - DNA, 841 bp, Zea mays
  misc_feature: Ceres CLONE 1344375-F
  misc_feature: Encodes the peptide sequence at SEQ ID NO. 10911
  misc_feature (418)..(418): n is a, c, t, g, unknown, or other
  misc_feature (634)..(634): n is a, c, t, g, unknown, or other
  misc_feature (667)..(667): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (674)..(674): n is a, c, t, g, unknown, or other
tggcggccgctctagaactagtggatcccccgggctgcaggaattcggcaccaggagagagagagagaccgacgcgccggcagatcccaagttcaccggagagggggaagagggcgaccgaaggcggcgatgggtttcatcatggacttcgcggagaatctgatcctccgtctgatggaggacccggacaagcgcgaccaggttcggcgggagcatgtctacaagatgaaggagcggtgcgagcgcactaaggcggcgtggagcctccctctgcgcccctacggcttctggaccttcgaccgcttcaactcgcagctctcctgggatccccagatcagccaggccgccggccgtcgggacccctacgacgacctcatcgcccgccactctggctcgccgccgtcttcctgaacacccngttccgatcttttgcccagaaggtctacttgggcatcaataagaaactctttcccctcaacctgattgtggttccatcctcttctgtctgggaaaatgttgtcaccaaactaccctatttccttgttccagtttgggctgggaaaaggaataagttgtgtacttctattcctcaagtttgttgtctttgtaattatgaaatgtttccaataatcangcagtttttgaatgtattggtcgtggatcccantnnnntnagtataaataaacaaaaaaaattttcgaggggggggcccgggacccaattcgccctattagtgagtcgtattacaattcccctgggccgtcgtttttcaccgtccgggactgggaaaaacctggcgttaccccaccttaatcgccttgcaacacatccccctttcgc

SEQ ID NO: 10911 - protein, 93 aa, Zea mays
  misc_feature: Ceres CLONE 1344375-F
MGFIMDFAENLILRLMEDPDKRDQVRREHVYKMKERCERTKAAWSLPLRPYGFWTFDRFNSQLSWDPQISQAAGRRDPYDDLIARHSGSPPSS

SEQ ID NO: 10912 - DNA, 633 bp, Zea mays
  misc_feature: Ceres CLONE 1344426-R
caattgggtaccgggccccccctggtgatttttggcgtcttcaccatctacgccattctgagttactccaccaactatctgaccgaaatgtatggcatgtcgctggtggcggcgagctacatggggattgtgatcaacaaaatattctgcgcgctgtgcggcccacttggcggcataatcaccacctacagcaaagtgaaatcccctacccgcgtgatccaaatcctttccgtactcggcctgctgacgttaactgccctgctcgtcacgaactctaacccgcaatcggtcgcgatggggattggcctgattttactgctgggattcacctgttacgcctcacgcgggctgtactgggcctgccctggcgaagcgagaacaccgtcttacattatgggcaccacggtaggtatttgttcggtgattggattcctgccggatgtcttcgtttacccaattatcggccactggcaagacaccctgcccgctgcagaagcctaccgcaatatgtggctgatgggcatggcggcgcttggcatggtgattgtctttacctttttgctgttccaaaaattcgtactgctgatagcgcccccgcaatggctagcagcaagtaagccaggacaattacag

SEQ ID NO: 10913 - DNA, 866 bp, Zea mays
  misc_feature: Ceres CLONE 1344431-F
  misc_feature: Translation starting site: 90
  misc_feature: SWISSPROT Homolog: EC 3.2.1.23 Beta-galactosidase
tccccgcggtggcggccgctctagaactagtggatcccccgggctgcaggagagagagagctcactagtcccccccccccccccccagcatgcacaggaggaacgtccttggtagcttcaaatctcctaggcccttctcgttgtctgatctccgtaatactaatgctgatgggattgattaccgcccacatatttggttgcatctctggcctctcctgaccaataatcagagatgtaatagccacttggtatatgcttcctgagcataaaatccaaatttgttgcgttcaaaagaacaaaaacagaaaactcgagtgggcgaccgataccctcttcaccctatagagagtctcattacaattcactgctcggctcttgacaacgacgagattgcgaaaaccctgatgttaccgaccttaatccccttgcagaacatccccctttccccacctggcgtaatagccaagaagactgcaccgatcgcctttcccaacagttgcgcagactgaatggaaagtggcaacctgcactccataatattctgtgacattcttcgttacatgtttgtcaaacagctcatttttaaaccaatagcgcgcaaactccaagatccctgataaatcacagataacggacattccggttgatttgctgttctcacgtggcagctatactctctcattatcgacctcgcattcgacgtacaagttagacaaccgctaatactaggaagatgcctcactaccttacacaccctaaaaaaaaaggtttttttcccgtgtgcggccaaaatccaaaaagacccgaaccctaaagcgacaccggattaaaagtttttatgggtaaatcccattgatcttccaaaa

SEQ ID NO: 10914 - DNA, 902 bp, Zea mays
  misc_feature: Ceres CLONE 1344438-F
  misc_feature: Translation starting site: 483
  misc_feature: Pfam Name: Ribosomal_L18p Pfam Description: Ribosomal L18p/L5e family
  misc_feature (674)..(674): n is a, c, t, g, unknown, or other
  misc_feature (802)..(802): n is a, c, t, g, unknown, or other
tggagctccccgcggtggcggccgctctagaactagtggatcccccgggctgcaggagagagagagatacctcactagtcccccccccccccccctgatgagagtaggcctttccgcgttctcttggatgttgcccttattatgactacaactgggaaccgtgtctttgcagccctcacggatagctttgcatgttgccctgcatattcctcccagcgacaacaggttggctggtttcaacatggatgacacccagctgaatgctgatatccatctcacgcacatctatggtggccatgatgctgactacatgaggacacctcgctgattagcagccagagaactacctgtctcacttcagtgagtacgttaacaagggaattgaggctgatgacatgtaagctctgtacaagaaggtccatgctgccatccgtgctgatccttctgtggacatcccttccaagcagccaccataggcgcacatgaggtacacccccaatacactgtcgtacgagcagacgaatggccagtctcattggaagcctcaacaaagtcaactcctcggtcgtatcagatgacgaccatgaggatgacccgtcaacgctagtcccttctaagtagtgctatcgtatgcagcgatcagtatttgagctatgacatttatccctacctgnagccttgacacatgcattttttgtataagttgagatgcaagcaagatgcttctgtactttggactgcagctcgaatattactttaaatattaagaaaaacaaaaaagctcgagtatggcccgtaccantcgccctaagggattttatacaatccccgggcgaccttttcaggtctgtctgaaaatcctgggtacccattatggcttgacccgtccccttcccagtgga

SEQ ID NO: 10915 - DNA, 1136 bp, Zea mays
  misc_feature: Ceres CLONE 1344464-F
  misc_feature: Encodes the peptide sequence at SEQ ID NO. 10916
ctaccctcccccttctcccatatttttccctccctcacccccccccttgtaatacaccgcggtggtgggcgctctagaatagtggatcccccgggctgcaggaaactcccagccgtctcctccgcacgcgaaaaccctagcagttcggtagtccctctcctctcgaggtattagtagtcgaccggttcctcggagcaccatgaagtttgttgctgcctacctgcttgctgtcctcgctgggaacgccagcccctccgctgacgatttgactgccattctggagccagttgcctgtgaagttgacaatgaaaagatggaactcctgttgtcccaactgagcggcaaggacatcaccgagctcattgccgtggccagggagaaatttgcttcagtcccatgcggtggtggcggtgtcgctgttgcggaatctgcccctgctgctgacggagcttctcctgctcctgacgcaacgaaagaacagaccgtgttatcagaacgaacaaagccgatgatgataatgtgccttcatgctcctctcgactaggtttgtccagttgatccacatctatttgctttcgtgtcaggtgcaacctcagagggcaacacccacagccattgttttagcattattaagcctttggttttattatagggaaaactccctggtaaaagaacttggtttactatgctcctcttactgctctgggccttcttcctattccattatcaatttgtctaatggcctggatcttgcgaacttataacctcccgcgggtccatccctagatcttttcgtttgtccgattatatacaatccacggacaatatcggtatacaccccccaaacgcatccccttggactttcttgtgtcctccgtctccctttgattcgggctcatggctattatctgctctgcatccttttaacctctcctctatcctcctcgcgcggcgggctcctggtttccacatactctcgccccataacaccggtgtggcgtttcctaaattctcactcgctctagtgcggtcgtcaccatcttagtgttgtggagacaaccttctaggttttaccatacattattggttctctgacaaatcctccacctcctcccaatttgtaactcatataacaa

SEQ ID NO: 10916 - protein, 114 aa, Zea mays
  misc_feature: Ceres CLONE 1344464-F
  misc_feature (17)..(93): Pfam Name: Ribosomal_60s Pfam Description: 60s Acidic ribosomal protein
MKFVAAYLLAVLAGNASPSADDLTAILEPVACEVDNEKMELLLSQLSGKDITELIAVAREKFASVPCGGGGVAVAESAPAADGASPAPDATKEQTVLSERTKPMMIMCLHAPLD

SEQ ID NO: 10917 - DNA, 902 bp, Zea mays
  misc_feature: Ceres CLONE 1344467-F
  misc_feature: Translation starting site: 244
  misc_feature (115)..(115): n is a, c, t, g, unknown, or other
tccccgcggtggcggccgctctagaactagtggatcccccgggctgcaggaattcttttttttttttttttttgataaagtgaaaattcgtaaaatggacaacatatacatggtnaggcggacataagaccactgatcaacattcaaataaccatagcaatgcattaccaccatgactaaattcataacacaggcaaaagccactgcaccacttacacacaccagccaaccaccactactaccatgagaagcggcacatcacagtgcttgcttgagaagcagacaacaacgacgcctactacaagggggctaagacgaggtgaacttggtgacggccttggtaccctccgagacggcgtgcttggcgagctcgccggggaggacgaggcggacggaggtctggatctcgcgggaggtgatggtgggcttcttgttgtaccgggcgagcttggcggcctccgcggcgagcttctcgaagatgtcgttgatgaaggagttcatgatggacatggccttggaggagatgccgatgtcggggtgcacctgcttcaggactttgaagatgagatcttgtaggtctcccgctcttcttcgcctctttcctacccttcttgtcgccggcctccttgcgggcggacttgcccgcaggtagccgcttccccgccttgggctccttccccgggggggcccttctccgccgaaccccccttcccccaggggtcctcctccgcccccttcttccccgccgggtttctttcccgccttggggggcttcaaaaccggtcaaaattttccgggatgaatagagaaaggacgcctggaaaaccaatgatacgcgtgggaaggtgggcaggatttctccggggtgggggggggggcccacagaaactgtacccaagggg

SEQ ID NO: 10918 - DNA, 747 bp, Zea mays
  misc_feature: Ceres CLONE 1344474-F
  misc_feature: Encodes the peptide sequence at SEQ ID NO. 10919
  misc_feature (596)..(596): n is a, c, t, g, unknown, or other
  misc_feature (719)..(719): n is a, c, t, g, unknown, or other
  misc_feature (747)..(747): n is a, c, t, g, unknown, or other
ggcggccgctctagaactagtggatcccccgggctgcaggaattcggcaccaggagagagagctcactagtccccccccccccaagcgcttagtgatcagttaatactaagggcaggcacacctctgcttcgcgctagtgatcaagcaagtgcttctgtactctgcagcaatggcaggcaaggcctcggtcgcgctgttcctcgccgtgaacctggtggtgttcgccatggccagcgcctgcggtggcaactgccccacgccgaccccgtccaccccgtcgacgccgaccccgacgccggcctcgttcggcaagtgcccccgcgacgcgctcaagctgggcgtgtgcgccaacgtgctgggcctgatcaaggccaaggtgggcgtgccgcccacggagccgtgctgcccgctgctgaagggactcgtcgacctcgaggccgccgtgtgcctctgcaccgccatcaagggagaggtcctcggaatcaagctcaacctgcccgtcgacctcagcctcatcctcaaccactgcggcaagaccgtgcccaccggattcaaatgcctctaagctagccgcgagcatgcggatatatatgtngttcttttggttgccattcgcctgcaggctttcttgtcgtttgctacttattaagcgagtgctagctctgcatgcatgactacgtccttttgcatgttgatgagcactttcacttttttgggngggtggggttttggggaaagtgcttcgn

SEQ ID NO: 10919 - protein, 131 aa, Zea mays
  misc_feature: Ceres CLONE 1344474-F
  misc_feature (49)..(130): Pfam Name: Tryp_alpha_amyl Pfam Description: Protease inhibitor/seed storage/LTP family
MAGKASVALFLAVNLVVFAMASACGGNCPTPTPSTPSTPTPTPASFGKCPRDALKLGVCANVLGLIKAKVGVPPTEPCCPLLKGLVDLEAAVCLCTAIKGEVLGIKLNLPVDLSLILNHCGKTVPTGFKCL

SEQ ID NO: 10920 - DNA, 818 bp, Zea mays
  misc_feature: Ceres CLONE 1344496-F
  misc_feature (312)..(312): n is a, c, t, g, unknown, or other
ggatcccccgggctgcagggagagagagagctcagtagacaccccccccccccacaggaacactacgactactccgaattggccacactccccagaaaacgaaaaagggggagcattgtatctgcttcaatgaatactgtatcagctggcaaaacagtagcaagtaaatgtccagtaatgtttagtggtgagcattagctattacgatacgtatctggtatgaatgttttggaattctggtgactgcgtgcgaccgtgcgatgattctgtcattgtgcagaaatgagggcgctctagatcttgggtacggcnttagagtgatgaagaatacgcatctgatgtaaggtaatcagagtcatcatggagcgctcagggcccaattcgccctatactttctagtggtgcgcctggcagccacatcgcccttaataggagtccaattacaatacactgggccgacgtttaaaaacgggcggagccggaaaaaccctgttggtcccccagttaatcggccttgggagcccatccccctttcgcccatccggagtaaaagggtataagggcccgaccgatggccctttctaaaagttggcccccccggaaggcccagggtaaatttttgggggtaaaatttttgttaaaatcccgggaaaattttgggaaaaaaccccctttttttacccaaaaggcccaaatccgggaaaccccctttattctcaaaaaaaacaccgacccgcggtttaagggtgcgcccccctttggaaaaaagggccctttttaaaaaaaggggccccccgcccccaggggggaaaacccct

SEQ ID NO: 10921 - DNA, 881 bp, Zea mays
  misc_feature: Ceres CLONE 1344557-F
  misc_feature: Encodes the peptide sequence at SEQ ID NO. 10922
  misc_feature (781)..(781): n is a, c, t, g, unknown, or other
  misc_feature (814)..(814): n is a, c, t, g, unknown, or other
  misc_feature (824)..(824): n is a, c, t, g, unknown, or other
  misc_feature (844)..(844): n is a, c, t, g, unknown, or other
  misc_feature (853)..(853): n is a, c, t, g, unknown, or other
gcggtggcggccgctctatactagtggatcccccgggctgcaggcccccccccccccccccgattggttgatgagttcttagcaaagtcaaatgtatcaaggtgtgttgacttcaaggagactgccgatgttattgcgaagcttggcttcaaaatgttcttgggcgtgactgcaaccgtgaccaattgggatgctgagggtacaagttgcagccttgtcctggaagacaaccctcttgttgatttcgttgagctccctgacacttgccaaggccttcagtattgcaatttgttaagtggagttattaggggggcattggaaatggtgtctatgaaggcggaggtgacatgggtgcgtgacatgcttcgcggggacgatgcctatgagatgcgggtgaagcttatcaagcaagtcccggaggaatacccctacaaggatgatgactagttctattttagtgcaagattgcttgtttggattttgacatcgttttcgtcgatggtccgtagttctgctataacctgatatcataggaggaaagctgcgtctgttttgcttgtgtattgtagaaatcatacataatctttcctgagttgcggctttgaattagcctgctggattcgctatgcaaattggtgttatctagaattaaagtattttcgatcttatcggtttgccctcatttcatgtaaaaaaaaaaaaaaaaaaactcgagggggggcccggtacccaattcgccctatagtgagtcgtattacaattcactgggcgtcgttttacnacgtcgtgactgggaaaaccctggcgttacccnacttaatcgncttgcagcacatcccctttncccagctgncgtatagcgaagagggccgcacgatcgc

SEQ ID NO: 10922 - protein, 97 aa, Zea mays
  misc_feature: Ceres CLONE 1344557-F
  misc_feature (1)..(84): Pfam Name: TRAPP_Bet3 Pfam Description: Transport protein particle (TRAPP) component, Bet3
MFLGVTATVTNWDAEGTSCSLVLEDNPLVDFVELPDTCQGLQYCNLLSGVIRGALEMVSMKAEVTWVRDMLRGDDAYEMRVKLIKQVPEEYPYKDDD

SEQ ID NO: 10923 - DNA, 876 bp, Zea mays
  misc_feature: Ceres CLONE 1344567-F
  misc_feature: Encodes the peptide sequence at SEQ ID NO. 10924
  misc_feature (784)..(784): n is a, c, t, g, unknown, or other
  misc_feature (799)..(799): n is a, c, t, g, unknown, or other
  misc_feature (852)..(852): n is a, c, t, g, unknown, or other
  misc_feature (876)..(876): n is a, c, t, g, unknown, or other
tccccgcggtggcggccgctctagaactagtggatcccccgggctgcaggaattcggcaccagagtcccccccccccccgccccccttcccaaaccctcttcttccccctcacgtgctcgacccagatcgagggctcgatccgtcggccatggcgctggagtgggtggttctgggctacgcggcgggcgcggaggcgatcatgctgctgctgctgacgctgccggggctcgacggcctgcgccggggcatgatctccgtggtgcggagcgcgctgaagcccatgatgtcggtagtgcccttctgcctcttcctgctcatggacatctactggaagtacgagacgcgccccacctgcgacgacgagcacgcctgcaccccctccgagcacctccgccaccagaagtccatcatgaagtcgcagcggaacgcgctcctcatcgccgccgcgctgctcctctactggatcctcttctccgtcacccagctcgtcgtcaggctcgagcagatgcagcagcgcgtcgacaagctcaggaagcgcgacgactgatggatccgcatccatccggtgggctcgttcttcctctgcctgccttgtgttcctgctttatgttgtggtgctgatgttttagatctcggatcgtaatttgagacctgctggtagcatttgcttcctttgccttgccgtcttcagataaaaaagaacagcgctcttggaaacgatgataatgtttaggatgtttggacgaatggtatctgtcgtaattgatgtcttcatccatgaanttggtggtgtcactncatgtacactgagatatttggtaatagctactagtgctggttttatcatgtgnatatgccgatgctgtaatggagtn

SEQ ID NO: 10924 - protein, 132 aa, Zea mays
  misc_feature: Ceres CLONE 1344567-F
MALEWVVLGYAAGAEAIMLLLLTLPGLDGLRRGMISVVRSALKPMMSVVPFCLFLLMDIYWKYETRPTCDDEHACTPSEHLRHQKSIMKSQRNALLIAAALLLYWILFSVTQLVVRLEQMQQRVDKLRKRDD

SEQ ID NO: 10925 - DNA, 880 bp, Zea mays
  misc_feature: Ceres CLONE 1344577-F
  misc_feature: Encodes the peptide sequence at SEQ ID NO. 10926
cgctctgaactagtggatcccccgggctgcagggagagagagagagagagagagctcactagtccccccccccccggcgcgtcacccccagcatctacgggcagatgaccgcgggcgtgacggtgagccaggggctgtaccagtacgggcctttcctcatccagctgcaggactgcaccttcgtgcgcgacaccttcacgaccatcaaccagggctactgcccggggttggagcgctacagcaagtgggtgtacgtgggcctggtgatggtctcgtcggcggtgatgctgtcgctcatcttctgggtgatctacgccagggagcggcggcaccgcgtgtacagcaagcagcaccagccgtacccggtggaggacaagccggcggcgacggtcccgggcgcttgaattgatatggcccgttccagtgctgctgtgcatactccgcgctagttgggttttacgtggtggtgtaggtggatgatgtaccctggattgttgttcgtttgcttggtgttgctgtatgtttgctgattttaagttgttgtgcattctcgtactgacggtagctgtatgaattgattgtgttgggattggttattaattaggtgtcttcagttcgtttctaaaaaaaaaaaaaaaaactcgagggggggcccggtacccattcgccctatagtgagtcgtattacaatcactggccgtccgtttacacgtcgtgactgggaaaccctggcgtacccactaatcgcttggaggaatccccctttcgcaggtggcgtataacgagaaggccgcacgatcgccttcccacagtgccagcctgatggcgatgcaaatgaagcggtaaattttgtaaaatcgcggtaattttgttaacactc

SEQ ID NO: 10926 - protein, 99 aa, Zea mays
  misc_feature: Ceres CLONE 1344577-F
MTAGVTVSQGLYQYGPFLIQLQDCTFVRDTFTTINQGYCPGLERYSKWVYVGLVMVSSAVMLSLIFWVIYARERRHRVYSKQHQPYPVEDKPAATVPGA

SEQ ID NO: 10927 - DNA, 791 bp, Zea mays
  misc_feature: Ceres CLONE 1344629-F
  misc_feature: Encodes the peptide sequence at SEQ ID NO. 10928
ggcggccgctctagaactagtggatcccccgggctgcaggcccccccctctactgctccgagatctacccgctgcggctgcgcgcgcaggctgctgccatcggcacggggctcaaccggatcatgagcggcgccaccaccatgtccttcctctcgctctccaacgccatcaccatcgccggcagcttctacctgtacgcgtgcatcgccgccgcaggctgggtgttcatgtacttcttcctgccggagacgatgggcaggagcctggaggacaccgtgaagctcttcggcaaggacgcggacgacgaggacgtcggcgacagccgtcgtgacgcgcccagtaagaagccctccacttccactgagctgagtgctcagcactgagtgatgtgccatgcatgaaacacgtgtcctcccgagtgtgaccgaagcttatgtctaaagcttcgatgatacagtctactcctagtatcttgtgtgctcgaactgtggtgaatcttttgtagatcccgggcctctcctttttttttatctgttaaaaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatgacgaatggcaaattgtaagcgttaatatt

SEQ ID NO: 10928 - protein, 86 aa, Zea mays
  misc_feature: Ceres CLONE 1344629-F
MSGATTMSFLSLSNAITIAGSFYLYACIAAAGWVFMYFFLPETMGRSLEDTVKLFGKDADDEDVGDSRRDAPSKKPSTSTELSAQH

SEQ ID NO: 10929 - DNA, 649 bp, Zea mays
  misc_feature: Ceres CLONE 1344647-R
  misc_feature: SWISSPROT Homolog: EC 1.11.1.6 Catalase
cgattgggtaccgggccccccctcgagtttttttttttttttttttttttttttttttttttttttttttttttttttttttttaaacaaaaactttggggagtcataactttatagataatcaaagagctcaaaatactagaacttagacatctctgcactaatagggggcgcaagcaataaacgaaatatcctaagtacacagccctgggggagtttttttctcgctagtcttctcatccgcagggcaatgtcacaagggatatcaaaattccccagttagcaatggcatgagttccaataccatcacgggagcttgagcatcaaaaaaactatgtctgtcatgagagcaggactaacgcgagagtttccgggaaggatcaaagctgaatctcctccctgtcactgttttgtgcaccattgctgaacggaaagggtagcctgcatcaaaacggcagcgcctctcctggtgccaaattcctgcagcccgggggatccactagttctagagcggccgccaccgcgggggagctccagcttttgttccctttagtgagggttaatttcgagcttggcgtaatcatggtcatagctgtttcctgtgtgaaattgttatccgctcacaattccacacaacatacgagccgga

SEQ ID NO: 10930 - DNA, 853 bp, Zea mays
  misc_feature: Ceres CLONE 1344647-F
  misc_feature: SWISSPROT Homolog: EC 3.2.1.23 Beta-galactosidase
  misc_feature (447)..(447): n is a, c, t, g, unknown, or other
  misc_feature (448)..(448): n is a, c, t, g, unknown, or other
tccccgcggtggcggccgctctagaactagtggatcccccgggctgcaggaattcggcaccaggagaggcgctgccgttctgatgcaggctaccctctccgttcagcaatggtgcacaaaacagtgacagggaggagattcagctctgatccttcccggaaactctcgcgttagtcctgctctcatgacagacatagcttctctgatgctcaagctcccgtgatggtattggaactcatgccattgctaactggtgaattttgatatcccttgtgacattgacctgcggatgagaagactagcgagaaaaaaactcccccatggctgtgtacttaggatatttcgtttattgcttgcgcccactattagtgcagagatgtctaagttctagtattttgagctctttgattatctataaagttatgactccgcaaagtatttgattannaaaaaaaaaaaaaaaaaaaaaaaaaaaaaaaaaaaaaaaaaaaaaaaaaaaaacctcgagggggggcccggaacccaattcgccctatagggagtcgaattacaattcactggccgccgttttacaacgtcgggactgggaaaaccctggcgttacccaacttaatcgccttgcagcacatccccctttcgccagttggggtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaatcccttataatcaaaagatagaccgagataggggtgagtgttgttcagtt

SEQ ID NO: 10931 - DNA, 846 bp, Zea mays
  misc_feature: Ceres CLONE 1344662-F
  misc_feature: SWISSPROT Homolog: EC 3.2.1.23 Beta-galactosidase
  misc_feature (831)..(831): n is a, c, t, g, unknown, or other
tacccgcggtggcggccgctctagaactagtggatcccccgggctgcaggtccccccccccccacccccccgggatatctttgacgaccgatctgtccaactccagccttcggggctgcagcagcttattcttgatatgcacttcattgtcgagattgctgtgtgtggaaggtttccatatagaccagttcagcagcttgtgtccacaatcataaccagagcagttgcagctttctcagcaaggggtgttgatccacaaagtgttcttcctgaggacgggtggtttgtcgacaccgccaaggccgcaatccacaagctcatgctgggggtttctgggtccgagtccgagcccgagcctgatgcggaagaacatattgctctgcatggtgaggtctcagattctgaggagagctcaggtgcatcgacagtaggatcagaagactcattcgcttctgcgaagaacgatgatctagaaagccccgtttacttcactgaccctgagagttgagaacttctcaggtcgtcgttgtagattcagttatcgtttatttgaagttttgtcatcctgcatagttggcagatttcagaaccgtggaacatcgttgcactcaagatgaaaacaaagaacccagaaatgccgtttgtaattatggtcgttgctattgtaccttgttgcttaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcngcagctggcgtaata

SEQ ID NO: 10932 - DNA, 812 bp, Zea mays
  misc_feature: Ceres CLONE 1344681-F
  misc_feature: Translation starting site: 337
  misc_feature: SWISSPROT Homolog: EC 3.2.1.23 Beta-galactosidase
  misc_feature (477)..(477): n is a, c, t, g, unknown, or other
  misc_feature (582)..(582): n is a, c, t, g, unknown, or other
  misc_feature (624)..(624): n is a, c, t, g, unknown, or other
agtggatcccccgggctgcaggcgaaaccggtaaatacggtcacccgacgccaacccaggtcaacgtcaaagcgacggcgggtaaatgcattctgatttccggtcacgatctcaaagatctctacaacctgctggaacagaccgaaggcacgggcgttaatgtctacacccacggcgaaatgctgcctgcgcatggctacccggagctgcgtaaattcaagcatctggtcggtaactacggcagcggctggcagaatcagcaagtggagttcgctcgtttccctggccccatcgtgatgacctcgaactgcatcatcgacccaaccgtaggcgcttatgacgatcgtatctggacccgcagcattgttggctggcctggcgtgcgtcatctggacggtgatgatttctctgcggttatcacccaggcgcaacagatggcaggcttcccgtacagcgaaattccgcaccttatcaccngtgggttttggtcgccagacgctgcttggcgctgctgatacgctgattgatctggtgagccgtgaaaaactgcgtcatatcttcctgcttggtggctgtgacggngggcccggtacccaattcgccctatagtgagtcgtattacanttcactggccgtcgtttttacacgtcgtgactgggaaaaccctggcgttacccaacttaatcgccttgcagcacatccccctttcgccagctgcggtaatagcgaagaggcccgcaccgatcgcccttcccaacagttgcgcagcttggatggcgaatggcaaattgtaaagcgttattattttggta

SEQ ID NO: 10933 - DNA, 840 bp, Zea mays
  misc_feature: Ceres CLONE 1344715-F
  misc_feature: Encodes the peptide sequence at SEQ ID NO. 10934
acttgtggatcccccgggctgcaggaattcggcacgagagagagagctcactagtcccccccccccccccagttccaactccaacctacgcagcagaggccagccacctccccgtcgctctcacgctcttcgtgcccgccgcctcccctccgtctctccctctcccctcccgtctgacgcacatgggctccatcgccggatcttccgccctctccttcgccaggcccgtcaaggcaatcaacacaaattctctagctttctcaccgttgaggaagggcaacacattcctccgcctgcaaccaatgcctatgagatctgtttcctgcgctgccaagaaggatacaacagagaaggtttgtgagattgtgaaaaagcagcttgctcttcctgaccatactgaagtttgcggtgaatcgaaattctctgaactcgctgcagattcactgcacacggttgagattgtgatgactctcgaggagcccttcgatattagcgttgaggagtccaccgaacaaacaatcgccacatggtgaaaacgccgctgtacctcatccactagcttgttgctggtaaagcgcaattctggacctcctccatcgctggcctaccaactcaaggcctatgcccttggtctaagccctctatggtcccgaacaattggggatttttttcgacacggctgtctctaatccccggggccgcatcatatatcaaatggttttattgcgccccccacccttttcggcgggaggcataccgtggtatatttcctctcctggaaccggcggagcctggcgtgtattgaatattacccccccacccccgcctatatattcaacg

SEQ ID NO: 10934 - protein, 116 aa, Zea mays
  misc_feature: Ceres CLONE 1344715-F
  misc_feature: SWISSPROT Homolog: EC 6.1.1.13 D-alanine--poly(phosphoribitol) ligase
MGSIAGSSALSFARPVKAINTNSLAFSPLRKGNTFLRLQPMPMRSVSCAAKKDTTEKVCEIVKKQLALPDHTEVCGESKFSELAADSLHTVEIVMTLEEPFDISVEESTEQTIATW

SEQ ID NO: 10935 - DNA, 865 bp, Zea mays
  misc_feature: Ceres CLONE 1346741-F
  misc_feature: Encodes the peptide sequence at SEQ ID NO. 10936
  misc_feature (809)..(809): n is a, c, t, g, unknown, or other
gcggtggcggccgctctatcaatagtggatcccccgggctgcaggtttccccccccccggtgcttcaaagattgcgatcttgaatgcaaactacatggcaaaacgtctagagaaacactacccagttctgttccgtggagtcaacggaactgttgcccatgaattcatcattgatctaagggcatttaaggcgactgctggtatagagccagaggatgtggcaaagcgcttgatggactacgggttccacgcaccgaccatgtcatggcctgttcctggcacacttatgattgaaccaactgaaagtgagagcaaggccgagctggacaggttctgcgacgctcttatctccatcagggaagagattgcagagatagaaaacggcaaagcagatgtgcttaacaatgtcctgaagggcgctcctcacccaccgcaactcttgatgggtgacacatggagcaagccgtattccagggagtacgctgcgttccccgcggcatggctccggggcgccaagttctggccaacaactggtcgtgtggacaacgtctacggggaccgcaacctcatctgcacgctgcagcaggcgacccaggtggccgaggaagccgcggccgcaactgcaaccgcgtaatctcgtccgagaaccacgataattgatcgcggcgtgcgattgtgcgaaacatcctcaagaaaatataatgcatgcttcctgtaggagggaagcatcgtcatcttcctcgtcatcctttctgcaggtacatactagctcatggaagcgcctgatcccccacaccaccgtaaaacanacaaaagttgccacttgttatttttgaaattacttcattgcctctctgttattcca

SEQ ID NO: 10936 - protein, 179 aa, Zea mays
  misc_feature: Ceres CLONE 1346741-F
  misc_feature: SWISSPROT Homolog: EC 1.4.4.2 Glycine dehydrogenase (decarboxylating)
MAKRLEKHYPVLFRGVNGTVAHEFIIDLRAFKATAGIEPEDVAKRLMDYGFHAPTMSWPVPGTLMIEPTESESKAELDRFCDALISIREEIAEIENGKADVLNNVLKGAPHPPQLLMGDTWSKPYSREYAAFPAAWLRGAKFWPTTGRVDNVYGDRNLICTLQQATQVAEEAAAATATA

SEQ ID NO: 10937 - DNA, 885 bp, Zea mays
  misc_feature: Ceres CLONE 1346778-F
  misc_feature: SWISSPROT Homolog: EC 3.2.1.23 Beta-galactosidase
  misc_feature (879)..(879): n is a, c, t, g, unknown, or other
cgcggtggcggccgctctataactagtggatcccccgggctgcaggaattcggcacgagagagagagagagctcactagtccccccccccccccgtgctggagagagcagacctgccagacgtctgatgacgcgcagttcatgcgcacagaggcgatccgtaattttgtgacgaggagcgagtgtatgtaacacgcagaaaacatagcctgcaaatatataaatatggtatatccgacaaaaaaaaaaaaaaaaaaaaaaaaaaaaaaaaaaaaaaaaaaaaaaaaaaaaaaaagaaaaaaaaaaaaaaaaaaacctcgagggggggcccggtacccaattccccctatagggagtcgtattacaattcactggccggcgttttacaacgtcgggactgggaaaaccctggcgttacccaacttaatcgccttgcagcacatccccctttcgccagttggggaaatagcgaaaaggcccgcaccgatcgcccttcccaacagttgcgcaccctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaacccgtctatcagggcgatggcccactacgtgaaccatcaccctatcaagttttttggggccgaggtgccgtaaagcactaaatcggaaccctaaagggagccccgaatttaaagcttgacggggaaaagccggcgaacgtggcgagaaagaaggnaaaaaa

SEQ ID NO: 10938 - DNA, 878 bp, Zea mays
  misc_feature: Ceres CLONE 1346782-F
  misc_feature: Encodes the peptide sequence at SEQ ID NO. 10939
  misc_feature (158)..(158): n is a, c, t, g, unknown, or other
  misc_feature (161)..(161): n is a, c, t, g, unknown, or other
  misc_feature (734)..(734): n is a, c, t, g, unknown, or other
  misc_feature (843)..(843): n is a, c, t, g, unknown, or other
  misc_feature (844)..(844): n is a, c, t, g, unknown, or other
  misc_feature (854)..(854): n is a, c, t, g, unknown, or other
  misc_feature (855)..(855): n is a, c, t, g, unknown, or other
aaagctggagctccccgcggtggcggccgctctatactagtggatcccccgggctgcagggtccccccccccccgacgaaggtaagatgttcctgcggaggatcctgaccggcgggggcggcctggcggccctgagggcggcgcgcgccgtgaagganacnacggggatcgtgggccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgccaggaggaggaggactggaagcgcatcgaggaccgaatcggatgcgggcaggtcgaggagctcatcgaggaggccgaggacgagctcaagctcatcgctaaaatgattgaatgggatccatggggtgttcccgatgactacgaatgtgaggtgattgaagacgacaccccaattcctaagcatgttcctcagcaccggcctgttgctcttcctgaggagttcttcaaggcactagatgctgtcaaatctgatcctgctcttcaaggcgatgctcctcctcaggtgaaggcgtaaggatggctgttcctggctaacgtcatttcacattttgccgcggggggtagggactggtttcttgtgtcatttgccagcaatgcgcttgctctgagcagaataatttctggtgagtaccatcaaagngtgaatttgaacttagtgattcgcgacagaaaacttgttgccatgaatactcgatgccctgaacatcgtttgtttgacgttatatccatggtgacaatatttgatgctnncaaaaggaannaaaaaaaaaaactcgaggggggg

SEQ ID NO: 10939 - protein, 173 aa, Zea mays
  misc_feature: Ceres CLONE 1346782-F
  misc_feature (35)..(91): Pfam Name: ETC_C1_NDUFA5 Pfam Description: ETC complex I subunit conserved region
  misc_feature (24)..(24): Xaa is any aa, unknown, or other
MFLRRILTGGGGLAALRAARAVKXTTGIVGLEVVPNAREVLVGLYERTLKEIKAVPEDEGYRKAVESFTGHRLQICQEEEDWKRIEDRIGCGQVEELIEEAEDELKLIAKMIEWDPWGVPDDYECEVIEDDTPIPKHVPQHRPVALPEEFFKALDAVKSDPALQGDAPPQVKA

SEQ ID NO: 10940 - DNA, 932 bp, Zea mays
  misc_feature: Ceres CLONE 1346809-F
  misc_feature (458)..(458): n is a, c, t, g, unknown, or other
  misc_feature (880)..(880): n is a, c, t, g, unknown, or other
aagctggagctccccgcggtggcggccgctctagaatagtggatcccccgggctgcagggagagagagagagctcactagtcccccccccccccctcggcgcgcagggaatcccagtcaagaacgacagtggctcctccttggtgagaaggaaggctcctacgtgttcctgttgacgtccacctcctggacgtggcgatgcaacgctgctagcagtatctatgtatgctgcatgcatgtgccgaagcacgtgatcgtcgacgtgtactagctcatcgtctgatccgttgcctgtgctctgtactgtacagatcagcgtcaagataaagaaatgcctggtccttgtttacagttttgatgatgaagggctggaattgctggaacaaggaagtgattcgctgcagggggggcccggtacccaattcgccatatagggaccgtattacaattactggccgnaggtttacaatgtcctgcctgaggaaaccgtggcgtaccccacttaatcgactggcagcaattccccttttcgccaggtggggtaaaaggaaaaatgcccacacggattccccttcccaatagatgcccagccttaattgctgaaggccaattggaaaacgtaaacttttgggaaaattccggtaaaatttattgtgatgccgttactttttaaacaatagggccaaattgggcaaattccctttaaaataaaaaaaattaacccaaaatggggtaacctgtttttcaaatttgggacaagatccccacttttaaaaaacggggactccctgggtgaagggcggaaaaaccttcctctcgggggaagggccccatagcttaaccctcctccctattttgtttttctcggggtgagggggccnaaaccccctaattgggaacctgaaggggacccccctatattaaatgttgaaa

SEQ ID NO: 10941 - DNA, 961 bp, Zea mays
  misc_feature: Ceres CLONE 1346829-F
  misc_feature: Translation starting site: 199
  misc_feature: Pfam Name: LSM Pfam Description: LSM domain
  misc_feature (646)..(646): n is a, c, t, g, unknown, or other
  misc_feature (961)..(961): n is a, c, t, g, unknown, or other
tcaccgcggtggcggccgctctagaactagtggatcccccgggctgcaggaattcggcacgaggagagagagagagctctagtccccccccccccggtctttcttctgctcttccatcgcgccagtgttttgagaagctggtcggcgctcctagatcccttcgcctctctcgcgttcgaggctaggtagccgccacccatgagccgctcggggcagcctccggatctcaagaagtacatggacaagaagcttcagattaagctgaatgcaaaccgtgttgttattggcacacttcgggggattcgaccagttcatgaatctggtgatcgacaacactgtggagggtcatggaaatgacaaaacagatatttgaatggtgggttatcaggggaaaccgtgttgtcatgatcgaggcactgaaccccgttgccaaagtcgcagggaatcctttttttttcgcctgaaataggcccccgcatggaaaactggttggtaaatggtatggaggcgaacccgggttgtactttccgaactcggggcttttttgcacagcaaacttaacctccggttaccaagcccccccctggtttcaatgggggagcttccaaataaaaaaaaaataaaaaaaaccttcggggggtggggnccgggtacccacaatttcccccctataggggggccgcttattaccattccccggggccctcccgttattccaacccccggggaggggaaaaaagcgtgggggtttccccatatttaattcgccctaggaagaccttcccccctttcttgcgggggggtggtaaaaggcgagagagggcccggctccggttgccttctccctacatttttcgccaccccgaacggggcagtggaatatgggcaacgctcctattttggtcaaccatccgcgccatatttgggtgacaccctctctctttttacacgatgcccgaan

SEQ ID NO: 10942 - DNA, 782 bp, Zea mays
  misc_feature: Ceres CLONE 1346862-F
  misc_feature: Pfam Name: Myb_DNA-binding Pfam Description: Myb-like DNA-binding domain
aagctggagctccccgcggtggcggccgctctataatagtggatcccccgggctgcaggccccccccccccccaaaccttaagaaagggtgttgaagagtatggtgttggcaattggagggatattttagataacaatgctgaggctttggccggcaggacaccggtggacttgaaggacaagtggaggaacatgcttttccgttgatgtaacggggaaacatgtagctggacatgctttactagggtaaagtacatagcatgtagtcgtcgtacatcacagcactcttggtcaagcttttctggcagctgcagctacatgatttgtgtctcggtgtagtagcagccgcagcccaatcggttggcttttctggcagttgcacagcagcagactcttggtcaagcttttctggcagctgcagctacatgattttgtgttttggtgtagtagcagccgcagcccaaacggttggcttttctggcagctgcacagcagactcttggtcaagcttttctggcagctgcagcctgcagctacatgattttgtgtctcggtgtagcagcagccgcagcccaaacggttggtttttctggcagccgcagcccaaacggttggtttttctggcagctgcagctacagtattatgtgatgggactgtcgtatcatgtacaacgaaaatcacaagtgtattaaccgcagtgggtgggcaattatcttatgtgcatccatatcatgtatgatgggacccatagtggctttgcttatacagctgtgagagctct

SEQ ID NO: 10943 - DNA, 854 bp, Zea mays
  misc_feature: Ceres CLONE 1346903-F
  misc_feature: Pfam Name: Ribosomal_S28e Pfam Description: Ribosomal protein S28e
  misc_feature (507)..(507): n is a, c, t, g, unknown, or other
  misc_feature (609)..(609): n is a, c, t, g, unknown, or other
  misc_feature (777)..(777): n is a, c, t, g, unknown, or other
tacccgcggtggcggccgctctagaactagtggatcccccgggctgcaggaattcggcacgagagagagagagagagagagctcactagtccccccccccccccgaccggctccaggggtcaggtgacccaggtcagagtgaagttcttggatgaccagaaccgtctcatcatgaggaacgtcaagggccctgttcgtgagggtgacatcctcaccctgctcgagtctgagagggaggccaggaggctgcgctgaagccctggtggccttggatgtaattctgttaattttgttctatgtttgtcgaacttgccgtgtgaccttcacaacatctgctttgagatttactcagcctggattgcagttttattttatgttcctgctggaaagtgacttgccgagacatagttatcattggttatctataatagctcaatcgacgcgtgcaatctgaaggctttgtttatatgtggtaaggtcgtctaatgtagttttgtcataagttgnatgtcggttgctccaaaatctgaaggttttttgtatatgtggtaagaaaaaaaaaaaaaaaaacttcccaaggggggggccccggtacccatttcgccctantaggtgagtcgtattacattcacttggggccgtcgtttttacaacgtcgtggactggaaaaaacccctggcggtacccaacttaatcggcttggaagacattcccttttcgcagttggggaaaaaaaagcgaaaaggcccgcaccgattgcccttcccaaaattgggncaacctggaaatgggcaatggcaaattgtaagccgttaaaatttttgttaaaattcgcgcgtaaaatttttggaaaa

SEQ ID NO: 10944 - DNA, 858 bp, Zea mays
  misc_feature: Ceres CLONE 1346925-F
  misc_feature (115)..(115): n is a, c, t, g, unknown, or other
  misc_feature (373)..(373): n is a, c, t, g, unknown, or other
  misc_feature (409)..(409): n is a, c, t, g, unknown, or other
  misc_feature (474)..(474): n is a, c, t, g, unknown, or other
  misc_feature (475)..(475): n is a, c, t, g, unknown, or other
  misc_feature (511)..(511): n is a, c, t, g, unknown, or other
  misc_feature (519)..(519): n is a, c, t, g, unknown, or other
  misc_feature (568)..(568): n is a, c, t, g, unknown, or other
  misc_feature (569)..(569): n is a, c, t, g, unknown, or other
  misc_feature (574)..(574): n is a, c, t, g, unknown, or other
  misc_feature (575)..(575): n is a, c, t, g, unknown, or other
  misc_feature (626)..(626): n is a, c, t, g, unknown, or other
  misc_feature (814)..(814): n is a, c, t, g, unknown, or other
  misc_feature (815)..(815): n is a, c, t, g, unknown, or other
ccccgcggtggcggccgctctagaactagtggatcccccgggctgcaggaattcggcacgagagagagagctcactagtccccccccccccccccccaaaaagccaccaggtggngggagagaacgagggaaatttacagcatccacgaagacggcaggctttcccgccttcaggcaatagaaatgctacgtatcaccagtagcaagttgagatgtataactggcgaattggattattccaaaattgtgataaaagagtaccctacgtgttgtatatttggactggggatatctcggactcatgagaaaccaccgagactgctactgcaccgcggtgccctgacgtgttgctaacacgtgctaggtgactgangaatagttgggtattgggcgttttttttaatatggnttctgaacatgagaatgccctagtatttcattaggatgtgtacattttacaatggtttatggacnnatactgtttgatttttacttttgaactcagagcccntggttttntcacgcactacaatttttcacctaaactctttcccgaacgttttactannaaaannaaaaaggaaaaaaaaaaaaaaaaacttcgagggggggggcccgttacccantccgccctataagggagccggattacaatcactgggcccgccgttttacaacgtcgtggactgggaaaaaccctggcggtacccaccttaatcggcttgcaggaaatccccctttcgccaggtggggaaaaaaacgaaaaggccccgaaccgatgccccttcccaaaagtgcgccacccgggattgcnnaatgcaaaattgaacgcgttaaaattttggtaaaattccgggt

SEQ ID NO: 10945 - DNA, 925 bp, Zea mays
  misc_feature: Ceres CLONE 1346930-F
  misc_feature: SWISSPROT Homolog: EC 3.2.1.23 Beta-galactosidase
cacaccaaaaaaaacaaagcaaccacccacaccgggggggtgttggaacgctggagctcaccgcggtggcggccgctctagactagtggatcccccgggctgcaggagagagagagagagagctcactagtccccccgcccccccccgatcaactgggtggacatgtagcacatcagcggcgatagcagtggcaggatgactgcccacctaagatctgcggtcgttgtgcggaagctcataatcaaggccaaaaacccctcctgatgcgctgctgccctctgattcttgtgagaagctaagttgtctctgattcttgtgagaatgtacccagatacaatccgtagaataagaaagtggttgcctccattgttcttgtgccgccataacagattgtttcaagtgttcttgaaaaaaaaaaaaagaaaaaactcgaggggggtaccgggaccccattcgccttatagtgagtcgtattacaattgactggccgtcgctttacaacggcttgactgataaaagcctggctttacccaatttaatcgcctggcggtatatccccctttcgccagctggcgtaatagtgaagaggcccgcaccgatcgccctttcccaacagttgcgcacccttgaatggcgaatggcaaattgtaagcgttaataattttgttaaaaatttcgcgttaaaattttttgataaatccgctctttttttaaccaataggcccaaaatcgggaaaaaccccttataaatcccaaagaatagaccccacattacggctgtagtgttggtcccggtttgtaaccaagaattccctatttaaaggaccgttggactcccacgcccaaaagggcgaaaaaaccgtttatttagggggaagggccccccctaccgcgaacaatccccccttaatccagtttttttgg

SEQ ID NO: 10946 - DNA, 862 bp, Zea mays
  misc_feature: Ceres CLONE 1346954-F
  misc_feature: Encodes the peptide sequence at SEQ ID NO. 10947
  misc_feature (515)..(515): n is a, c, t, g, unknown, or other
cgcggtggcggccgctctagaactagtggatcccccgggctgcaggaattcggcacgagctcactagtcccccccccccccccccaaaaacgtgtgggacactaacatctcgctaggctggtacaaaaccgactccaactcacgatgcaccgaaaaaccggtggtaccacacatgccggacggcgagaagacgaccgaggcaacggccaaggatgtcggcggcggcagccagccaaaaccaccgtcccgccgcggtagcgcccgcttcgagcgcctcctctccgggctgggcgctggtccgctcgtggacgtcgagcccgacaaggttaaggacgagatccggcgatgggccaagaaggtggcggctctggtgcgccagctcagcttcggcgcctgggcggagaagagcgacggcggctcgtcggagaaccacggcgcaggcgatgatggatacgagagctgagcacctagactgcagataactttcgcgggcagtaagccagtaataactccgnctgatatgggtggcagcaccgggcaaaagcaagcgcaaaattcttctcctttaattccgtttgttcgtttctaagggcgctgaatactgtatgtgtaccacagtaaatcttacctcagttatgtcaaaagagataaaattaccaaggggcatggatgtaatgattataataaaaagctatggatattctccggcaaaaaaaaaaaaaaaaaactccagggggggcccgaacccattccccctaatgggaagcgattacattccctggccggcgttttacaacgcgggactggaaaaacctggggtacccacttaatcgctttggaactcccccttcccagttgggaa

SEQ ID NO: 10947 - protein, 96 aa, Zea mays
  misc_feature: Ceres CLONE 1346954-F
MPDGEKTTEATAKDVGGGSQPKPPSRRGSARFERLLSGLGAGPLVDVEPDKVKDEIRRWAKKVAALVRQLSFGAWAEKSDGGSSENHGAGDDGYES

SEQ ID NO: 10948 - DNA, 869 bp, Zea mays
  misc_feature: Ceres CLONE 1346972-F
  misc_feature: Encodes the peptide sequence at SEQ ID NO. 10949
  misc_feature (449)..(449): n is a, c, t, g, unknown, or other
  misc_feature (475)..(475): n is a, c, t, g, unknown, or other
  misc_feature (582)..(582): n is a, c, t, g, unknown, or other
  misc_feature (611)..(611): n is a, c, t, g, unknown, or other
  misc_feature (735)..(735): n is a, c, t, g, unknown, or other
  misc_feature (736)..(736): n is a, c, t, g, unknown, or other
  misc_feature (766)..(766): n is a, c, t, g, unknown, or other
tccccgcggtggcggccgctctagaactagtggatcccccgggctgcaggaattcggcacgagagagagagagagagagagctcactagtccccccccccccccccatccagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccnagctccgtgggtccgcagccaagggncaagctcgtgaaggtcaaggcttcgtacaagctctcggacgccgccaagaaggcatcccccaagaccaaggctaagccggcaaaggccgccgctgccaagaccacgncccccaagccggccaaggccgccgccgcnaagtcaaagaaaggcagcggctgcaaaaccaaagaaggcccgctgctgctggaccaaagcgaagtgccccaaaaaaaaaagggccggcgaaaaccccaaaaagtcccccgccgccaaggcaagnncaaagcgaaaaaaaccgggaagtccctggnctcagaaaaaagggccgaaagctccccccaagaaaagggggtgctttaggctaacctctgaaatggggggggggggcgccataaaggtctggaacaaactaag

SEQ ID NO: 10949 - protein, 95 aa, Zea mays
  misc_feature: Ceres CLONE 1346972-F
  misc_feature (35)..(86): Pfam Name: Linker_histone Pfam Description: linker histone H1 and H5 family
  misc_feature (84)..(84): Xaa is any aa, unknown, or other
  misc_feature (93)..(93): Xaa is any aa, unknown, or other
MPALAKPASRTAKPAAAPKPKPAAAKPKAATAGASHPPYFEMIKEAITALKERTGSSSQAIAKYVGDKHGASLPANFKKMLSIXAPWVRSQGXSS

SEQ ID NO: 10950 - DNA, 843 bp, Zea mays
  misc_feature: Ceres CLONE 1346976-F
  misc_feature: Translation starting site: 165
  misc_feature: Pfam Name: SSB Pfam Description: Single-strand binding protein family
gctcttaactagtggatcccccgggctgcaggccccccccccccccccgctcaggcccgtgatttcagcgacggcgtcagcggcttcccctcccgtctcttcccagtcgcctcgcgccctcgcctccggtcctccgcacaccggccggtgaccctgcatccaccatgactggtgtcagcactggattgttgacgggcttgaggagggtcatggaacagcaaaggatttcaaccgctttctgcagacaatcacgagtttcgagctctactgtttctttctctgacctcgatgagaagggtgacatggaaatatgatgataactctccaaattcaaagagggagttacgacccccaggtgtagatcccaataaggggtgggaattccgtggtgtgcacaggcccatcatctgtggcaaagctggacaagtccctgtggcaaaaattttaaggaatgggcatacaggacccgtttttactgttgaaactgggggaatgtttggaccacaagggtaattgggcccaacgatttgccaaagccagcctcatggcaccgccaaaccgcccctaatgattacttaacgggttaatgccgtcaaaagctgggggagaaatccggctgccctagttgagggggatattagaaacaggggtttacaatgacctgggttatggatccaactcaaaaacattacctgataaatagggccccgaagtggatggcaaaaatccacctggtccaaatctgggggcaccgtcccgctcattattcttttttaagtgacttaagagaataggtctgcgtcccacccctcccctgaaacaagtgcctgctattcatcgtct

SEQ ID NO: 10951 - DNA, 842 bp, Zea mays
  misc_feature: Ceres CLONE 1346981-F
  misc_feature: Pfam Name: XH Pfam Description: XH domain
  misc_feature (360)..(360): n is a, c, t, g, unknown, or other
  misc_feature (529)..(529): n is a, c, t, g, unknown, or other
  misc_feature (539)..(539): n is a, c, t, g, unknown, or other
  misc_feature (547)..(547): n is a, c, t, g, unknown, or other
  misc_feature (825)..(825): n is a, c, t, g, unknown, or other
ggcggccgctctagaactagtggatcccccgggctgcagggagagagagagagagagctcactagtccccccccccccaagaatgggggaactcgatgaaaagcctttcctaaatgcatgtaagagaaaatatgggaacagtgaataccaggtcaaagcagcagagctggtcacaaattggcaggaggaactaaagaatccatcctggtatccttttaagatgattcatgttgacggagaagacaaggaaattctggttgacgatgatacgaaactgaagtttctgtggattgagtttggcgatgacgtgtgtaatgcggtgaagaccgcattgatggagataaacgagtataacccaangtgggaggtatgttgtgcccgagctgtggaacttcaggaaaggcaggaaggcgacgatgaaggaggtgctcaagtacctgttcagtcagatggacacgacgaccaagcgcaggagggggctgagtaggtgcccttggccatgccggaaagcccagtcgttcgctgtcgnatcccgtagntgccagtnctgtcagagatgcctccctctttgtttactgtatagtgacatcctgacgttaatgttccaggtttgggtaatgcggccatggttcgttaagctcacgaaccatacagtgagcttggctagtctcgtttacgagctctttagcttcggaagtcaggtcagaacagaatattgctctttagcctcgcaagtcaggccgtcagaacagaaaaacatatgtatttataattaattttaagccaattttaactaatttaccatacgattacaacaaaccaccnctactctcaaacacccg

SEQ ID NO: 10952 - DNA, 861 bp, Zea mays
  misc_feature: Ceres CLONE 1347041-F
  misc_feature: SWISSPROT Homolog: EC 3.2.1.23 Beta-galactosidase
  misc_feature (508)..(508): n is a, c, t, g, unknown, or other
tggagctccccgcggtggcggccgctctagaactagtggatcccccgggctgcaggccccccccccccccgaacggcaacgtcctggcaaccgacgccgacggggagatcccggagctggagcccgtgcaggtggaggggacgcagcccataaccgtgggcccttactccatcgtgtttgctcacgtccccagcttctacgctcctgcgtgcctgtagctagagttttcgtctggatttttttttccagcctttctcggtgtgcatctcgtaggttaggtaagtctgtccggggtgaacggcgaagcttgttcatctctgctcatagtccgtgaagtgtgtaagctgcgaggctggaaaggtttgtggtttatgattgtttgggaaaaggagtggtcagatatataatgtgtgagcaaaagaaggaaggaagctggaaatgagataataaaaagaaagggttttggagtttaaaaaaaaaaaaaaaaaaacttcgaggggggggcccnggtacccaattcgccctaatagtgagtcgtattacaattcactgggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatatttttgttaaattcgcgttaaatttttgttaaatcagctcattttttaaccataggccgaaatccggcaaatccctataaatcaaagaaagaccgagaatagggtgagtgttgtttcatttggaaaaaaatcccta

SEQ ID NO: 10953 - DNA, 831 bp, Zea mays
  misc_feature: Ceres CLONE 1347051-F
  misc_feature: Translation starting site: 209
  misc_feature (475)..(475): n is a, c, t, g, unknown, or other
  misc_feature (568)..(568): n is a, c, t, g, unknown, or other
  misc_feature (831)..(831): n is a, c, t, g, unknown, or other
ccccgcggtggcggccgctctagaactagtggatcccccgggctgcaggaattcggcaccaggagagagagagagagagagagagctcactagtcccccccccccgacaaccatctctgaactcatctttcattctctcttgattccaatccattcttcttcaagtgccgggttctcgggtcggatcttctaagtctagctagggataatggctactgtcactactcatgcctcggcctcgattttccgaccttgtacttcaaagccaagattcctcaccggttcttccggtaggttgaaccgcgacttgtcgtttacatcgatcggttcatcggccaaaacgtcgtcgttcaaggttgaagctaagaaaggagaatggttgcccggtttggcatcgcctgattatctcaccggcagtcttgccggtgacaatgggtttgacccgttgggtctagcagaggatccagagaacttngaaatggttcgtccaggcagagctggtcaacggacgatgggctatgctcggtgtcgctgggatgtttttgccggaagttttcaccaagatcgnaatcataaatgttcctgagtggtacgatgctgggaaagagcagtattttgcatcgtcgtcgacattgttccgtgatcgagttcatattgtttcattacgttgagatcagacggtggcaagacatcagaaacccaggaagtgtgaaccaagaccctatctttaagcaataagcttacctaaggggggaagttgggtaaccctgggggaatctttaacccgcttaactttgctcccacgcaagaggcctaggagaaagagtagcn

SEQ ID NO: 10954 - DNA, 923 bp, Zea mays
  misc_feature: Ceres CLONE 1347090-F
  misc_feature: Encodes the peptide sequence at SEQ ID NO. 10955
  misc_feature (459)..(459): n is a, c, t, g, unknown, or other
  misc_feature (501)..(501): n is a, c, t, g, unknown, or other
  misc_feature (507)..(507): n is a, c, t, g, unknown, or other
  misc_feature (513)..(513): n is a, c, t, g, unknown, or other
  misc_feature (534)..(534): n is a, c, t, g, unknown, or other
tacccgcggtggcggccgctctagaactagtggatcccccgggctgcaggcccccccccccccccccgtacatgctgaagggtccgcttgaggctgctccccccgctagggacttcgttggggcgctcaaggcgtcctacgatcgaactggcttgcctgctctgattgcggaggtcaagaaggcttcaccaagccggggtgttatcagggagaattttgatccggttcagatcgctcaggcatatgagaaaaacggagcagcatgccttagtgttcttacagatgaaaagtactttcagggaagtttttacaacttggaggctatacgcaatgctggagtccagtgccctcttctgtgcaaagagttcattattgatgcttggcaactttactatgcacggtccaagggtgcagatgctgttcttctaatagctgctgtattacctgaccgcgatatcnaatacatgtttgaaaattttgcaaatacttgggatggctgcntttagntgaggntcatgacgaaagagaaatggnaccgtgttttagggattgatggtgtacagctcataggcatcattaaccgtaatctcgagaacattggagttggaattacaaacccaaaaaagcttctggaaaggggacgaggacaggtttatactcaaaaggatggaatggttgtaaggaaacccggcctggccacccggaagaaaatacgccgctcaaaacctgggacaaaaggtttccccggggaaccccttcaggggggggtccggaaaaaaatccggggtttttcgaaaaaattcccagggggggaccctagaacccgccaaaaaacaaaaataccaaacccctcttttaagaagcggggttttttttggggggaaaaaaaggggggccaaaaaccccctccgagagttggcggc

SEQ ID NO: 10955 - protein, 143 aa, Zea mays
  misc_feature: Ceres CLONE 1347090-F
  misc_feature (1)..(141): Pfam Name: IGPS Pfam Description: Indole-3-glycerol phosphate synthase
  misc_feature: SWISSPROT Homolog: EC 4.1.1.48 Indole-3-glycerol-phosphate synthase
  misc_feature (130)..(130): Xaa is any aa, unknown, or other
MLKGPLEAAPPARDFVGALKASYDRTGLPALIAEVKKASPSRGVIRENFDPVQIAQAYEKNGAACLSVLTDEKYFQGSFYNLEAIRNAGVQCPLLCKEFIIDAWQLYYARSKGADAVLLIAAVLPDRDIXYMFENFANTWDGC

SEQ ID NO: 10956 - DNA, 932 bp, Zea mays
  misc_feature: Ceres CLONE 1347104-F
  misc_feature: Encodes the peptide sequence at SEQ ID NO. 10957
  misc_feature (739)..(739): n is a, c, t, g, unknown, or other
  misc_feature (748)..(748): n is a, c, t, g, unknown, or other
  misc_feature (820)..(820): n is a, c, t, g, unknown, or other
  misc_feature (821)..(821): n is a, c, t, g, unknown, or other
  misc_feature (899)..(899): n is a, c, t, g, unknown, or other
  misc_feature (900)..(900): n is a, c, t, g, unknown, or other
  misc_feature (931)..(931): n is a, c, t, g, unknown, or other
ggagctccccgcggtggcggccgctctagaactagtggatcccccgggctgcagggagagagagagagagagagctcatagtcccccccccccccccacttgtgtagcccaacgagaagagcggcggcgcgggcggacaaggagcaggcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggagaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgcctgnacagtgtgnccgagctgatgggtacatccttgagggtaaagagctttgagtctacatgaaagagctacagaggaagaaggnncagagcgctgtagcttaaagcattctcatggattgtctgcaccgaaatgtgtgtctgatgagtacacttttttttggnntagcgctcaagtcagagcgttatgcatgttnc

SEQ ID NO: 10957 - protein, 207 aa, Zea mays
  misc_feature: Ceres CLONE 1347104-F
  misc_feature (1)..(188): Pfam Name: Ribosomal_S8e Pfam Description: Ribosomal protein S8e
  misc_feature (189)..(189): Xaa is any aa, unknown, or other
  misc_feature (192)..(192): Xaa is any aa, unknown, or other
MGISRDSMHKRRATGGKQKAWRKKRKYELGRQPANTKLSSNKTVRRVRVRGGNVKWRALRLDTGNYSWRSEAVTRKTRILDVVYNASNNELVRTQTLVKSAIVQVDAAPFKQWYLTHYGVDIGRKKKTPAAKKDNAEGQEVEAAAEETKKSNHVTRKLEKRKEGRTLDPHIEEQFGSGRLLACISSRLXSVXELMGTSLRVKSFEST

SEQ ID NO: 10958 - DNA, 897 bp, Zea mays
  misc_feature: Ceres CLONE 1347120-F
  misc_feature: Encodes the peptide sequence at SEQ ID NO. 10959
  misc_feature (444)..(444): n is a, c, t, g, unknown, or other
  misc_feature (751)..(751): n is a, c, t, g, unknown, or other
tccccgcggtggcggccgctctagaactagtggatcccccgggctgcaggaattcgatatcgagattatactttaccctataacgtcgaggattacacctcaatgcacttcgccctatagcgactcgaattgacattccctggccgtccccatattactccccgagtggcacatccctgtttctacccatgttaatctacttgaaaggcctccccctttcgccctttgcagcaatagcgaagactgcctgaccaatggcccttcgcaacagttgctatttctgaatgattcatgttaaattgtaggcaaataatattcatgttattatccacgatgactttttgttaaatctcctctttttttaaccagtatagaccaatctaggaattcccgtatatctcgtttgaatagacagacatctattagagagctgttcctccttcnaacaagagtccactatcaactatcgtggactcgaaccactacgggaaccatcacgctaatcaagttgatggcccactacgtgacccatcaccctaatccagaaccctgaaggcaagccgccatatagagctagatcggaaccctcgagggacgccccgatttagaaattgacgaaaaaaaacggagaacgtgctaagaaactaacgaaagaaacggacaggagtgcgcgatacgccactgccaacgtgtattaatgcacctgtacaggaaccaccaagccggcacttctcaatgcaacgctacaggnagcgccatgtgtctacttttcgagaacgtgcaagaacctctattcgtgtatcatctacctgattcagcttcgatacgctcatgaaagaatagcctgatattgctcctttctagtcgacatgatcccttgatgctgcacatgccgtg

SEQ ID NO: 10959 - protein, 43 aa, Zea mays
  misc_feature: Ceres CLONE 1347120-F
PRGGGRSRTSGSPGLQEFDIEIILYPITSRITPQCTSPYSDSN

SEQ ID NO: 10960 - DNA, 923 bp, Zea mays
  misc_feature: Ceres CLONE 1347124-F
  misc_feature: Encodes the peptide sequence at SEQ ID NO. 10961
  misc_feature (861)..(861): n is a, c, t, g, unknown, or other
  misc_feature (923)..(923): n is a, c, t, g, unknown, or other
tccccgcggtggcggccgctctagaactagtggatcccccggacccgatgcacctagatggagcgcattacaattccctgtgacgcggtttacgcggcacgtactgacagaaacctgggggtgccgacttaatcgccttgcagcacatccccctgtcgccagatggcgctgtagccaagaggactccgcaccgatcggccttcccatcagatgcgcacgctgaatggagaatggaaaattgaaagccataatatcttgacacaattcgagatacacttatggtatatacggtcattttttaaccaacaggtcgaacccataaagatcccttatacatctcaatgatagaccgagataggcgtgagggctgttccagcccggaacaagagcccactattagagaaggtggactcccacgtttcaggacgtgaaaccgtatatcagggcgacggaccaatacgcgaaccatcaccctaatcaagctgtttggcgacaaggagacggaaagcactaaatacggaaccctaaagggagcccccgatttagtagcttgacgtcgaaagccagcgaacgtggcgagatacggcagggaccatagtcgatggagcggtcgctcacggcgctggcaagagtgtcggtcacgctgcgcagtaccaccacacccgacgcacttagtgctccgctacaggacgcgtaaggagcgactattcggcgaaggtgcgctgcaccacccatcgcctatattacgaatacgtgcgaagatgtgtcggatcgtgatacaataaccctcgaaagtgcgtccactatattgagctggacgagtatgacgatccacatgtccgtgacgccatgatccctctnatgcgcagtttgcatgcctgtgttagtcaccagaaacgctgtcgcaatcaacgatgctgacn

SEQ ID NO: 10961 - protein, 44 aa, Zea mays
  misc_feature: Ceres CLONE 1347124-F
MRTLNGEWKIESHNILTQFEIHLWYIRSFFNQQVEPIKIPYTSQ

SEQ ID NO: 10962 - DNA, 908 bp, Zea mays
  misc_feature: Ceres CLONE 1347193-F
  misc_feature: Encodes the peptide sequence at SEQ ID NO. 10963
  misc_feature (731)..(731): n is a, c, t, g, unknown, or other
  misc_feature (745)..(745): n is a, c, t, g, unknown, or other
  misc_feature (807)..(807): n is a, c, t, g, unknown, or other
  misc_feature (810)..(810): n is a, c, t, g, unknown, or other
  misc_feature (811)..(811): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (824)..(824): n is a, c, t, g, unknown, or other
  misc_feature (829)..(829): n is a, c, t, g, unknown, or other
  misc_feature (831)..(831): n is a, c, t, g, unknown, or other
  misc_feature (891)..(891): n is a, c, t, g, unknown, or other
  misc_feature (894)..(894): n is a, c, t, g, unknown, or other
  misc_feature (895)..(895): n is a, c, t, g, unknown, or other
tggcggccgctctagaactagtggatcccccgggctgcaggccccccccccccactaccaccagtaccacaccactccgcgctagctgaggacggtacagcggcacagagcgacgacgacgacacaggcgccacacatggcatcccagctctccgccgccgtgccccggttccacggcctccggggctacgccgcgcccaggtccgcggtggcggcgctgccgtccgtgagggtgggcaggaagaggtcgtcgtcgcagggcatccgctgcgactacatcggctccgccaccaacctgatcatggtgacgacgacgacgctgatgctgttcgcgggacggttcgggctggcgccgtcggcgaaccgcaaggcgacggcggggctgaagctggaggcgcgcgactccggcctgcagacgggtgaccccgccgggttcaccctcgccgacacgctggcctgcggcgccgtcggccacatcctcggcgtcggcatcgtgctcgggctcaagaacaccggcgccctcgaccagatcattggctagatccctacgtcgccgttgttaagatcagactcagcagcctcgatcgcgccgccggccggcaggtgccagctggtgactttgtaacgtgtgtgcgtgcgtacgtgtacattgcatccatcttggttccaatggacatatagctcctggtgctcctctaaaaaaaaaaaaaaaactcgaggggggggccggntaccccattcgccntatagtgagtcgtattacaattcactgggcgtcgttttacaacgtcgtgactgggaaaaccntgnncgtaccnnnactnatcgncntgcagcacatccccctttcgccagctggcgtaatacgaagaggcccgcacgatcgccttnccnnacagtgcgcagct

SEQ ID NO: 10963 - protein, 134 aa, Zea mays
  misc_feature: Ceres CLONE 1347193-F
  misc_feature (49)..(129): Pfam Name: PSI_PSAK Pfam Description: Photosystem I psaG / psaK
MASQLSAAVPRFHGLRGYAAPRSAVAALPSVRVGRKRSSSQGIRCDYIGSATNLIMVTTTTLMLFAGRFGLAPSANRKATAGLKLEARDSGLQTGDPAGFTLADTLACGAVGHILGVGIVLGLKNTGALDQIIG

SEQ ID NO: 10964 - DNA, 872 bp, Zea mays
  misc_feature: Ceres CLONE 1347197-F
  misc_feature: Encodes the peptide sequence at SEQ ID NO. 10965
  misc_feature (730)..(730): n is a, c, t, g, unknown, or other
  misc_feature (740)..(740): n is a, c, t, g, unknown, or other
  misc_feature (746)..(746): n is a, c, t, g, unknown, or other
  misc_feature (779)..(779): n is a, c, t, g, unknown, or other
ggcggccgctctatactagtggatcccccgggctgcaggaattcggcaccaggagagagagagagagctcactagtcccccccccccggagattccttgcccccttttcccttccccatcgtcgaaaccctagccccgcctcgccgccggcacgccggatcggtcggcgccatgtccaaggccagggtctacgccgacgtcaacgtgctgcgccccaaggagtactgggattacgaggcgctcaccgttcaatggggtgagcaggatgactatgaagttgtcaggaaggtcgggagaggaaaatacagtgaagtatttgaaggtattaatgttaacaataatgagaaatgcatcatcaagatcctcaagcctgtgaagaaaaagaagatcaaaagagaaattaaaattcttcagaatctttgtggaggccctaacattgtgaagctgctcgatattgttagagatcagcattcgaaaacgcccagcttgatctttgaatatgttaacaacacagatttcaaagtgctgtacccaacattaacagattatgacattcggtattacatctacgagttactcaaggcattagattactgccattcacaaggtattatgcaccgagatgtgaagccccacaatgttatgatagatcatgagcttcggaaactccggctgatagactggggtcttgctgaattctatcatcctgggcaggatataatggtcgtgntgcatccagntacttncaggggcctgagctttctggtgactttgcaganatgattactctttggaatgtggagtctgggctgcatggttgctgggatgattttcgtaaggaacattttctacgggcatgacaacatgatcaa

SEQ ID NO: 10965 - protein, 202 aa, Zea mays
  misc_feature: Ceres CLONE 1347197-F
  misc_feature (34)..(201): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 1 in US patent 7038110
  misc_feature (187)..(187): Xaa is any aa, unknown, or other
  misc_feature (190)..(190): Xaa is any aa, unknown, or other
  misc_feature (192)..(192): Xaa is any aa, unknown, or other
MSKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGQDIMVVXHPXTXRGLSFLVTLQ

SEQ ID NO: 10966 - DNA, 895 bp, Zea mays
  misc_feature: Ceres CLONE 1347209-F
  misc_feature: Encodes the peptide sequence at SEQ ID NO. 10967
cgcggtggcggccgctctagaactagtggatcccccgggctgcaggaattcctgacatcatagacagaaaggaacacgagaagctgcgaacgaaactgctcactgtcggtcaggatcgacgccatattcatgaggaaaacatcaaagaacagcatgcagagcgatttctaccagctacataatgaccctgccactctcttcccagtcagtcctgtcggagtacatatctgccactgagatcccacaaaaatgggtccatctgcataccccttattttgctgctctgattcgagttatacacattctcctcactatcatcctatctcgaaccttcaaaggctgtattccgcattcacgtgtctgcctgccaacatacaacagccaccggattatctgtcttggcatcctcaatgatcaccgtagctcgctgtgctaatctaattccgactggttgctggccatctgatccctgcttaataatcaaaattgccaccatgcgctggcagctgagatatggactctgtactatacatcatcatgacacagacgagatctctcctgtgaccagagactgacaacgacgccatgtatccacgagtaccctacactgactctccgccgttcacaaataactgccgctgctggctgagtgtctcagtagctgcaccatgattgtacactgtacgtagctctgtgtgttccatcctgaggtgaatatggacactgcctatctgactatcagcgcaatacaccttgacgctgtacaggctgtattgcgtcacttgcaggtcgtaattctgtatggcaacgacagcagagtggtagcatcttgctgcaagatttccgtctttcagtgccttgttcgatgctgctgacggtagccaatctctctatg

SEQ ID NO: 10967 - protein, 35 aa, Zea mays
  misc_feature: Ceres CLONE 1347209-F
MRKTSKNSMQSDFYQLHNDPATLFPVSPVGVHICH

SEQ ID NO: 10968 - DNA, 910 bp, Zea mays
  misc_feature: Ceres CLONE 1347235-F
  misc_feature: SWISSPROT Homolog: EC 3.2.1.23 Beta-galactosidase
  misc_feature (843)..(843): n is a, c, t, g, unknown, or other
  misc_feature (881)..(881): n is a, c, t, g, unknown, or other
  misc_feature (895)..(895): n is a, c, t, g, unknown, or other
  misc_feature (898)..(898): n is a, c, t, g, unknown, or other
tggcggccgctctagaactagtggatcccccgggctgcagccccccccccccccggctcgacccttaacgcctggaaagggcacagggagctgtgttgtccgtcagtcgctgttgtaactcaaactagtgcatacaccgtggcttgtcacggtaatttccgaagatgtccaacgttagttgagacaaccgaactgcttaccgtggcaatcactcattgtaacatcaagttgaaaatgagggctgaagtttccctcacaggctaccatatgtcagatatgtcctttgtaccactaataagtgcccctggggtcatgtatgaatgtatctcaatttgctattgcagaaatgtttggtgaaactttcatccaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaaacagagtccactattaaagaacgtggactccaacgtcaaagggcgaaaaccgtcttatcagggcgatggcccactacgtgaaccatcaccctaantcaagttttttgggggtcgaggtgccgtaaagcacttnaatcgaaacctaanggnagcccccgattt

SEQ ID NO: 10969 - DNA, 863 bp, Zea mays
  misc_feature: Ceres CLONE 1347254-F
  misc_feature: Pfam Name: Transposase_11 Pfam Description: Transposase DDE domain
  misc_feature: Pfam Name: ThiF Pfam Description: ThiF family
cgctctatactagtggatcccccgggctgcaggaattcggcacgaggagaccatccgctccagattatccggctcctccatgcgttgcctctcggctcctgctccggttttccatgccttatggaactcctcgatccgccagcgatgggtataaatgtcgatgacgcgcaaggcttgggctagcgactcgaccggttcgctggtcagcaacaaccatttcaacggggtgcgcgccagcgcttccgccgcccaggaaccgacaccaccgataccaaccacacaaatatgcgcgtcagcaaacagttgcaacgctttttcaccatacagacgcgctgtgccaccaaaacgctgacgccatgcatcactaattaccacagacatagcacctcagaattaaaaagggcgaggttatccctcaccctaaacgcataaatgcctgatgcgctacgcttatcaggcctacataactcctgcaatattttggatttgcatgatttgtaggccggataaggcgttcaccgtcgttcagatttgagatcacatggcgcggcgctactgcggtggcgatcgatcgctcctgcgccgcgcgccgtgcattgccatacaatgtcgcacggtcgatacgatcagagttggtgtgccccatccatccatgtacccatccatgcatttgtggctttattaattctttcttccccttgctttctctctccttttcctttcggcggatttctattggtgatttgtatttgtaacctaatgtgatgtacacaagtagtgcttcctctttcactggatggatctttggcctccgagatctggacctgcttttggttgtttaatccgagcgtactatacgctta

SEQ ID NO: 10970 - DNA, 824 bp, Zea mays
  misc_feature: Ceres CLONE 1347327-F
  misc_feature: Encodes the peptide sequence at SEQ ID NO. 10971
  misc_feature (525)..(525): n is a, c, t, g, unknown, or other
  misc_feature (548)..(548): n is a, c, t, g, unknown, or other
  misc_feature (772)..(772): n is a, c, t, g, unknown, or other
  misc_feature (773)..(773): n is a, c, t, g, unknown, or other
  misc_feature (775)..(775): n is a, c, t, g, unknown, or other
  misc_feature (779)..(779): n is a, c, t, g, unknown, or other
  misc_feature (782)..(782): n is a, c, t, g, unknown, or other
  misc_feature (789)..(789): n is a, c, t, g, unknown, or other
  misc_feature (790)..(790): n is a, c, t, g, unknown, or other
  misc_feature (792)..(792): n is a, c, t, g, unknown, or other
agtggatcccccgggctgcaggaagagagagagagagagagagctcactagtccccccccccccccccgacgcgccatggatcgcgtgcagccgacgattcctccgctgccatctgcccacaaacagacgactctggcggcgaattggagcacttcgagagcggcgacgcgttcaatgttccggttagatgggatctttggcgattgaagcttgctagcaactttcacggatgtagcttccatacgaagacatggcacctcttcaggcagcagttgccgttgttcaaagagatgctggcagaaagatcctgctctaagaccaacctttgcagagattatggatacaccaaactctataaaggaggtggttcggagttctgtgcatcacaagaggcatttaggtcgatctcactcttcttcgagtttatgcgcgctgcccaggacaacatcacagcgctgatggagttggacgatgtcatcgggctcgactggatctagatgggatggaccctacttgcgctgaangagagagagagggcgtacttggncttgcaggggatcgtaataaagttcatcttttttcatgggccatgttatctgccatgccaaattacccaactccagttatttccgcctttgcaagagaagaacccaaaaattttacttcttgctcaccccccaaaggggccagtgcctccccccaaatcataaagggtaacaaggtgtttggtaccaaccattttttgagatataaagcgcgggaggtttttcnncncccnccnctccgtnncnccccccccataaaaaaaaaaaaccacaaccct

SEQ ID NO: 10971 - protein, 68 aa, Zea mays
  misc_feature: Ceres CLONE 1347327-F
MLAERSCSKTNLCRDYGYTKLYKGGGSEFCASQEAFRSISLFFEFMRAAQDNITALMELDDVIGLDWI

SEQ ID NO: 10972 - DNA, 785 bp, Zea mays
  misc_feature: Ceres CLONE 1347336-F
  misc_feature: Pfam Name: Sterol_desat Pfam Description: Sterol desaturase
  misc_feature: SWISSPROT Homolog: EC 1.14.21.6 Lathosterol oxidase
  misc_feature (499)..(499): n is a, c, t, g, unknown, or other
  misc_feature (519)..(519): n is a, c, t, g, unknown, or other
  misc_feature (529)..(529): n is a, c, t, g, unknown, or other
  misc_feature (636)..(636): n is a, c, t, g, unknown, or other
cgggctgcaggagagagagagagctcactagtccccccccccctatctcgcattctcccctcgttatcggtagaaaagttccatttacgatccactacttgcgtgcactacatagttccttgatgttaagctctggtgtgtcgcttttgaagtccattactccattttgctatgagcagccattcggccatgactactaaaacacatttgctttccaggactcgcgtttcacccactggatggtattctgcaagcgataccgcatgtgcttgcgctcttcctcctcccaacgcacttcaggacgcacatcgctctcgtgttcttggagggcgtgtggacgacaaacatccacgactgcattcacggcaaggtatggccagtcatgggcgctgggtatcacaccatccaccatacgacttaccgccacaactatggccactacaccgtctggatggactgggatgtttggtacgctccgtgagccagatgatatcccagnaaaaggcctgagttccgcgnaagctgtggnttttcctacgggtgcggcatgtgcctggtcccgctctgcccccagtgcctctaatccgctgagaccgttcaccgctccgtttccgcagcctttgcgggccaataacnttcctaactttcttttctcccccccatatcctccctttaccctcccttatttttgctcatccgaccttatcaccctcttctatattaaattacccaccaaaccccaccccattattaccatacttaagtcccaatctatcacccccccc

SEQ ID NO: 10973 - DNA, 750 bp, Zea mays
  misc_feature: Ceres CLONE 1349364-F
  misc_feature: Encodes the peptide sequence at SEQ ID NO. 10974
  misc_feature (714)..(714): n is a, c, t, g, unknown, or other
  misc_feature (720)..(720): n is a, c, t, g, unknown, or other
  misc_feature (723)..(723): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
tccccgcggtggcggccgctctagaactagtggatcccccgggctgcaggaattcggcacgaggagagagctcactagtcccccccccccccgagtacttgttcgattcgacaaatgatgtttccgtcctgccttgtggtcataccattcatgtaaagtgcctgaaagaaatggaagagcactgccagtttgcatgccccctttgctccaagtcggtttgtgacatgtcgaaggcatgggaaaggctcgacatggagctggcaactctgtctgactcctgtgatcacaaaatggtccgcatattatgcaacgactgcggggcaatatcagatgtgcagttccatttgattgcgcacaagtgccagaattgcaagtcatacaacacccgccagatttgaagtaagaaatcgcagtcacacaacacccgtcagatctgaaaatagcaatcccttggggggtttctgcattttcttcaaaaaacgggatgggactgaaggcccccttccccgggaattttttaaaccccgaaattttggaaaaaaccttccccgggtgtccccccccccgggggcccccggggggggggaaaaaaccccccaaagggaataatttggggggggaagggtgcccccccccctcttttttaaaaaaaaaaaaaaaaacccccccgcggggggtatatcaatcacccaccccccccccggggcccccctntttttntgntnnnaannnatataaaatataaataat

SEQ ID NO: 10974 - protein, 131 aa, Zea mays
  misc_feature: Ceres CLONE 1349364-F
PAVAAALELVDPPGCRNSARGESSLVPPPPEYLFDSTNDVSVLPCGHTIHVKCLKEMEEHCQFACPLCSKSVCDMSKAWERLDMELATLSDSCDHKMVRILCNDCGAISDVQFHLIAHKCQNCKSYNTRQI

SEQ ID NO: 10975 - DNA, 840 bp, Zea mays
  misc_feature: Ceres CLONE 1349376-F
  misc_feature: Encodes the peptide sequence at SEQ ID NO. 10976
cgcggtggcggccgctctagaactagtggatcccccgggctgcaggcccccccctctactgctccgagatctacccgctgcggctgcgcgcgcaggctgctgccatcggcacggagctcaaccggatcatgagcggcgccaccaccatgtccttcctctcgctctccaacgccatcaccatcgccggcagcttctacctgtacgcgtgcatcgccgccgcaggctgggtgatcatgtacttcttcctgccggagacgatgggcaggagcctggaggacaccgtgaagctcttcggcaaggacgcggacgacgaggacgtcggcgacagccggcgtgacgcgcccagtaagaagccctccacttccactgagctgagtgctcagcactgagtgatgtgccatgcatgaaacacgtgtcctcccgagtgtgaccgaagcttatgtctaaagcttcgatgatacagtctactcctagtatcttgtgtgctcgaactgtggtgaatcttttgtacatcccgggcctctcctttttttttatctgttaaaaaaaaaaaaaaaaaaaaaaactcgagggggggaccggcacccaattcgccctatagtgagtcgtattacaattcactggccgtcgttttacaacgtcgtgactgggaaaaccctggcgttacccaacttagtcgccttgcagcacatccccctttcgccagctgaggtaatagcgaagaggcccgcaccgatcgcccttcccaacagttgcgcagcctggatgccgaatggcacaatgtaagcgttaatatgatgttgaaattcgcggtcaatgtttgataatcagctacatttt

SEQ ID NO: 10976 - protein, 86 aa, Zea mays
  misc_feature: Ceres CLONE 1349376-F
MSGATTMSFLSLSNAITIAGSFYLYACIAAAGWVIMYFFLPETMGRSLEDTVKLFGKDADDEDVGDSRRDAPSKKPSTSTELSAQH

SEQ ID NO: 10977 - DNA, 943 bp, Zea mays
  misc_feature: Ceres CLONE 1349404-F
  misc_feature: Encodes the peptide sequence at SEQ ID NO. 10978
  misc_feature (211)..(211): n is a, c, t, g, unknown, or other
  misc_feature (316)..(316): n is a, c, t, g, unknown, or other
  misc_feature (339)..(339): n is a, c, t, g, unknown, or other
  misc_feature (372)..(372): n is a, c, t, g, unknown, or other
  misc_feature (595)..(595): n is a, c, t, g, unknown, or other
  misc_feature (605)..(605): n is a, c, t, g, unknown, or other
  misc_feature (626)..(626): n is a, c, t, g, unknown, or other
  misc_feature (747)..(747): n is a, c, t, g, unknown, or other
  misc_feature (776)..(776): n is a, c, t, g, unknown, or other
  misc_feature (785)..(785): n is a, c, t, g, unknown, or other
  misc_feature (822)..(822): n is a, c, t, g, unknown, or other
  misc_feature (843)..(843): n is a, c, t, g, unknown, or other
  misc_feature (880)..(880): n is a, c, t, g, unknown, or other
aggtggagctcaccgcggtggcggccgctctagatatagtggatcccccgggctgcaggccccccccccccggagctggcgcaggaggaggccaacagcctctccaacaccgtccacgccgacaacgtgcggctggagcgcgaggtggcgttcctgaaggccgtcatggacgagacccagaaggaactggactcgactcgcggagttcttncagggagacgcgcacgggcattccagcttcaggttgaagtctttcatctgaagcagcggctgcagacgatggaagggagcgcatcccgcagccccaaggatccancagaatacgtagggaagggtgcntgcttgtagagaagcttttgagctgtaaatgcnttcagggttgtactgaaactgtggtaagtgcccggacttacttgtcattttggaatattattgcgacgcggtgcgatgcaaaccggatgtggtaacgggggacgtaactaaacttgtgcatcatgaagttggagtgtcttttttattgcaaggtggggttctactcctaagaaaaataagacaaaactcgtagaggcgggtccccgagtagcgcgatatccgnccatataatntgtatccggtattaaaaaatntccctggcgccatcggtgttttacaactgtgcgcggccttggagagaacccgtgggccgttaccccatctattcacaccttagtggggcaccttacctacctttcgccaacgtgggcgttnattgccgagctaaggccgtcgccgatcgncccttcctnccatagtgggccatgcgtaggggggcgagtgacaagngggagaccgggagctctttgnttaaattgcccgctagaagttgtgaaatcggcccatntttaacgacatggccagaatccgcgaaggttctgataagcataaataaaccgattatggtcga

SEQ ID NO: 10978 - protein, 60 aa, Zea mays
  misc_feature: Ceres CLONE 1349404-F
  misc_feature (16)..(16): Xaa is any aa, unknown, or other
  misc_feature (51)..(51): Xaa is any aa, unknown, or other
MDETQKELDSTRGVLXGRRARAFQLQVEVFHLKQRLQTMEGSASRSPKDPXEYVGKGACL

SEQ ID NO: 10979 - DNA, 916 bp, Zea mays
  misc_feature: Ceres CLONE 1349420-F
  misc_feature: Encodes the peptide sequence at SEQ ID NO. 10980
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (773)..(773): n is a, c, t, g, unknown, or other
  misc_feature (890)..(890): n is a, c, t, g, unknown, or other
ggagctccccgcggtggcggccgctctagaactagtggatcccccgggctgcaggccccttctccgccgccacgctagagaggaagagcgcgcggagagcgagagcccgggagaaacagcggccggcggcaaaatggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgggaagaagatccaaggaattccacacctgagacctgctgagtacaagaggtctaggttgccaaggaaccgcaggactgtgaaccgtccatatggtggtgttctgtctggtaccgcagtcagagagaggatcatccgtgcctttttggtcgaggagcagaagatcgtgaagaaggttttgaagatccaaaggaccaaggataaggcctccaagaactaggcgatataggcatcttccacaatgttcaagtcccttagatgatatggtttaaattttgagcggaagttgcggatccttttatttttttaaaatctcggtgggatgtttttcactcgtctatgtggatgtcagatattttgctaatggtgcctgcccatttgctccannnnnnnnnnnnnnnnnnnnnnnnnnnnnnnnnnnnnnnnnnnnnnnnnnnnnnnnnnnnnnnnnngaannnnnnnnnnnnnntctcgagggggggcccggaccaatttcgccntatagggagcgtattacattcactgccgtcgtttaacacgtcggaactggaaaaccgtggggtacccactaatccgctggagacatcccctttcgcaggtgggtatagcgaaagggngaacgatcgcctttcaaaagtggcaa

SEQ ID NO: 10980 - protein, 119 aa, Zea mays
  misc_feature: Ceres CLONE 1349420-F
  misc_feature (5)..(103): Pfam Name: Ribosomal_L34e Pfam Description: Ribosomal protein L34e
MVQRLTYRKRHSYATKSNQTRVVKTPGGRLVYQYTKKRASGPKCPVTGKKIQGIPHLRPAEYKRSRLPRNRRTVNRPYGGVLSGTAVRERIIRAFLVEEQKIVKKVLKIQRTKDKASKN

SEQ ID NO: 10981 - DNA, 916 bp, Zea mays
  misc_feature: Ceres CLONE 1349454-F
  misc_feature: SWISSPROT Homolog: EC 3.2.1.23 Beta-galactosidase
  misc_feature (609)..(609): n is a, c, t, g, unknown, or other
  misc_feature (629)..(629): n is a, c, t, g, unknown, or other
  misc_feature (653)..(653): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (720)..(720): n is a, c, t, g, unknown, or other
  misc_feature (787)..(787): n is a, c, t, g, unknown, or other
  misc_feature (798)..(798): n is a, c, t, g, unknown, or other
  misc_feature (830)..(830): n is a, c, t, g, unknown, or other
aaagctggagctccccgcggtggcggccgctctataactagtggatcccccgggctgcaggcccccccccctcagggccgccgggaagcccgtcgtggtcagggacttccacggccagcagcacggcttcttcaccatcgacccctggtccgacgcctccgccgagctcatgcgcgtcatcaagcgcttcgtcgacgccgacggccgcttcgacttcgactgacacgtcggtgtcgaactctagtattaaatccggggcttgcgagcagaacggtctgcgtcgagccgtcgtgtagttcccgggttggaatcaatgtggtttggtgattgtgatatttttcaagttcaacggtttccaccgtcgtcgcattcttcgcaattaaattaaaaatgctaaattatatataaatagagatttaaaccaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcnacgatcgcccttccaacagntgcgcagcctgaatggcgaatggncaatnnngtagcgtaatattttggtaaaatttcgcgtaaattttttgtaaatcagctcatttttaanccaatagggccgaatcggcaaaatcccttataatcaaaagatagacagagatagggttgagtgttgntccagtttggnaacagagtccactattaaagacgtggactccnacgtcaagggcgaaaaacgtctatcagggcgatggccactacgtgaccatcaccctatcaagtttttggggtcgaggtgcgtaaac

SEQ ID NO: 10982 - DNA, 856 bp, Zea mays
  misc_feature: Ceres CLONE 1349466-F
  misc_feature: Encodes the peptide sequence at SEQ ID NO. 10983
  misc_feature (93)..(93): n is a, c, t, g, unknown, or other
  misc_feature (531)..(531): n is a, c, t, g, unknown, or other
  misc_feature (583)..(583): n is a, c, t, g, unknown, or other
  misc_feature (691)..(691): n is a, c, t, g, unknown, or other
ggagctccccgcggtggcggccgctctagaactagtggatcccccgggctgcaggaattcggcacgagctcactagtcccccccccccccccncatcacatcacaggcgcttattagcagtcgggttattaatataagctaaggccgcccagccagcctaatcactccgcttaattcgtgcttgtgatcgagcagctgtcgctgtgtgtgtataatggcactggcaggcaaggcctcggtcgcgctgttcctcgccgtgaacctggcggtgttcgccatggccagcgactgcggtggcaactgccccacgccgaccccgtccaccccgtcgacgccgaccccgacgccggcctcgttcggcaagtgcccacgcgacgcgctcaagctgggcgtgtgcgccaacgtgctgggcctgatcaaggccaaggtgggcgtaccgcccacggaaccgtgctgcccgctgctggaggggctcgtcgacctcgaggccgctgtgtgcctctgcaccgccatcaagggcgaggtcctcgnaatcaagctcaacctgcccgtcgacctcagcctcatcctcaaccactgcggnaagaccgtgcccaccggattcaaatgcctctaagtctaagcacgcattcagccgcgcgctcgtcgctgaagagtggaactggatcgtttggattcagatttattgggnttgtatcggttgaactggcctgtaccgtagctctggtctgatcagatttgcttcccttgttgcatggaaaaaaaaaaaaaaaaaaaaaaactcaggggggccgggacccaatccgctaaagggagcgtataacatccctgccgcgtttaacacgcgggatggaaa

SEQ ID NO: 10983 - protein, 133 aa, Zea mays
  misc_feature: Ceres CLONE 1349466-F
  misc_feature (51)..(132): Pfam Name: Tryp_alpha_amyl Pfam Description: Protease inhibitor/seed storage/LTP family
  misc_feature (106)..(106): Xaa is any aa, unknown, or other
MALAGKASVALFLAVNLAVFAMASDCGGNCPTPTPSTPSTPTPTPASFGKCPRDALKLGVCANVLGLIKAKVGVPPTEPCCPLLEGLVDLEAAVCLCTAIKGEVLXIKLNLPVDLSLILNHCGKTVPTGFKCL

SEQ ID NO: 10984 - DNA, 945 bp, Zea mays
  misc_feature: Ceres CLONE 1349480-F
  misc_feature: Encodes the peptide sequence at SEQ ID NO. 10985
  misc_feature (328)..(328): n is a, c, t, g, unknown, or other
  misc_feature (945)..(945): n is a, c, t, g, unknown, or other
aagctggagctccccgcggtggcggccgctctagaactagtggatcccccgggctgcaggaattcggcacgagggcctaggagacaacgatgagccgtttatatgtaccatggactgcattggtgccaaggaactagcaaaagattttgtggtctccggtactgcttcagagtcactttatggtgcttgtgagtccatgtataagccaaacatggaacccgaagaacttttcgagacaatctcgcaagcattgcaggcatctgttgatcgcgactgcctcagcggctggggaggttatgttcttgttgtcacacccactgaagtgcangagagagtgctgaagggaaggatggactgatgagtgctgccatgtagttattctaggagagatttgtttcttcattcgccctgacatgctcgcccctgtcctacggcgtacagaattcaaagaacctgggcacccacgtttactttctcgttctgaaagaacattggatccagaagttggccttacaaaaaaaaaaaaaaaaaacttcgaggggggggcccgggaccccatttccccctattggggaggcgtattaccatttccacgggccggccttttttacaacgtcctggaaggggaaaaaccctgggcgttaccccaattttattccccttggaggaacatcccccctttctcccaggtgggggtaaataccgcaaaaggccccccaccgattcgcccttttccaaaatattggcccaccccggaagtgggagaagggaaaattgggaagcgcttaaatttttggttaaaactcccgggttaaatttttggataaaccaccctccttttttaacccctagggcgcggaaaccgaaaaactctctttaaaatcaaacaatacacaccaaaataggggtagacgttttcccacgttgccaccaagaaccccttan

SEQ ID NO: 10985 - protein, 82 aa, Zea mays
  misc_feature: Ceres CLONE 1349480-F
  misc_feature: SWISSPROT Homolog: EC 3.4.25.1 Proteasome endopeptidase complex
  misc_feature (73)..(73): Xaa is any aa, unknown, or other
MDCIGAKELAKDFVVSGTASESLYGACESMYKPNMEPEELFETISQALQASVDRDCLSGWGGYVLVVTPTEVXERVLKGRMD

SEQ ID NO: 10986 - DNA, 787 bp, Zea mays
  misc_feature: Ceres CLONE 1349518-F
  misc_feature: SWISSPROT Homolog: EC 3.2.1.23 Beta-galactosidase
  misc_feature (690)..(690): n is a, c, t, g, unknown, or other
cgcggtggcggccgctctatatctagtggatcccccgggctgcagggaccccccccccccccccgcacgtgatgaacgggcttctgatgtcgattgagttgagtcgacctcgcaggagcaggtgcaccgtgagagatctttactggcctcggttggggggtaaaaaaaacgtacccaatcttgcactaaaaaaaaggagagcgagcacagttcgtaataaagaaagaagatcatgtgatgcagtgggaatttgcaaatgtaaatactgaactgaaaccatgtggacaggaccgagtgcataagcacctttgtgaatatgttgatccaaaaaaaaaaaaaaaaaaactcaaggggggtccctggacccaattctacctatagggggctggattacaattgactggacgccactttaccaccttgcgactggtcaaaactctggcgttacccaacttaatcgactaggaccacatccccctttcttcacatggcgtaataacgaagaatgccgaacggatcgcccttcccaacagtatgcgcagcctgaatggcgaatgagcaaatggtaagcgttaacattttgtaaccatacgcgctaaatctttagaatctcagatcattctttaacctatacgacgatatcggtaagatcccttataaatcgaaacatagaccgatatagggtagagntggtgttccacgttgaagcaagagtccactattatcgagcctatgctccactgacagaagcatcacaatcgtctatcatgttgatgccccactaccc

SEQ ID NO: 10987 - DNA, 755 bp, Zea mays
  misc_feature: Ceres CLONE 1349526-F
tccccgcggtggcggccgctctagaactagtggatcccccgggctgcaggaagtctgctgccaatggagataaagagagagcttactagtcccccctccccaccaccgataccggatacagtgacgcattgttattatttgaacatggggaccctgcgcacatacccaatataggacctgaacgacctactcccaactgacattcctacagggcgagatattatatctttcccctcttcacgaaggtaaaaaggtccacaggtattcgcgaaacgtccgggtctacacatgagacctcttccaccgagcttccaagaaagaaacctctggcatcttatatagccttgcttggcatcgctacctctgactagaacgctcatgttggtgatgttcgtcaggctgcctcagactatggaaaagcaccactccgctccgcttttacagcgcctgctctattgctgctcctgtgatccgtgctcttgcctgcgtcatccactgatacggagcatatccgtattaccgccttagagtgagatgataccgctcgccgcaggcgagcgagcgagagcattgagtcatcgagcgacgatgcgtaagagcgcccgataggcataccgcctcatcccgtgcgctggccgactgattagtgcaactggcacgactgttctccgactgataagcgaatatgtccgcacgcacttaatgtgagatagatcgtcatgaggcacaccacgctaactcgttatggtacaggt

SEQ ID NO: 10988 - DNA, 797 bp, Zea mays
  misc_feature: Ceres CLONE 1349530-F
  misc_feature: Translation starting site: 334
  misc_feature: Pfam Name: MAP1_LC3 Pfam Description: Microtubule associated protein 1A/1B, light chain 3
  misc_feature (504)..(504): n is a, c, t, g, unknown, or other
  misc_feature (643)..(643): n is a, c, t, g, unknown, or other
acccgcggtggcggccgctctagaactagtggatcccccgggctgcaggccccccccccccccccgtctctccgccgcttccttggaagacgaagaaaccctcctcctccaccaacccgatccagctacatccgttgaggcccgtgcgtttcttccctgttctcccatcaatcgacctagccttacgccgaccaggggcttcctctaatcgatctggtgtctgttctgtggtcttggtctgggtgcactccagggccaggagcagctagccgtcttcgatcgatccgttcgcatccccaacgcagttcggtttgtaaggtaggaaggagcgtgatggccaagacaagctcgttcaagctggagcaccccctcgagaagaggcaatctgaggctaaccgtatcagagagaagtaccctgacagaattccagtgattgttgagaaggctgagaggagtgatattcctgacatcgacaagaaaaagtacctcgtccctgcagatctntacagtcgggcagttcgtgtatgttgttaggaagagaatcaagctcagtgctgagaaggctatcttcatatttgtgaaaaacacccttccaccaacagctgctctgatgtcttcaatctatgaagagaaacaggaccgnaggatgggttcctctacatgacttacagtggtgagaacaccttcggactgctctagatggtcaccgcaaatcgggtcgggtagccttgcccatgcctcctgtaaataagactgccagcaatgtgggaaaaattcctggttcgtcctttgcaagg

SEQ ID NO: 10989 - DNA, 738 bp, Zea mays
  misc_feature: Ceres CLONE 1349553-F
  misc_feature: Encodes the peptide sequence at SEQ ID NO. 10990
  misc_feature (402)..(402): n is a, c, t, g, unknown, or other
  misc_feature (419)..(419): n is a, c, t, g, unknown, or other
cgcggtggcggccgctctagaactagtggatcccccgggctgcaggcccccccccccccccccaggacgccgtgatcgcgttcaagacggcgctctggttctggatgaacaacgtgcaccgtgtgatgccgcagggcttcggcgccaccatcagggccatcaacggcgccctcgagtgcaacgggaacaaccccgcccagatgaacgcgcgcgtcggctactacaagcagtactgccagcagctccgcgtcgacccagggcccaacctcacttgctaggcgacggcgtccacgttgtacccatggctcctgctagctcgtccacaataaatgcctcggcgtcgcacccctcgcgaaaaccaagagttttactgggactagtacgaggctagctagcatgcangaaataataatcataantataaaacgacggggctgaaccaccttggttcgaactggaaaaaaaaaaaaaaaaaaactccgaggggggggcccgggacccaaatcccccctataggggggcccgattaacattccatggggccggcggttttaaaacggcgggagattggggaaaaaccccgtggggggtaaccccaaatttaatatcgcgctttgggggaaaaaatccccccctctttgccccgggggggggaaaaaaaaaaaaaaaaggggccccccccaaattcccccttttccacaacaaggtgggcccccccttagaggggggggaaaaggg

SEQ ID NO: 10990 - protein, 57 aa, Zea mays
  misc_feature: Ceres CLONE 1349553-F
  misc_feature: SWISSPROT Homolog: EC 3.2.1.14 Chitinase
MNNVHRVMPQGFGATIRAINGALECNGNNPAQMNARVGYYKQYCQQLRVDPGPNLTC

SEQ ID NO: 10991 - DNA, 847 bp, Zea mays
  misc_feature: Ceres CLONE 1349579-F
  misc_feature: Encodes the peptide sequence at SEQ ID NO. 10992
  misc_feature (530)..(530): n is a, c, t, g, unknown, or other
cgcggtggcggccgctctagaactagtggatcccccgggctgcaggaattcggcaagagagagagagagagagctcactagtcccccccccccgacgccaccggccgcctgtatttccctcacccaactccgtccctctctcccagctcagatagatctttcccccgtcctccctcgccttcgccttcgccttcgccggcaggagatttccaccaccaccgccggaccgccccgaccctcctcccctctcgcgctatggcccagactgttgtgctcaaggttggcatgtcctgtgagggctgtgttggagctgtcaagcgggtcctgggcaagatggaaggcgttgagtcctacgacgtagacatcatggaacagaaggtcaccgtgaagggcaatgtgacacctgacgccgtcctgcaaactgtttccaagactggcaagaagacttcgttctggggaggctgaggccgtgacaagtgaatccgccacacctgccggtgccaccgcctgacaggttcgatggatcaggnaagtgccccggcaaggcggcaaagaaaaaaatgtgaatgtattttagcttggatctgttacaaataattgcaaactggctagctcggtctgtacattttacagttgctattcgtgtactgtgatggtctcgtaagtttggggagatgataaaccaatattttgcaaaaagaaaaaaaaaaaactcgagggggggcccggtacccaattcgcctatagggagtcctattacatttcactggccggcgttttacaacggcgggatggaaaaacctggcgttaccaacttaatcgccttgcacacatcccctttcgcagg

SEQ ID NO: 10992 - protein, 69 aa, Zea mays
  misc_feature: Ceres CLONE 1349579-F
  misc_feature (5)..(66): Pfam Name: HMA Pfam Description: Heavy-metal-associated domain
  misc_feature: SWISSPROT Homolog: EC 3.6.3.4 Copper-exporting ATPase
MAQTVVLKVGMSCEGCVGAVKRVLGKMEGVESYDVDIMEQKVTVKGNVTPDAVLQTVSKTGKKTSFWGG

SEQ ID NO: 10993 - DNA, 822 bp, Zea mays
  misc_feature: Ceres CLONE 1349599-F
  misc_feature: Encodes the peptide sequence at SEQ ID NO. 10994
  misc_feature (520)..(520): n is a, c, t, g, unknown, or other
tccccgcggtggcggccgctctagaactagtggatcccccgggctgcaggaattcggcaccaggagagagctcactagtcccccccccccctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagatcctgtcaactgcacccgccattatcgatccatggtcgctcctgggggttcatgttcatctgtacggtgctcgcgggtcaggtccgtctccgtgccggatttaatatttatatgcatggggattttgggttttttcctggcgttattacngaaaaaaaaaaaaaaaaaaactcccaaggggggggcccggtaccccaattcgcccctaatgggggggccgtattacaattcacctgggccgtcggttttaccaacgccggggactgggaaaaccccggccggttacccaactttaatcgcccttgcagcacattcccccttttcgccaggctggggtaaaaaacggaagaggccccgcaccggttcgccctttccaaaaagttggcgccaccgggaatggcgaattggccaatttgaaagcgttaaatatttggttaaaattcggggtaaat

SEQ ID NO: 10994 - protein, 96 aa, Zea mays
  misc_feature: Ceres CLONE 1349599-F
  misc_feature (30)..(95): Pfam Name: Metallothio_2 Pfam Description: Metallothionein
PRGGGRSRTSGSPGLQEFGTRRELTSPPPPSCGSSCNCMSPNVETAAASSIKTTVLAAPTTKASAGGFEAATEGGGCDCNTCNCGTSCGCSCCSCN

SEQ ID NO: 10995 - DNA, 842 bp, Zea mays
  misc_feature: Ceres CLONE 1349609-F
  misc_feature: Translation starting site: 190
  misc_feature: Pfam Name: Alpha_adaptinC2 Pfam Description: Adaptin C-terminal domain
  misc_feature: Pfam Name: B2-adapt-app_C Pfam Description: Beta2-adaptin appendage, C-terminal sub-domain
  misc_feature (545)..(545): n is a, c, t, g, unknown, or other
  misc_feature (550)..(550): n is a, c, t, g, unknown, or other
  misc_feature (551)..(551): n is a, c, t, g, unknown, or other
  misc_feature (579)..(579): n is a, c, t, g, unknown, or other
  misc_feature (580)..(580): n is a, c, t, g, unknown, or other
  misc_feature (656)..(656): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (763)..(763): n is a, c, t, g, unknown, or other
  misc_feature (799)..(799): n is a, c, t, g, unknown, or other
  misc_feature (800)..(800): n is a, c, t, g, unknown, or other
tccccgcggtggcggccgctctagaactagtggatcccccgggctgcaggaatcggcaccagcccccccccccacccggagtccccatcccagggagttgatggggcgtcgccttcctctagtgctggtacttcttctaatgtacccgtgaaacagccggcggcagcatccccacctggtccagtggcaatgccagaccttttaggtgatttaatgggtatggataatgctattgtccctgttgatgaacctgcagcaccttctggccctccgctacctgtcttactgccttcgaatacaggtcaagggctgcagattagtgcacaactaacacggcgtgatggccagatatactatgatatatcttttgagaatggcacccagggtgtcctagatggatttatgattcagtttaacaagaacacatttggtcttgctgctggtgaagcacttcaggttactccactgcaaccaggccaatcaacaaggacacttttacaaatgaacacgttccagaataatcagccctggtgcaccaaatcgcntattnnacaagttgctgtgaaaaataatcacagnnccagtgtggtacttcaatgacaaattccactgcatgttttccttttgggtgaagatggaaaaaggaacgagctagnttttccttgaggcctggaaatctttacctgatgacaatgaatttacaaaagaattcccgggcttttgtatcnnncagtatagaatgctacagttgagcgcctgcaancatcaaatgtgttctttatagcaagcgaaagggccnnacacttggaggttcctgatctgtccgcgaaaaatgcccgcga

SEQ ID NO: 10996 - DNA, 935 bp, Zea mays
  misc_feature: Ceres CLONE 1349628-F
  misc_feature: Encodes the peptide sequence at SEQ ID NO. 10997
tgttctagtggatcccccgggctgcagggatttacagagagagagagagctcactagtccccccccccccgaagaagcgaccatgagggccaagtggaagaagaagcgcatgaggaggctcaagaggaagcgcagaaagatgaggcagagatccaagtaggcagatcgagatggattgtggacctgatgacatgcgtgggtacatacatttcttcggatgcgttggtgtgcctgtggagagatgtcaacctgccatggtgtcacggtccgccatcagttgaacgtcttgcctgcacttcagtaggccatttttcatggttctagttgtatttgaatccagcgtttgccactaagataaatcagacattcgttttgtgaacctattatgatggagctttaaaaaccacacacgctaccaaaaaaacttgccgttccaaaaaactcgaggggggggccccggtacccacattcccccctataggggagtcgtattacaattcccttgggccgtccttttttaccaccgcccgggacttgggaaaaacccctgggcgtttaccccaactataatcgcccttgggaggcaacatccccccctttttcgtcaaacgtggggcgaaaatagccaaaagagggaccctcaccggaaccgtctctttcccaacaagttgcgccccaccctggaatgggccgacagggcaaatttgtaaaccgtctatacatttttcgcaaaaaatctccgcgttaaaatttatcggtcaaatccggctcacttgtttaaacgcaataagggccaaaaatcggccaaaaatccctctattaacttacaaacaaacattaacccgagaaatgcgtgccgactgtgtcgttcccctcttttggaacacaagacctccctcttgtataaaacggggcgcctcacccgtgcacagggg

SEQ ID NO: 10997 - protein, 45 aa, Zea mays
  misc_feature: Ceres CLONE 1349628-F
MTCVGTYISSDALVCLWRDVNLPWCHGPPSVERLACTSVGHFSWF

SEQ ID NO: 10998 - DNA, 846 bp, Zea mays
  misc_feature: Ceres CLONE 1349648-F
  misc_feature: Pfam Name: TonB_dep_Rec Pfam Description: TonB dependent receptor
  misc_feature: Pfam Name: Alpha-amylase_C Pfam Description: Alpha amylase, C-terminal all-beta domain
  misc_feature: Pfam Name: Alpha-amylase Pfam Description: Alpha amylase, catalytic domain
  misc_feature: SWISSPROT Homolog: EC 2.4.1.18 1,4-alpha-glucan branching enzyme
  misc_feature (715)..(715): n is a, c, t, g, unknown, or other
  misc_feature (824)..(824): n is a, c, t, g, unknown, or other
ggagctccccgcggtggcggccgctctagtctagtggatcccccgggcgacgcatggcttaaattcgcgaacctgcgcgcctactatggctggatgtgggcattcccgggcaagaaactactgttcatgggtaacgaatttgcccagggccgcgagtggaaccatgacgccagcctcgactggcatctgttggaaggcggcgataactggcaccacggtgtccagcgtctggtgcgcgatctgaacctcacctaccgccaccataaagcaatgcatgaactggattttgacccgtacggctttgaatggctggtggtggatgacaaagaacgctcggtgctgatctttgtgcgtcgcgataaagagggtaacgaaatcatcgttgccagtaactttacgccggtaccgcgtcatgattatcgcttcggcacgttatcccactgatagagatcggtgccgactgcgttttgccctacagccacatagcccgcttcaatcttattgcgataatcgttacggaaccaggtgacgcccgccagccacccgtcgcgtttgaactccagaccaatctctttgttgatgctggtttctgctttcaggtcatcgttaccttgcagatagcagccgcccgcgctggcatagcaaccctgacctttactgtagagaatgtagttcgggttagtctggtacaggctcggcgctttataagcacggncgatgcccattttcagcgtgaagtcatcgcctaaaccttgcgatatgttcagcgccgggctccagttattgccgacaatactgtgatgatcgaaacgcagcccccgcgntacgatggtgctgtcagtcagc

SEQ ID NO: 10999 - DNA, 874 bp, Zea mays
  misc_feature: Ceres CLONE 1349673-F
  misc_feature: Encodes the peptide sequence at SEQ ID NO. 11000
  misc_feature (657)..(657): n is a, c, t, g, unknown, or other
  misc_feature (743)..(743): n is a, c, t, g, unknown, or other
cgcggtggcggccgctctagaactagtggatcccccgggctgcaggaattcggcaccaggagagagagagagctcactagtccccccccccccgaagcgacactgcacgtgtatgaacctacgacagctctctacttccctcgcgtcctctccatcgagagctgctcctgctcgtctcctcccacaccgcgcaattcgacgtgattcgggaaccctagcgccggatctccgcggcagcggcggaaatggcgaatcccctagcggggctgcaggaccacctcaagctcgcgcgggactacgcgctcgagggcctctacgacacctccatcatcttcttcgacggcgccatcgcccagatcaacaagcatctaactactttggacgatgctctgattcgtacgaaatggatgaactgcaagaaagcaatctctgaagaagtggaaattgtgaaacagttggatgctcaattaaagtcccttaaagaagctcctgggtcaaggcggtcatcatcacctcctattcggtctaataaatcatttgttttccaaccgttggatgagtatccaacatcttcaccagcaccctttgatgatccctgatgtgtgggctccaccaagggatacaccaacccgaagaccaacaagaggtcaatctagntgcaaggaagtcctcccaagatggagctttgggcacgtggttcatcaaggactggaacacctagtcgaacgcaaacctaatggganttaaaagggaggtgctgttaatcacttggctcctacagttcctgtaggaaagggaaaacaaagttcagcaagctgattcaccgaatatggatgctttaagaagtaaatcccaagagggggttagattgaag

SEQ ID NO: 11000 - protein, 117 aa, Zea mays
  misc_feature: Ceres CLONE 1349673-F
  misc_feature: SWISSPROT Homolog: EC 3.6.4.3 Microtubule-severing ATPase
MANPLAGLQDHLKLARDYALEGLYDTSIIFFDGAIAQINKHLTTLDDALIRTKWMNCKKAISEEVEIVKQLDAQLKSLKEAPGSRRSSSPPIRSNKSFVFQPLDEYPTSSPAPFDDP

SEQ ID NO: 11001 - DNA, 846 bp, Zea mays
  misc_feature: Ceres CLONE 1349693-F
  misc_feature: Encodes the peptide sequence at SEQ ID NO. 11002
  misc_feature (561)..(561): n is a, c, t, g, unknown, or other
  misc_feature (608)..(608): n is a, c, t, g, unknown, or other
  misc_feature (609)..(609): n is a, c, t, g, unknown, or other
  misc_feature (652)..(652): n is a, c, t, g, unknown, or other
  misc_feature (653)..(653): n is a, c, t, g, unknown, or other
  misc_feature (656)..(656): n is a, c, t, g, unknown, or other
  misc_feature (657)..(657): n is a, c, t, g, unknown, or other
ggtggccgccgctctagaactagtggatcccccgggctgcaggaattcggcacgaggctggtatcgcccgccgcaattttgcgcagaatacggcgcataattttgccggagcgggttttaggcagggagtcggtccagtgcagcacgtctggcgtcgccagcgggccaatctctttacgcacccagttgcggacttctgcgtacagttctggtgacggttcctccccgtgattaagcgtgacgtaggcgtagatcgcctgacctttaatattgtgcggaatacctactacggcggcttcggcaatcttcggatgcgccaccagcgccgactcaatctctgccgtccccagacggggaccggagacgttcagcacgtcgtccacacgcccggttatccagtaatagccatcttcatcgcgacgcgcgccgtcgccgctgaaatacatatttttgaaggtggagaaagtaggtctgttcaaaacgttcgtgatcgccaaacagcgtacgcgcctgacccggccaaggagtcggtgattaccagctttaccttcggtggccccntccagcgggttaccttcgtatcgacccaagcgtcggtgcacgcgaannaaaacgacgtgttgccgaaccggttttcagctcggacgcaggnnaanngggggtgatctgaaacccgcccggtttcgggcctgccaacaggtatcgaccacggacattctccgtttgccgaatttttttccagtaccactccaagcttttccgggttaattggctccgccacgggaacgagatgcccacgggaccaacgggcccggggccttcgatcgctttatcgcctttcgcctc

SEQ ID NO: 11002 - protein, 76 aa, Zea mays
  misc_feature: Ceres CLONE 1349693-F
GGRRSRTSGSPGLQEFGTRLVSPAAILRRIRRIILPERVLGRESVQCSTSGVASGPISLRTQLRTSAYSSGDGSSP

SEQ ID NO: 11003 - DNA, 846 bp, Zea mays; identical to SEQ ID NO: 11001
  misc_feature: Ceres CLONE 1349693-F2
  misc_feature: Pfam Name: AMP-binding Pfam Description: AMP-binding enzyme
  misc_feature: SWISSPROT Homolog: EC 6.2.1.1 Acetate--CoA ligase
  misc_feature (561)..(561): n is a, c, t, g, unknown, or other
  misc_feature (608)..(608): n is a, c, t, g, unknown, or other
  misc_feature (609)..(609): n is a, c, t, g, unknown, or other
  misc_feature (652)..(652): n is a, c, t, g, unknown, or other
  misc_feature (653)..(653): n is a, c, t, g, unknown, or other
  misc_feature (656)..(656): n is a, c, t, g, unknown, or other
  misc_feature (657)..(657): n is a, c, t, g, unknown, or other

SEQ ID NO: 11004 - DNA, 920 bp, Zea mays
  misc_feature: Ceres CLONE 1349699-F
  misc_feature: Encodes the peptide sequence at SEQ ID NO. 11005
  misc_feature (838)..(838): n is a, c, t, g, unknown, or other
  misc_feature (876)..(876): n is a, c, t, g, unknown, or other
tcaccgcggtggcggccgctctagaactagtggatcccccgggctgcaggccccccccccccgttcgatcctcacaatgcagtgaaatcactctgctctcctctgcttccttctataaatctaatagaataactccgtcaagaagcaacgagcatagaacaattcaacagaggaagaatcaggcagggagctctcccattcgcatcccaggccaacctcaaccccaatccaatccgttgcaggtcgcaggatggctccgcgtgagcaccaccagccccaggaggaggaggaggaggacaccgcaggcgtcgtcaagctcatcagcgccgagggcttcgaattcgtcgtcgacaagaaggccgccatggtctccaacaccctacgcaacatgctcacatcgccaggcggtttctccgagacgcgccagggcgaggttcgcttcccggagatccccaccaatatcctcgagaagatctgccagtacttctattggtcgctccattattccagtggcaaggaaacagcagagtttctgatcgaacccgagatcaccctggagctgatgatggccgcaaactacctggacacttgatgaggagcctgagggatctaaccctaggaaccgtttgggtgtgaaatttgaaaaggtaatgtaaacgttatccgataacactgtaaattttaaaaagtaagctattactcggattggttgggtcagcgtaagagattatgttgtggggttaaacaaacacgctccaacgtaatcaggtactggtggaaacaaatcaccttacattctactgaaccaaacagcaccatagggtcttatgaattatgnaagaacggagcaatggttactagtggttttccaacaanacaagtcttgggggctcgggacaaatagacaataaccgaacccg

SEQ ID NO: 11005 - protein, 113 aa, Zea mays
  misc_feature: Ceres CLONE 1349699-F
  misc_feature (19)..(81): Pfam Name: Skp1_POZ Pfam Description: Skp1 family, tetramerisation domain
MAPREHHQPQEEEEEDTAGVVKLISAEGFEFVVDKKAAMVSNTLRNMLTSPGGFSETRQGEVRFPEIPTNILEKICQYFYWSLHYSSGKETAEFLIEPEITLELMMAANYLDT

SEQ ID NO: 11006 - DNA, 913 bp, Zea mays
  misc_feature: Ceres CLONE 1349712-F
  misc_feature: SWISSPROT Homolog: EC 3.2.1.23 Beta-galactosidase
tccccgcggtggcggccgctctagaactagtggatcccccgggctgcagggagagagagagagagagagctcactagtccccccccccccccctcccctggcccagttgctgccgagagttatcgtcagttggtgcggtgtgtccgcttaaactttatttgtggttggttggtactttaaaaaaaaaaaaaaaaaaactcgagggggggcccggtacccaattcgccctatagtgagtcgtattacaattcactggccgtcgttttacaacgtcctgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaataccgtctatcagggcgatggcccactacgtgaaccatcaccctaatcaagttttttggggtcgaggtgccgtaaagcactaaatcggaaccctaaaggaagccccgatttagagcttgacggggaaacccgcgaacgtgggaagaaagaaaggaaaaaagcgaagggccggccgctagggcgctgcaaagtgtacggtacgctgcccgtaaccaccaccccccgcgcttaatgccccactcacagggcggcaggggtcactttccggggaaatgggcgcggaacccctatttgttatttttctaaaa

SEQ ID NO: 11007 - DNA, 890 bp, Zea mays
  misc_feature: Ceres CLONE 1349722-F
  misc_feature (576)..(576): n is a, c, t, g, unknown, or other
tgaggctccccgcggtggcgggcgctctagaactagtggatcccccgggctgcaggtcgaggccatgtcggcgctaaagaacaggtatggaaatgtctgttcggcgggatacaaacagaggctcggttcttcagtttactcctcgtcatcatccgctgcatccccggacccacctttaaggtgcagatgcttctccctcctctggaagtcggtcaggcccttgccactcccagtgacacccaccttacctctgtggtcgtccggtgacttgaagatgctctccttcttgcgaccggagaagaaccccacctttttggctttccccttggtttgaaactgctgccatgcattctgccttttgttttgggcaaattcaagctgctcaaagcgggattttgatttgaaagcatgtattttcttacgctttgcagctttaacatcctcagggtcacttggttcgatacgaagtttggccggcaagctacgcgcctgaaaatcagatgttgctgcttgttcaattttcctctttattgccatttttgtagcttcagcttccttttcagcttgcccaaggcnatcgggggggggggggggggggcccaacgaacttgactcgaggggggccccgaaacccatttcgccctatagggagccgaattacaattcatggcccgccgtttaacaacgtcgggatgggaaaaaccctgcggttcccaattaattcgcttggaaagaaatccccctttccaagttggcgaaaaagagaaaagcccccaaccgatcgccctcccaaaagtgcccaccttgaatgggagatggcaaattgaaaccgttatattttggttaaattccgggttaaatttttgtaaaaccagctcattttaacccaa

SEQ ID NO: 11008 - DNA, 901 bp, Zea mays
  misc_feature: Ceres CLONE 1349735-F
  misc_feature: SWISSPROT Homolog: EC 3.2.1.23 Beta-galactosidase
  misc_feature (860)..(860): n is a, c, t, g, unknown, or other
  misc_feature (883)..(883): n is a, c, t, g, unknown, or other
cgcggtggcggccgctctagaactagtggatcccccgggctgcaggccccccccccccccacagccagacccgaccttcctggcaaacgccaaagcgagtatcaaccagccaacatcctctcaaccgagtgatggttccaagggtgaaaggaaaggttgagtaagccgtagcatgtcatgttggtttttggtcttgtgtatgttaagtgcatgctgtttaggaggaatagttgtgcacgccataacacaacatcgcaatctttaaagttcatgattttgctgtaattcttgacaattatggtcatggagcaatatgaagttgaaacttttgtacgttcacatgagagaaaatcacactaaccgaaactcgagggggggcccggaacccaattcgccctatagggagtcgtattacaattcactggccgtcgttttacaacgtctggactgggaaaaccctgacgttacccaacttaatcgccttgcagcacatccccctttcgccagctggcgtaatagcgaagaggcccgcaccgatcgcccttcccaacagttgcgcagcctgaatgccgaatggcaaattgcaagcgttaatattttgttgaaattcgcgttaaatttttgataaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaccgtctatcagggcgatgggccactacgtgaaccctcaccctaatcaagttttttggggtcgaggtgccgtaaagccttaatcgnaaccttaaagggacccccgattnagagcttgacagggaaac

SEQ ID NO: 11009 - DNA, 803 bp, Zea mays
  misc_feature: Ceres CLONE 1349787-F
tgtggatcccccgggctgcaggccccccccccccccccccggtcgtcgagaagaccgtcgaggtcgccagtgcggaccgcaagaagtcctccgccaagggaggtggtaacaaggacgccaagcgcaagcgctcgcccaccgccttcttcctcttcatggacgacttcaggaaggagttcaaggccacccatcctgacaacaagagtgtcgctaccgttgcaaaggaaggaggggagaggtggaagtccatgacagaccaggagaagaagccttacattgaaaaggccgcggagctcaaggctgaggccgagaatggcgagggcagtggtgagaacaatgttgccactaagaaagccaagacagatgaaccaggaggtggacccgccacccaagaagttttataacgcgcaaggctctcttcccaaagaacagcatgacgatggctgacccaccaagaccgaggatgaaaaacaacgaagttgtatggaccacactgcacacgggcataggtccactctccccatcctcttgtaaagggcatggccagaacgcgtacccgcccccgcttaaaaaatgtctcccctggttccccagcccacaaggcacccagggagaagcaactcccctcaactggcatatctcccccctaattgttcgcccccctgcaacggaactattcctacgatggcattccctggcccgcttttcctttcccctccaacacccgggtattaaatggccctttttccttttctggggctcctcccaaacttacctcccactggcgcccggaaaggttcggt

SEQ ID NO: 11010 - DNA, 744 bp, Zea mays
  misc_feature: Ceres CLONE 1349791-F
  misc_feature: Translation starting site: 130
  misc_feature: SWISSPROT Homolog: EC 3.2.1.23 Beta-galactosidase
  misc_feature (645)..(645): n is a, c, t, g, unknown, or other
  misc_feature (744)..(744): n is a, c, t, g, unknown, or other
tgtggatcccccgggctgcaggaattcggcacgagagagagagagagagctcactagtccccccccccccccccccgcgagcgccggggagccgacggcgtgtggtgcctaacgttcgggaacgcggacatggtgcccctgacggcgtacgtgatcgggcaccaccaccagatgaacctgtgggtcgagtacgacctggagcgcggtcgcgttgggatcgcgcctgtcaagtgcgacgtcgccagcgagcggctcggcctgatgttgtgacgtggcctggcgaaccgtaaccgctctggctcgggggtttgttcctccagactccagtggccataagcccataaccttaacctgccaaacgtttctaagtttagaacttgtttatccttttttttcatgtaaggaaggaaaacttgcataaccttgatcgtgcgtgtggcatgtacgatgtttagcgtaaactgtaaagtaagtgtagtgcagtgttgtgcttctttattttactgaacacgtagtggtttaaaaaaaagaaaaaaaaaaaaaacttcgaggggggggcccggtacccaattcgccctatagtgagtcgtattacattcactgggccgtcggttttacaaggtcgtgactgggaaaacccctggncgttacccaacttaatcgccttgcagcaaatccccctttcgccaggctgcggaaataagcggaaaaggcccgcaccgatcgccctttccaaaggttggn

SEQ ID NO: 11011 - DNA, 1001 bp, Zea mays
  misc_feature: Ceres CLONE 1349794-F
  misc_feature (23)..(23): n is a, c, t, g, unknown, or other
  misc_feature (24)..(24): n is a, c, t, g, unknown, or other
  misc_feature (63)..(63): n is a, c, t, g, unknown, or other
  misc_feature (64)..(64): n is a, c, t, g, unknown, or other
  misc_feature (72)..(72): n is a, c, t, g, unknown, or other
  misc_feature (1001)..(1001): n is a, c, t, g, unknown, or other
cttccctcttcctcccccccttnnacctccccccccatttcctctttactccttttctccctnnctctcccnctattttcccgcggtggcggccgctctagaatagtggatcccccgggctgcaggaattcggcaccaggggggggggggcggggctgaagctggaggcgcgcgactccggcctgcagacgggtgaccccgccgggttcaccctcgccgacacgctggcctgcggcgccgtcggccacatcctcggcgtggggatcgtgctcgggctcaagaacaccggcgccctcgaccagatcattggctagatccctacgtcgccgttggtaagatcagactcagcagcctcgatcgcgccgccggccggcaggtgccagctggtgactttgtaacgtgtgtgcgtgcgtacgcgatacattgcatccccatcttggctcccaatggacatatagctcctgctgcttcttccaaaaaaaaaaaaaaaccaaaattctaaggggcgggccccgcaaaccccaatttccgccccaatagtgaggccgccattacaattccaccggagccgtcgcgtttttacaaagggtcctgggattggggcaaaaaccccctgtgctgtctcccccacactttaaattcgccttttgggaggcaatttcccccccctttttctccccacttctgggccgccaattcacgcggaagaaagggccctggaccacgggatcgcgctccttctccccacaaaggggggccgtacgtccctggaattggcgccacacggtgcacacactcggcaacagggggctataattatttttgtggtcacataatattctccccgcctccactcctcttgttgtttcacacaccacggcttctcttcctctttttaaaatcacaaacacccgtcgctgcaacttctgggcggacacacaccccccctctatccatactctccccacgcgcgcagccacgactctgcgtaaatacggccn

SEQ ID NO: 11012 - DNA, 916 bp, Zea mays
  misc_feature: Ceres CLONE 1349795-F
  misc_feature: Encodes the peptide sequence at SEQ ID NO. 11013
  misc_feature (794)..(794): n is a, c, t, g, unknown, or other
  misc_feature (795)..(795): n is a, c, t, g, unknown, or other
tccccgcggtggcggccgctctagaactagtggatcccccgggctgcagggctcactagtcccccccccccccactcgcatcagagcggcgccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaaacagtctggagaccccacggcgtctggtgattccgacaagtccaagtccgagggtgacgagtgatgtatgacggatgaaactctgtccaagtgtttgcagtcagggaaaaaatctcgtcgttgtcggcctaaccgggttttctcgaaggactttctagatgcagtagattagtgccgtcttctgagtagtttccttgcaagtgtcgtcccgtccctggagtgaggcagtttagtttgtagtttcttcgcttcatcggcactcgaccggtgtttgattgggatgtttaagctgcagtctgtacttaccccaagcatctatgggggctggtttaaatctcnngatcccacaaaaaaaaaaaaaaaaaaactcgagggggggcccgggaccaattcgccctatagggagtcgaataacaatccctggggcgcgttttacacggcgtgactgggaaaacctggcg

SEQ ID NO: 11013 - protein, 119 aa, Zea mays
  misc_feature: Ceres CLONE 1349795-F
  misc_feature (28)..(97): Pfam Name: HMG_box Pfam Description: HMG (high mobility group) box
MKSRARSTAGDSRLSVRKTKAEKDPNKPKRPPSAFFVFMEEFRKDYKEKHPNVKQVSLIGKAGGDKWKSLSDAEKAPYVSKAEKLKAEYTKKIDAYNNKQSGDPTASGDSDKSKSEGDE

SEQ ID NO: 11014 - DNA, 895 bp, Zea mays
  misc_feature: Ceres CLONE 1349829-F
  misc_feature: Encodes the peptide sequence at SEQ ID NO. 11015
  misc_feature (717)..(717): n is a, c, t, g, unknown, or other
  misc_feature (746)..(746): n is a, c, t, g, unknown, or other
  misc_feature (769)..(769): n is a, c, t, g, unknown, or other
  misc_feature (791)..(791): n is a, c, t, g, unknown, or other
  misc_feature (794)..(794): n is a, c, t, g, unknown, or other
  misc_feature (801)..(801): n is a, c, t, g, unknown, or other
  misc_feature (827)..(827): n is a, c, t, g, unknown, or other
  misc_feature (834)..(834): n is a, c, t, g, unknown, or other
  misc_feature (835)..(835): n is a, c, t, g, unknown, or other
  misc_feature (875)..(875): n is a, c, t, g, unknown, or other
tacccgcggtggcggccgctctagaactagtggatcccccgggctgcaggaattcggcaccaggagagagagagagagagagctcactatccccccccatcactgccaaatcccccagaaaatcaactcctccccaattccacgctgccaccaactcgccgtcctccgcgccaagcaccaaagctccgatggcccgcacgaagcagacggcgcgcaagtcgacgggcggcaaggcgccccgcaagcagctggcgaccaaggcggcgcgcaagtctgcgccggccaccggcggcgtgaagaagccccaccgcttccgccccggcaccgtcgcgctccgggagatccgcaagtaccagaagagcacggagctgctcatccgcaagttgcccttccagcgcctcgtccgtgagatcgcgcaggacttcaagaccgatctccgcttccagtcctccgccgtcgccgcgctgcaggaggccgccgaggcctaccttgtggggctctttgaggacactaacctctgtgccatccacgccaagcgcgtcaccatcatgcccaaggacatccagctcgcgcgccgtatcaggggcgagagggcctgagcgaggctggctcctctcaccgcaggcggcgtcgttgttgcttcgggcctgcttgtaggacttgtgcttctcttgggtcctttctggtggcagtggcatcttggtaccatgtgcttgntctagaaatctaggatagagagtgttcangtgctgggtaccctgatgttatnctgcattcctgctctgaatggntgnctgctgnctaaatgaaatgatattgcttttaantctcagnntcaaaaaaaaaaaaaaaactcgaggggggcccggtacccnatcgcctataggagtcgaat

SEQ ID NO: 11015 - protein, 136 aa, Zea mays; identical to SEQ ID NO: 6923
  misc_feature: Ceres CLONE 1349829-F
  misc_feature (58)..(132): Pfam Name: Histone Pfam Description: Core histone H2A/H2B/H3/H4

SEQ ID NO: 11016 - DNA, 911 bp, Zea mays
  misc_feature: Ceres CLONE 1349864-F
  misc_feature: Translation starting site: 228
  misc_feature: Pfam Name: SAP Pfam Description: SAP domain
  misc_feature (822)..(822): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
cgcggtggcggccgctctagaactagtggatcccccgggctgcagggagagagctcactagtcccccccccccccttccggctccgccccctccaatctgggagggttcagggtttacgtctgcgagcacagcacagatcccccagaaggacaagttataaagacggattcaacgaatattttaatcaggcatctccagttgaacaagcagaagactgagggcaaagatgtggattccagaactgtcggcgaaaacaacagagggaaaagatctgctgccagaagtttggatgtcaacaattcagcaaagaaggctaacttgggtacttcatctggatcatcagcctatgaggaaatttctggcttttcacaacacacactgcagtcatttacagtggagagattgcgtgcacttctacgacaaagtggtcgatcgaccaaaggcaaaaaggatgaactgattgctcgcttacgggagtcgcagggttgacatgaatctggtacttgtttagtcaatcaaaccccttcaggcagggttacacgaccaaatgagtaccatgctgtacttgtcaatggctgctctgcctagatttaatacaatgtaatggcatatgtaggttgagactttgccggaccttattatactcagaatttgttaactagctgttacctgtcagtagtcatgaattcactgttttctcatacccggtagttaaaaaatgcaggtatgtgaattcaattgctaaggtgcatttgcatctgctctttttgctaacgggacgtttggatccctttcatttagaggaattgggaatcactcgntnnnnnnnnnnnnnnnnnnnnnnnnnnnnnnnnnnnnnnnnnnnnnnnnngannnnnnnnnnnaactcggggggggccggtaccattcc

SEQ ID NO: 11017 - DNA, 813 bp, Zea mays
  misc_feature: Ceres CLONE 1349911-F
  misc_feature: Translation starting site: 243
  misc_feature: Pfam Name: Pectinesterase Pfam Description: Pectinesterase
  misc_feature: SWISSPROT Homolog: EC 3.2.1.23 Beta-galactosidase
  misc_feature: SWISSPROT Homolog: EC 3.1.1.11 Pectinesterase
ccccgcggtggcggccgctctagaactagtggatcccccgggctgcaggaattcggcacgagagagagagagagagagctcactagtcccccccccccccccgggtcaagtggaaggggtaccgcgtcatcaccagcgccgccgaggccagcgccttcaccgttggcaacttcatcgacggcgacctctggctcgccggcacgtccatccccttcaccaccggcttgtgagcgcgcggcggtatgtatacgaggggtttcacggcaagggatggcaataaaccaaattggcggcggcggaagttcgtcgttcgtacgttcgttcatttcaatcagagctaaaaaaaaaaggcaccgtttcgatccggtcgtgttactgtagttgattgttttgtgcttggggacgcaggccaatatatttatttaatttaaccgtcccatatatatgtacacgtggttgttatgattcggtgtattatttatatgtatcgatacggtatcaatatataattaataaaaaaaaaacgaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcag

SEQ ID NO: 11018 - DNA, 944 bp, Zea mays
  misc_feature: Ceres CLONE 1349919-F
  misc_feature: Encodes the peptide sequence at SEQ ID NO. 11019
  misc_feature (78)..(78): n is a, c, t, g, unknown, or other
ccggccgcggccccggccccggcggggcgcggggcccgccccgcgcccgtcaggttgggactccaccgcggtgggggncgctctattctagtggatcccccgggctgcaggcccccccccccccccggagggaaccgaccgccgcgggatgtccaggtgctctggtcgagagaagtggggggtcggagatgtgagcacagatccgccgtgcgctagaaccggtcacgccgtcgtcaaatcctcgggaatttctccccggaatcaagccgccaccgcagtaccgcgcgtggccatggtcagaattcagtgttgtgccgtagctgcgaggttacgagtcacttgaagaccaagttggtacctgggaatctcgagtctaaggtcaaggactggtaccacacgatgaggcgcatgaaggatgatatgatgacgctcgtgagtggtctacgctgtcgtctcccagtcaattatggttgttggatcgttgtcttcgcatgatgtaactatttaactattttgtacatagcttcgttatatacaaatgatgtgacattcgtttaccagaacgcgcttaccttcgccatctcgaggtggggcccggtaccccattcgccctttagtgaggcgtattaccattcccttgggccgtcgtttttaccacgttttgtattgggaaaacccctggcgttacccaacttattcgcgctgtgcagcacttcccccctttcccccgcttggcgtaactgccgcagtaggccccgcaccggatcagtccttcttcaaaatttggggccttcccgaatcggcgcatcgggaccattgtgggcggtttaaaatttttgttcaacatttctgcgttaaaatttttgcgggtaacgccgcgttcacttttttttaccccaataaggccctagaatatggtcaaagtctcactcttaataagttag

SEQ ID NO: 11019 - protein, 64 aa, Zea mays
  misc_feature: Ceres CLONE 1349919-F
MSRCSGREKWGVGDVSTDPPCARTGHAVVKSSGISPRNQAATAVPRVAMVRIQCCAVAARLRVT

SEQ ID NO: 11020 - DNA, 827 bp, Zea mays
  misc_feature: Ceres CLONE 1349933-F
  misc_feature: SWISSPROT Homolog: EC 3.2.1.23 Beta-galactosidase
ggcggccgctctatcaatagtggatcccccgggctgcaggatttcggcaccaggagagagagagagagctcactagtcccccccccccccgacgcagacccggggcagcggccatcgatgagcgctgtcctcaagatgctggaggaggagatcttgtccccctgcatgagcgagctgtgctacgagcagcacctggagctctgagctgaggaggaagatggtgctggctgcgtgcgtgaagcgtcatggatgagactgaagttttgtactgtagatacaacgatgatgagtgtaggtgatgtactgatgttttgtgtgctcttagggccaatgaagaacagtaagcagcagttcgtgagtgaagaaggatcgtccattgggcgtactgccctgatacgataccggttggctgcacatgagcggccggccttgtgcggttgtgcctcgcttgcgaattgcaaccaaaagcctgacgagaaaactccatgtgctaatgttttcaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccataggccgaaatcggcaaatccctt

SEQ ID NO: 11021 - DNA, 820 bp, Zea mays
  misc_feature: Ceres CLONE 1349961-F
  misc_feature: Translation starting site: 63
cgggctgcaggatgagagagagagagctcactagtccccccccccccccccccgcatctgccatgggggcgtacaagtacgtctcggagttatggagaaggaagcaatccgacgtgatgcggttcgttcaacgcgtgcgctgttgggagtacaggcagcagccggccatcgtccgcctcacaaggcccacccgccccgacaaggcccgccgcctcggcttcaaggccaagcaggggtatgttgtttaccgcgtccgtgtgaggcgtggtggcaggaagaggcctgtgccgaagggtattgtctatggcaagcccaagcaccagggtatcacccagctcaagttccagaggaacaagagatctgttgctgaggaacgggctggacgaaagcttggtggactcagggttctcaactcctactgggtgaatgaggatagcacctacaagtactttgagatcatcctgggttgatgtggcccacactgccatccgcaacgacccaagaatcaactggctatgcaatcctgtgcacaagcatcgtggagctccgtggtctcacctctgcaggcaagaagttccggggcctggcgggcaagggcccaatttcacaaataatcggccgttatagtgggcccccctggaatgtacatcatatcctgttccccccgtcgattcgttttagcaatccctcctttgcgttttttttaccttcctaccctccaccctgcatcatttttattatcacatcacaactattctctcatactataaattccgctttatcactccagcattctcagtctccctcccacgtcgcctcc

SEQ ID NO: 11022 - DNA, 810 bp, Zea mays
  misc_feature: Ceres CLONE 1349967-F
  misc_feature: Encodes the peptide sequence at SEQ ID NO. 11023
  misc_feature (765)..(765): n is a, c, t, g, unknown, or other
  misc_feature (797)..(797): n is a, c, t, g, unknown, or other
  misc_feature (798)..(798): n is a, c, t, g, unknown, or other
  misc_feature (810)..(810): n is a, c, t, g, unknown, or other
cgggctgcaggaattcggcaccaggagagagagagagctcactagtcccccccccccccccccgaagcccgcccgaacctcctcgcgccaggcgagcagtactgtaagccacatctcgttcgctgaggatggaaccgatcctcccaaaaagcccacatcagtagctgaggtggcaaagcagcgtgagcttagtggcactcttcaaagcgagacggatagtaagacgaagaagcagatctcaaatgcaaagtccaaggagctcagcggccacgacatctttgctgatactctggattccaggtctaacagggcaaggaacccatcgaacggcagcacagcctcacacgcacctgccaaaaatacaaacgccagcaccttctcgtttggagatgccaacactgacagcacgccaaagacggcaaggaagataaccggcaagaaggtcaacgacctcaccggcaacgacatcttcaaagggggacgtgccgccagcttctgcagagaagcatctgagcaccgcgaagctgaaggagatcactggaagcaacatttttgcagatgggaaggaaccaatccgcgagcgtgtgggcggaaaccgcaagcctcctggcggtgagagcagcatcgcgctgatttagcataattccgggactcagtgcgaccccctagaggaggatttccaccagcacaggcacaggctggttggatcccccaagttttggtgtctgtttcctgatcaagggtgcggagtgaaaaaaaccccgntttaagcccctgatgaggtaattaaactggtnnggggggggcaan

SEQ ID NO: 11023 - protein, 204 aa, Zea mays
  misc_feature: Ceres CLONE 1349967-F
GLQEFGTRRERELTSPPPPPPKPARTSSRQASSTVSHISFAEDGTDPPKKPTSVAEVAKQRELSGTLQSETDSKTKKQISNAKSKELSGHDIFADTLDSRSNRARNPSNGSTASHAPAKNTNASTFSFGDANTDSTPKTARKITGKKVNDLTGNDIFKGGRAASFCREASEHREAEGDHWKQHFCRWEGTNPRACGRKPQASWR

SEQ ID NO: 11024 - DNA, 805 bp, Zea mays
  misc_feature: Ceres CLONE 1349981-F
  misc_feature: SWISSPROT Homolog: EC 3.2.1.23 Beta-galactosidase
gtggatcccccgggctgcaggcccccccccccccccccgatctgtctctgtcggtagccgacgcccgacgacgtacgaccatgcatatggcatgatatatgaagccatggactgaactaaagaagaaagcagttagagatacgtgcacagatagacatacagagaatgaagaagaacgtacggatcaccgaccctgccggagttgcatcgtcgctcatcaaccggccggacatggatcgtataatagcaccactgctagtcatatataaaagctacatctagtccctcatttagttaccgcatgcatgctaattagtttttaagcagcccagctgcgtacgcggccgggacagtagcagagaggcaaaaggtttccaactttcgatatttggtgtatgtgggcttctttcgtttgcattggtctgattttttttttttgccttgagttatgtatatacatgaagaaatccacatatagtattttcttcaaagaaaaaaaaaaaaaaaaacctcgagggggggcccggtacccaattcgccctatagtgagtcgtattaaattcactgggccgtcgttttacaacgtcgtgactgggaaaaccctggcggtacccaaattaatcgccttgcagcacatccccctttcgccagctggggtaataagcgaagaagcccgcaccgatccccctttcccaaagttgcgcaaccttgaatgggaatggcaaattggaagcgttaatattttgtaaaaattcgcgttaaatttttggataaacagctcattttttaaccataaggccgaatc

SEQ ID NO: 11025 - DNA, 839 bp, Zea mays
  misc_feature: Ceres CLONE 1349982-F
  misc_feature: Encodes the peptide sequence at SEQ ID NO. 11026
gctctataactagtggatcccccgggctgcagggctcactagtccccccccccccaagagccatatgtggaggacccagataatgaagaagataataaaagacctaagcatggacaatttgaggagggagttcagcagagctaacacatcacgtccacagcctcagacatttatgtttcagagttcaactgttacatatggtgttccgaatggagcctgctatacatcttcatcaactacgaggactggagcagatggatttacgctggaagaaagtaaagaggctgacacaactactggtaaagccactcacaggatttcacgtggcattggcattaagggtcactcgttaacaagaaatcttaattctggggggcgtgtgaacacccttcaaactttacacaacttgaatgaagatgagccttgctagggtttgaggaatcatggtagagaaataccagggagaatatgcctggctggaatcctagaatgaacatgcttggcagtggaaatgttcgctctgacttccgagatgtgaatcaaatgcctgcacttccagccccagaactataccgtggcacgaattttcagaatggctcttccatgggccgggcaccccgcacatgagctcctctgtggcatatgctggatcacagtgctccagaaccgggacttgcaccaatattgagaaaaatgttgaaacccaaaccccgttttgaaaaatacctgtacttgagacagctctaaaagcccagagctttccttaatttccaagcctctttcgaggactccacccactgcacgttactgctgcctgaaatccactcaaccccgtcctc

SEQ ID NO: 11026 - protein, 121 aa, Zea mays
  misc_feature: Ceres CLONE 1349982-F
MWRTQIMKKIIKDLSMDNLRREFSRANTSRPQPQTFMFQSSTVTYGVPNGACYTSSSTTRTGADGFTLEESKEADTTTGKATHRISRGIGIKGHSLTRNLNSGGRVNTLQTLHNLNEDEPC

SEQ ID NO: 11027 - DNA, 831 bp, Zea mays
  misc_feature: Ceres CLONE 1351895-F
  misc_feature: SWISSPROT Homolog: EC 3.2.1.23 Beta-galactosidase
ggagctccccgcggtggcggccgctctagaactagtggatcccccgggctgcaggaattcggcaccagcccccccccccccggttggtaggaggtaggaaggccattgcatttcatttcgcgaggacatttgcattttgtactgtgtagagatcggaagggcattgcatttctggtggggtaggcattatcctttggtagtaggcagcttagaatgcgcagagggagatgactccccctgagacgaaagattcagacttgctgtcgtgaatcttggtgttctgttggtgcggacggcagcaacttcagcttgtacagacatttctttctctgtcgtttggttattaggacttgttcggtagtaggaacattatggtctctttcgtaatgtgatgaatgacttgaaccatcaaacatttgagattcgtcaaaactttaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgccaaattgtaagcgttaatattttgttaaaattcgcgttaaatttttgttaaatcagctcatttttttaacaatagggcgaaatcggcaaatcccttataaatcaaaggatagacccagataggggtgagtgttgttccagtttggaaccagagtcccttataaagaacggggactccaacc

SEQ ID NO: 11028 - DNA, 838 bp, Zea mays
  misc_feature: Ceres CLONE 1351896-F
  misc_feature: Encodes the peptide sequence at SEQ ID NO. 11029
aagctggagctccccgcggtggcggccgctctagaactagtggatcccccgggctgcaggatgtctcaccgcgatacccctctcctctgactcgaggggtgacccgacacccaattcgccctataccgagacatattaccattcactggccgacaatttacaaagtagtgactgccaaaaccctgccgttacccaacttattccccttgcaacacctccccctttcaccatgtggagtagtagcgaaaaggcccgcaccgatcgcccttcccaacaattgcccactctgaatggaaaatgctccattgtaagcgtgtaccattttgctaacatccacgataaatttttgttagatcacctcattttttacccgatataccgaaatcagaacaatcccttattgatcagaagagtagaccgagatagggttgagtgctgttccaatgtgccacacatactgcactattaaagaacgagaactcccacgtcaaagggcgaacaaccgactatcaggtggatggcccactacgtgaatcatcgccctaatcgagtgttttgactactaggtgccgcaaagcactaaatcggaaccctaaagggagcccccgatttagagcttgacgcccaaagccggctaacgtgacgagaaaggaaggtaacagagcgaaaggatcggacgctagggcgctgacaagcgtagcggtcacgctgttagtaacatcacacccgtcgcgcttatgcgactgtacagagtgcgtcaagtggcacttctctggcaatgcgcacggtacccctactctgttatttttctaatacatgcaacatgtatccgctcatg

SEQ ID NO: 11029 - protein, 79 aa, Zea mays
  misc_feature: Ceres CLONE 1351896-F
  misc_feature: SWISSPROT Homolog: EC 3.2.1.23 Beta-galactosidase
MWSSSEKARTDRPSQQLPTLNGKCSIVSVYHFANIHDKFLLDHLIFYPIYRNQNNPLLIRRVDRDRVECCSNVPHILHY

SEQ ID NO: 11030 - DNA, 844 bp, Zea mays
  misc_feature: Ceres CLONE 1351897-F
  misc_feature: SWISSPROT Homolog: EC 3.2.1.23 Beta-galactosidase
  misc_feature (803)..(803): n is a, c, t, g, unknown, or other
  misc_feature (805)..(805): n is a, c, t, g, unknown, or other
  misc_feature (806)..(806): n is a, c, t, g, unknown, or other
  misc_feature (842)..(842): n is a, c, t, g, unknown, or other
tccccgcggtggcggccgctctagaactagtggatcccccgggctgcaggaattcggcacgagagagctcactagtccccccccccccccaggcgctcccctgggcctcttaggcggcgctcgccacctccaaggcgtttgaggagcccaccaagaaggccaccacctccacgtcgctatagtcgatctcctcctcgccgaccccttcgctccagatcgatttctccaagaaggggacgagggcctctcttgaggcgtggtaggtcaggctcatcatattctcgatcacctactccaccgccaagaaaggggccaagaagggtatcaaggagtcgcagccctagaaggcctcccagaggaagaagcatctctagtgacagccgaagcagcagttctccttcccctagacgtggcaggtagaaggaacccgttgcattgtgtatccggcaggtaaagcctacggcaatgcttccagtggatctgcttaacatgcctggtgggctcactggcttgtgatttgtacccgagacagaattatctgccatgtgacatctggctcatgtacttgattgtaccccaagtatcttgaacttgtttccgcacaggagtctggatctttttttttgcattaaaccattgtgctacttggtctaaagcgttactgggtctttcgtttcaggagtcaaaaaaaaaaaaaaaaaaaactcgagggggggcccggtacccaattcgccctatagtgagtcgtattacaattcactggccgtcgttttacaacgtcgtgactgggaaaaccctggcgntnnaccacttaatcggcttgcagcacatccccctttcgnca

SEQ ID NO: 11031 - DNA, 865 bp, Zea mays
  misc_feature: Ceres CLONE 1351898-F
  misc_feature (776)..(776): n is a, c, t, g, unknown, or other
aagctggagctccccgcggtggcggccgctctagatctagtggatcccccgggctgcaggaattcggcacgagagagctcactagtccccccccccccccaggcgctcccctgggcctcttaggcggcgctcgccacctccaaggcgtttgaggagcccaccaagaaggccaccacctccacgtcgctatagtcgatctcctcctcgccgaccccttcgctccagatcgatttctccaagaaggggacgagggcctctcttgaggcgtggtaggtcaggctcatcatattctcgatcacctactccaccgccaagaaaggggccaagaagggtatcaaggagtcgcagccctagaaggcctcccagaggaagaagcatctctagtgacagccgaagcagcagttctccttcccctagacgtggcaggtagaaggaacccgttgcattgtgtatccggcaggtaaagcctacggcaatgcttccagtggatctgcttaacatgcctggtgggctcactggcttgtgatttgtacccgagacagaattatctgccatgtgacatctggctcatgtacttgattgtaccccaagtatcttgaacttgtttccgcacaggagtctggatctttttttttgcattaaaccattgtgctacttggtctacagcgttactgggtctttcgtttcaggagtcaaaaaaaaaaaaaaaaattcgaggggggggccgggaaccaattcgccttatagggaggcgtattacaattcctggccgccgntttaaacgtcgtgacttggaaaacctggggttaaccactttaacgccttgaggacatccccctttcccaagtggggaatagcgaaaagc

SEQ ID NO: 11032 - DNA, 882 bp, Zea mays
  misc_feature: Ceres CLONE 1351927-F
  misc_feature: Encodes the peptide sequence at SEQ ID NO. 11033
ccccgcggtggcggccgctctagaactagtggatcccccgggctgcaggaattcggcacgagcccccccctctcgcgccgccgcggaggccgacaccgcaccacactacccagcggaatccgcccacccgcactcggagcacaggagatatgtcgcacgggaatggaggagcctcgaggaaggaggaggtggtcaccatggagtacatcatccatctccacaagcgcctccacggctgcaaattcaggaacaatgcacccttcgccatcatggagatcaggaagtttgcacagaaggccatgggcacctcggacgtcaggatcgatgtgaagctcttctagctcatctggatcatctttatcacgaacgtgccgcgcagggttctcgcgaggatctcccgcaagaagaccgatgaggaggatgccgaggaggaactctactcccttgacaccgtcgcggagatccctgcctacggcttgaaagggctggggaccatcgttcctgacgagggccattaagctgacgcgttcctccaatctttagagatgccgtagatgtgtcttaaaccgcaaaatctttaccatccgaggaagctcctgtattcaccttgttgtctatttcctgcacaaaattgcctgcgctgattgctttttctccataaggatctggactctatgggcctccggggggggggcacgagtcccccattttccctcataaagaggatccggagataacaattctgcgggcccgacgtgtttaaccgcgtggcgtggcctggggacaatccctcaggggggttacccgaaaattccatctacttgttggcgggattcgtttcgcccccattttttgcaccagctggggcatcaaagtcacgcc

SEQ ID NO: 11033 - protein, 63 aa, Zea mays
  misc_feature: Ceres CLONE 1351927-F
  misc_feature (10)..(62): Pfam Name: Ribosomal_L31e Pfam Description: Ribosomal protein L31e
MSHGNGGASRKEEVVTMEYIIHLHKRLHGCKFRNNAPFAIMEIRKFAQKAMGTSDVRIDVKLF

SEQ ID NO: 11034 - DNA, 899 bp, Zea mays
  misc_feature: Ceres CLONE 1351943-F
  misc_feature: SWISSPROT Homolog: EC 1.2.1.3 Aldehyde dehydrogenase (NAD(+))
  misc_feature: SWISSPROT Homolog: EC 3.2.1.23 Beta-galactosidase
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (668)..(668): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (676)..(676): n is a, c, t, g, unknown, or other
  misc_feature (677)..(677): n is a, c, t, g, unknown, or other
  misc_feature (782)..(782): n is a, c, t, g, unknown, or other
  misc_feature (803)..(803): n is a, c, t, g, unknown, or other
tccccgcggtggcggccgctctagaactagtggatcccccgggctgcaggccccccgcccccgctgccttgtgaagtctgttgtagaagatagattgtggccatatattagaacagtgatcccgaagcctatccagtatcccgtctcagagcatggatttgagttccagcagttgcttgtggagactctgtatggctatagcgtgtgggacaggttgcggtcccttgtgaatcttataaagatggttaccgagcagaattctgccccggcttcaaatgcgaccacgaagaaaaggcgatgagacgaatgcccggggggttcattgaatctgtttatggtaagtctgatctctggacgctgtaaacctccccaagctgctgtaatcggccttgtttgctctctgaaacaatctcgagcctgggagcttgtgtattcaagcgctttagctttcatttcagaaccttcttttttttttctctctctccctctctccctttcttattaacacccacatgcgtgggcaatggaaatgaaattccactgtggatgtgctaggaactgtcattgtgctgccgctgctgtgatttgtgaacatcatcggtattgagggtgnnnnnnnnnnnnnnnnnnnnnnnnnnnnnnnnnnnnnnnnnnnnnnnnnnnngaanannnaaannaaaaaaaactcgagggggggcccggtacccaattcgccctatagggagtcgtattacaattcactggccgtcgttttacaacgtcgtgactgggaaaaccctggncgtaccaacttaatcgccttnagcacatcccccttttcgcagctggcgtatagcgaagaggcccgcaccgatcgcccttcccaacagtgcgcagcctgaatggcgaatggcaattgt

SEQ ID NO: 11035 - DNA, 877 bp, Zea mays
  misc_feature: Ceres CLONE 1351968-F2
  misc_feature: SWISSPROT Homolog: EC 3.2.1.23 Beta-galactosidase
  misc_feature (633)..(633): n is a, c, t, g, unknown, or other
  misc_feature (676)..(676): n is a, c, t, g, unknown, or other
ggagctccccgcggtggcggccgctctagaactagtggatcccccgggctgcaggaattcggcacgagagagagagagagagagagctcactagtcccccccccccccaagcccgccaccatccagggatcaatcctcaccacgaggaccaggggtgatgccaacaaggttgagaacaagtcaagagggtttgatttttgtcatgtatggttccacagaagagcctgagaatgcattatcgaatctcaatggagctatgagttctgaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcgggcaaatcccttataaatcaaaagaatagaccgagatagggttgagtgttgntccagtttggaacagagtccactatttaagaacgtggactccnacgtcaaagggcgaaaaccgtctatcagggcgatggccactacgtgaccatcaccctattcaggtttttggggtcgagtgccgtaaagcactaatccggacctaagggagccccgattttaagctggacgggaaagccgcaacggggcgagaaggaaggaaaaagcaaagaacggccctggggcttgaaagggacggcccc

SEQ ID NO: 11036 - DNA, 877 bp, Zea mays; identical to SEQ ID NO: 11035
  misc_feature: Ceres CLONE 1351968-F
  misc_feature: Encodes the peptide sequence at SEQ ID NO. 11037
  misc_feature (633)..(633): n is a, c, t, g, unknown, or other
  misc_feature (676)..(676): n is a, c, t, g, unknown, or other

SEQ ID NO: 11037 - protein, 75 aa, Zea mays
  misc_feature: Ceres CLONE 1351968-F
GAPRGGGRSRTSGSPGLQEFGTRERERESSLVPPPPKPATIQGSILTTRTRGDANKVENKSRGFDFCHVWFHRRA

SEQ ID NO: 11038 - DNA, 901 bp, Zea mays
  misc_feature: Ceres CLONE 1351987-F
  misc_feature: Encodes the peptide sequence at SEQ ID NO. 11039
  misc_feature (707)..(707): n is a, c, t, g, unknown, or other
  misc_feature (742)..(742): n is a, c, t, g, unknown, or other
  misc_feature (743)..(743): n is a, c, t, g, unknown, or other
  misc_feature (756)..(756): n is a, c, t, g, unknown, or other
  misc_feature (759)..(759): n is a, c, t, g, unknown, or other
  misc_feature (802)..(802): n is a, c, t, g, unknown, or other
tccccgcggtggcggccgctctataactagtggatcccccgggctgcagggatagagagcttactagtccccccccccccccccacgagtgttggggctgtcattatgggatttgagctcacttggtttctgtttaaatgtcagctgctgtggtttttttggtcactggatgactgctgctgttggctggtcaggtttgatatcgagaaatatccattgcattctgcgtttgaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaaacagagtccactattaaagaacgtggactccaacgtcaaagggcgaaaaaccgtctatcagggcgagggcccactacgtgaaccatcaccctaatncagtttttttgggtcgaggtgccgtaaagcactannatcgaaccctaanggnagccccccgattaaagcttgacgggaaaagccgccgaacgtgncgagaaaggaagggaaaaagcgaaggagcggcgctagggcctggcaagtgtaacggtcacctgccgtaccaccaacccgccgggctaatgcgcgctacg

SEQ ID NO: 11039 - protein, 135 aa, Zea mays
  misc_feature: Ceres CLONE 1351987-F
  misc_feature: SWISSPROT Homolog: EC 3.2.1.23 Beta-galactosidase
MGFELTWFLFKCQLLWFFWSLDDCCCWLVRFDIEKYPLHSAFEKKKKKNSRGGPVPNSPYSESYYNSLAVVLQRRDWENPGVTQLNRLAAHPPFASWRNSEEARTDRPSQQLRSLNGEWQIVSVNILLKFALNFC

SEQ ID NO: 11040 - DNA, 772 bp, Zea mays
  misc_feature: Ceres CLONE 1351991-F
  misc_feature: Encodes the peptide sequence at SEQ ID NO. 11041
  misc_feature (327)..(327): n is a, c, t, g, unknown, or other
  misc_feature (347)..(347): n is a, c, t, g, unknown, or other
tggcggccgctctacaactagtggatcccccgggctgcaggatattcggcacgagagagagagagagagagagctcactagtccccccccccccccccccgctattgcagcaggttgaagggcccaaatcacctgaagagatgataacagttcttcaacgtgttgttgaagaatgtgctacatcacttgttgctgctaggattgaagctgaagagagactaaacaaccagcgattgcgtgaggaacaagatgctgcttacagagctgcacttgaagctgatcaggccagggaacgtgaaaggttagaggaactgaaaagacgtgaangagaggctgcagaggctganaaaaagcgtaaagaagaaggaggaaactgtacccaagggcatccccaaaaaaacacctgaaaaggaaaactggctcttgcaagggggaggcaaaaaaaaggccttggttccttgggagtttaaccttgaaaaagggaccagggggttacccccggtctccccaaaaaaattcccccctggggaaaaccccaaaaaggggggaatttttcaagtttttgggaacggggggttccccccttgggaaaatgggggcctctccccccaaaggggggggaagggggggaaaaacccccccccttttttttttttccccccccctgttttttttggggtcgcaaaaaaaaaaccccccctcccctggggaaaaaaaaatttttttttttttttgcggggggggttttttttttttataaaaaaaaaaaaat

SEQ ID NO: 11041 - protein, 134 aa, Zea mays
  misc_feature: Ceres CLONE 1351991-F
  misc_feature (109)..(109): Xaa is any aa, unknown, or other
  misc_feature (115)..(115): Xaa is any aa, unknown, or other
AAALQLVDPPGCRIFGTRERERESSLVPPPPPPLLQQVEGPKSPEEMITVLQRVVEECATSLVAARIEAEERLNNQRLREEQDAAYRAALEADQARERERLEELKRREXEAAEAXKKRKEEGGNCTQGHPQKNT

SEQ ID NO: 11042 - DNA, 880 bp, Zea mays
  misc_feature: Ceres CLONE 1351995-F
  misc_feature: Pfam Name: TCP Pfam Description: TCP family transcription factor
  misc_feature: SWISSPROT Homolog: EC 3.2.1.23 Beta-galactosidase
  misc_feature (757)..(757): n is a, c, t, g, unknown, or other
  misc_feature (815)..(815): n is a, c, t, g, unknown, or other
ggagctccccgcggtggcggccgctctatactagtggatcccccgggctgcaggaattcggcaccaggggggcgacggggacgagagacgggggcgcctcctcggtcgtgacaccggtgccggtggcggcgattatggaaggctcggcctggcgcagcaaccactcgatggtctctccgtcggtgcggtgtccgagttcacgcgtgagctggaagacgcgcgccgccaccatggcgtcctcagtgtcccttacgccggtcccgtactacaccgcgctcctcatgcaaccaccgcccaccgccaatgagtcccctgtcgcctctgcatccgtatctggcactgttgcggataacaactaggctaggtggaagaggattatcaaatggcagttaggctaaaagttagttagtggttagggtttattatgtgtgctatgtggtcatggcttattaccttgggagaggattacggtgatttagctagcaaaactgattgagaatgtaacaacagaaggaatgacatcttttaaagtgttttttgagtcaaaaagaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatcccccttttcgcagctggggtaatagcgaagaggcccgcaccgatcgcccttcccaacagntgcgcaggctgaatggcgaatggcaaatgtaagcgttaatattttgttaaaatcgcgntaaatttttgttaaatcagctccatttttaacaatagggcggaatcggcaaatcccttataaata

SEQ ID NO: 11043 - DNA, 916 bp, Zea mays
  misc_feature: Ceres CLONE 1352014-F
  misc_feature: SWISSPROT Homolog: EC 3.2.1.23 Beta-galactosidase
  misc_feature (215)..(215): n is a, c, t, g, unknown, or other
  misc_feature (286)..(286): n is a, c, t, g, unknown, or other
  misc_feature (297)..(297): n is a, c, t, g, unknown, or other
  misc_feature (345)..(345): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (373)..(373): n is a, c, t, g, unknown, or other
  misc_feature (374)..(374): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (410)..(410): n is a, c, t, g, unknown, or other
ctggagctcaccgcggtggcggccgctctagaactagtggatcccccgggctgcagggagagagagagagctcactagtcccccccccccccctcggcgcgcaggtaatcccagtcaagaacgacagtggctcctccttggtgtgaaggaagctccgacgtgttccgtttgtcgtcgtcgtcctggacgttgtgatgcaacgtttctagtaatanctatgtatgctgtatgcatgtggtgaagcaagtgctcgtcggtgtgagtggtcgctcttctgatccatggnctgggctctgnactggagggatcagcgtcaaaataaagaatgcctgtcctttgttaganttnnnnaaaaannnnnnnnnnnnnnnanngaaannnnnnaaaaaaactcgaggggggggcccggnaccccattccgcctatagggagtcgtataacatttcactgcccgtcgttttacaacgtcgggactgggaaaaccctggggttaaccaacttactcgctttgaaacaactcccccttttcgccggtggggtaatagggaaaaggcccgcaccgattccccttcccaaaagttgcccagccttgaaggggaatggcaaaatggaaacctttattttttggtaaaaatccggggaaaatttttggtaaacccacttcattttttaaccaaaagggcagaatggggaaaattcctttattaatcaaaaaaaataccccgagatgggggtggaggggtttctccattttggaacaaaatttcctttttaaaagaacgggggcctccacgctaaaagggaaaaaaacccgtttttggggggaggggcgcctttacgggaaaccctccccttataaatttttttttggggcgggggggcgccaaaaactcaatatccgagccttaagggggcc

SEQ ID NO: 11044 - DNA, 877 bp, Zea mays
  misc_feature: Ceres CLONE 1352033-F
  misc_feature: Encodes the peptide sequence at SEQ ID NO. 11045
  misc_feature (748)..(748): n is a, c, t, g, unknown, or other
tccccgcggtggcggccgctctagaactagtggatcccccgggctgcaggaattcgagagagagagagagagagctcactagtccccccccccccaaaccctaaacctaaacctctcacccggcgccgccgccgccaccgccgccgccccgaggccccatcccagcgcaaccgacttccgcctcggattgaagcaatgtcgtcggacgacgaggtcagggaggagaaggagctcgacctctcctccaacgatgtcgtcaccaagtacaagactgccgccgaaatcctgaacaacgctctgaagctggttgtgtctgagtgcaagccaaaagcaaagattgttgacctttgtgagaagggtgactctttcataagagagcaaactgggaatgtctacaagaatgcaaagaggaagattgaaaggggcattgctttcccaacctgtgtttctgtgaaacacacagtctggcacttctccccgcttaccacagatgatgcagttctgggaagaaatgatatggttaaaattgacatgggggtgtcatattgatggctttattgctgtggtggcacatacacatgtaattgcaaatggcctgtcacaggaagagcagctgatggtcttgcttggtgccacacagcaacaaaagtggcatgaggctggtcagacttgggaagaaaaataggatgttacctgaccaatcaaaaggtgctgctgtttatgatgcaaaatgggggaggggtcttanccatcacctgagcatttgggatgagggaacaagtgggctaaggccctcatgctgaacaaaggggtgaggtgaattgaaaaatgaattatgcacgattggccccacctgggggggggagcccagttttgg

SEQ ID NO: 11045 - protein, 117 aa, Zea mays
  misc_feature: Ceres CLONE 1352033-F
  misc_feature: SWISSPROT Homolog: EC 3.4.11.18 Methionyl aminopeptidase
MSSDDEVREEKELDLSSNDVVTKYKTAAEILNNALKLVVSECKPKAKIVDLCEKGDSFIREQTGNVYKNAKRKIERGIAFPTCVSVKHTVWHFSPLTTDDAVLGRNDMVKIDMGVSY

SEQ ID NO: 11046 - DNA, 841 bp, Zea mays
  misc_feature: Ceres CLONE 1352103-F
  misc_feature (511)..(511): n is a, c, t, g, unknown, or other
  misc_feature (514)..(514): n is a, c, t, g, unknown, or other
  misc_feature (562)..(562): n is a, c, t, g, unknown, or other
cgcggtggcggccgctctagaactagtggatcccccgggctgcaggaattctttttttttttttttttgcacgactcacgatgcgaatacatcgtggatcaaagcacccacacattactacatagagagagtaaacagacagaagcgcacacatcggttcatgcctacgtactctgctcgcggcaacatgcatccacgatacaccgttacgaactgtgtagaccattcctaaacaccataataaatgactagagacaggcacacctcgatatagcttaaaataccagtagcattattttattactctccgccagggccatgcatggattcctcgcccggacgcgcacaggacgcctcatcacttaattaatcgtgttgcagttaacgttggtgctgatcttgtacggcagggcgacgccgcacttgctgggcagcgcgggggcgcggctgatgtaggtgccgctcccgttggcccggttggcgacgttcttgaggagccgaattggtgganggnccgaaatttgtgtaaatgtccttcagaatcaggatgaataagccgctnaaggcgggatgggtgggtcatgttgcgcacagagtgcactatcaaagaacgcggactcaaagggctaagggcgaagaacgtctatttaggcggatgcacccactaccggaacatcaccctattcgacgtcttttgggcccgagcgggccaaagtcactagcttcgaaccatacaggcagctccctattttagctcggacgggatacctacaaacggggcgagaaaggaaggaaagaaagcaaaaagatgaataataaggcctggaaatcgaaattctgg

SEQ ID NO: 11047 - DNA, 873 bp, Zea mays
  misc_feature: Ceres CLONE 1352114-F
  misc_feature: Encodes the peptide sequence at SEQ ID NO. 11048
  misc_feature (478)..(478): n is a, c, t, g, unknown, or other
  misc_feature (507)..(507): n is a, c, t, g, unknown, or other
  misc_feature (508)..(508): n is a, c, t, g, unknown, or other
  misc_feature (613)..(613): n is a, c, t, g, unknown, or other
  misc_feature (617)..(617): n is a, c, t, g, unknown, or other
  misc_feature (635)..(635): n is a, c, t, g, unknown, or other
  misc_feature (654)..(654): n is a, c, t, g, unknown, or other
  misc_feature (691)..(691): n is a, c, t, g, unknown, or other
  misc_feature (694)..(694): n is a, c, t, g, unknown, or other
  misc_feature (695)..(695): n is a, c, t, g, unknown, or other
  misc_feature (726)..(726): n is a, c, t, g, unknown, or other
  misc_feature (727)..(727): n is a, c, t, g, unknown, or other
  misc_feature (802)..(802): n is a, c, t, g, unknown, or other
ggagctccccgcggtggcggccgctctagaactagtggatcccccgggctgcaggccccccccccccccccccccagtggcttccatcagcaagatggttctcatgtgcctactcaggccagcaagtggcacgcacagctacatggatgtgcttttcgtggccaacaagcaccagctgttccatctcaatcctcatccccaccatctgtcctgatgtttcaacgaggtgatccaaagatgtccccatttgaatttgggcatttccacgtgaataagaaagaggatagacgcgcaatgtttgtccatgctggaggcatcggaggaactgagcaaacgacgatgctccaggctcatcatgtttctggaggaacgggaaacagagatgtgaccgttgagaaatctcatcccgctgttgccgctgcttcaacaaacagggaagttagcaaaaacagttgcaaaatatttggcatatctttgnaccgagaaggttccagcaatgaaagaaannagggctggtggtgacatcaacaccaactatccatcccccttcctgtctttgaagcaacaagtgccgaaatcgctgggcaacagctgtgccaccgttcatgagcanaagncctgtgtttgcctagggntgattgacgtttcaacagngggatatgaatgatctgatgtaattggaaactgtccntgnnagctgtgtttgcgtaatggggaaaatgtccnngttttttgatgtttcggtattcgtgaagaccggatttttgatttgaggatcctggccagatttggtatccaaaanttgtagctgtttaaagcacttttgatgaacaacggggaagtgctcccgtgttatcaaccactagtttgctg

SEQ ID NO: 11048 - protein, 173 aa, Zea mays
  misc_feature: Ceres CLONE 1352114-F
  misc_feature (160)..(160): Xaa is any aa, unknown, or other
  misc_feature (169)..(169): Xaa is any aa, unknown, or other
  misc_feature (170)..(170): Xaa is any aa, unknown, or other
GAPRGGGRSRTSGSPGLQAPPPPPPSGFHQQDGSHVPTQASKWHAQLHGCAFRGQQAPAVPSQSSSPPSVLMFQRGDPKMSPFEFGHFHVNKKEDRRAMFVHAGGIGGTEQTTMLQAHHVSGGTGNRDVTVEKSHPAVAAASTNREVSKNSCKIFGISLXREGSSNERXXGWW

SEQ ID NO: 11049 - DNA, 864 bp, Zea mays
  misc_feature: Ceres CLONE 1352134-F
  misc_feature (864)..(864): n is a, c, t, g, unknown, or other
cgcggtggcggccgctctagaactagtggatcccccgagcgccaatttgatatatcgagcatcgtatctgtaccacgctgaacatcgtctggatttcgtcgcgactgttcaatatccggtgcgatagccatgtcaatcatgctatggaaacttccccctttctacggctgaggaaaaaggaaaaaaggagccgacacctgggaattgacaccgaccggaaattctggaaggcgagggaatgatcgcaatagcaaaaactatgtaaccgtacacgctacgttgtagagaaatctgatcgtttaacccacaacagagcgcgaattagtagcgatcttcttatttatcacgagagactgcgactcagcttcgagagagacgtccatttcgcaaccgatactcgctgttgagcgacatagacatgccacttcccgcaggcgcgaaaaactgtcgatcaaggcgcacgggccactatgctggccaacacactagtaaagaatgttcggctgactggagagcacggcaaatgatggatcactctaccgtcaaaccgagcgctacctgaccgttttcacccacgacgcaaatgacggagaaacagatcttccacagtgaaaggagactgtttcaggcagctggcaagtgtgtcgtccacccattcctagaaccagccccgccaccaagttgaccgatacggtagacgaatagaaagcagtggcctttcgttgaaaagggcgcggaatgccaaattccgtgtagtttcccaacttaaatccgctttgcaatccatcccctcttaagaaaactcggggaattagcgtaaacgaccagtcacacatggcccttttccgaaatacttcccccttn

SEQ ID NO: 11050 - DNA, 861 bp, Zea mays
  misc_feature: Ceres CLONE 1352165-F
  misc_feature: Encodes the peptide sequence at SEQ ID NO. 11051
  misc_feature (676)..(676): n is a, c, t, g, unknown, or other
  misc_feature (729)..(729): n is a, c, t, g, unknown, or other
tacccgcggtggcggccgctctagaactagtggatcccccgggctgcaggagagctcactagtccccccccccccccactagcacaaggttgaaaccagcgttgccgagcgagagaaacagagcgccccctgtccaagtggtcaggtccaggacaccctccacgcacgcactgatggaacccctggtgttcgtgctgctcttggtggccatgccactcagaggatcagatggcgcgtggtgcgtgtgccgcccggacgtgtccgatgcggcgctgcagaagacgctggactacgcgtgcgggcacggcgcggactgcgccgccgtgctcccgaccgggccgtgctacagccccaccactgtgcgcgcgcactgctcctacgccgccaacagctacttccagcagaacagccaggccaacggcggcgccacctgcgatttcggcggcacggccaacctcaccgacacagacccgagctctggaacttgcaaataccctgcaacacaaagcgaagcagggacaagcggcaacgccaccggcacgggcacggcaccgccaggctcgacgagtaaccagtacaccccccctttggggggaggggggagcgtcacacgacactggttggggggggttgtttgttcccgcgcctagcaccttcagcgcggccaccgcctggncccccccggttttgggtgttcgccgtgccttcttcctcgccgtcgtctccgtncctgtctttcttggcgcgctaacttgctcgatcagaagaaatccgtagcatcgtcacccctatgtgtaattggcggccgcaaaggacagggcctttttttttttggtgtcatggcgccttcgtgaatatttc

SEQ ID NO: 11051 - protein, 158 aa, Zea mays
  misc_feature: Ceres CLONE 1352165-F
  misc_feature (21)..(107): Pfam Name: X8 Pfam Description: X8 domain
  misc_feature: SWISSPROT Homolog: EC 3.2.1.39 Glucan endo-1,3-beta-D-glucosidase
MEPLVFVLLLVAMPLRGSDGAWCVCRPDVSDAALQKTLDYACGHGADCAAVLPTGPCYSPTTVRAHCSYAANSYFQQNSQANGGATCDFGGTANLTDTDPSSGTCKYPATQSEAGTSGNATGTGTAPPGSTSNQYTPPLGGGGSVTRHWLGGVVCSRA

SEQ ID NO: 11052 - DNA, 858 bp, Zea mays
  misc_feature: Ceres CLONE 1352186-F
  misc_feature: Encodes the peptide sequence at SEQ ID NO. 11053
ccccgcggtggcggccgctctataactagtggatcccccgggctgcagggagagagacagagctcactagtcccccccccccccccccggccggccggaggaagctagctaattataaagcttaataaagtatagcggcgtcgctgtgtgtgtttcgagtcagtcagtcagtcagttgcgtgccatggcatgctccgagtctgagatgatgatgatgcctgatggcggcgtcgtgtcctcccctggccccctggggcgcttctggcgagcagtgtgttgtgttgtgttgtgtgggtgccgcacgctagcaggctagccatgtgccctgctgtgttgtgtcaccatccatctataatcttatctataccccaccttttgtgtaccgcgtgtacccctttttcctgatgtctgttcccgagtaccaaggggtgtttggttccctcttctaatttctaatcacatgagatgttttcggtccaaaaaaaaaaaaaacacacatatcattcccaaaggaaacccctattttttaaactcgagggggggcccggtaccccaattcgccctatagtgagccgtattacaatttcactggccgtcgttttacaacgtccgggactgggaaaacccctggcgtttacccaatttaatcccctttggagcactttccccctttttccccagttggcgaaatagcaaagaaggccccgccccgcatccggccctttcccaaaatttgcccccccctgaatggcaaatggcaaaattggtaaccgtttatatttttggtaaaaattccgggataaatttttggttaaaaccccgcctttttttttacccaaaagcgccaaaacccgcaaa

SEQ ID NO: 11053 - protein, 43 aa, Zea mays
  misc_feature: Ceres CLONE 1352186-F
MACSESEMMMMPDGGVVSSPGPLGRFWRAVCCVVLCGCRTLAG

SEQ ID NO: 11054 - DNA, 1060 bp, Zea mays
  misc_feature: Ceres CLONE 1352199-F
  misc_feature: Encodes the peptide sequence at SEQ ID NO. 11055
  misc_feature (1060)..(1060): n is a, c, t, g, unknown, or other
ccctcccccctttgtcccgcctacgcgggcgggcgccccccccccacccctcccctgggcgctccaccgcggtggcggccgctctataatagtggatcccccgggctgcaggaattctgcacgaggagagagagagagagctcactagtcccccccccccccccagcccccacaagacgaggcaacaatggcgctagaagcagccaccgccccccgcgcactcctcgccgcgtgcctcgtcctgctggtcctcggcggcgggaccggcccgtcgtcggtgctgcgcggcgccggggcgcaggccgccgggcagtgcctgccgcaggtgaaccgcctcctggggtgccgcgcgtacctggtgcccggcgcgccggaccccagtgcggactgctgcagcgagctgaacgccgcgccccacgagtgggtctgcaggatcatgggcatcctcaacagacttggccggcccggtggcccctcgcccaagccaactgcatccgtttgaaagagggcccctggcaccgcgtgcttgaaacgggctgggagggaagggggagagtgaactaccacaaggggtttccctttttcgattgtccgcagccgctcgaggcctctcaaggttgtcccccctgcccggcgttcttcttttttttttggaaactgccggaacctcgcggcgttgggcggggctattatttcggcccgctctctccgtacttatctaaaccccccgccccacagcgccctacccgcgtggtctgggccgcgccgggcttcgagatacacagcaattatgtaccaccctcttgtggtgcgggcgccccgtggggcccacatatctggcccccaccacaggtgcggcctccccactgacacgagttcgtccggggcgtcccgtcgtctattacaaagggatgcccgtcatagtgcgaccagaccttgtgggtgcgaaccctacgcttatataaccggcccgtcgcgacacgaatcttgcgtgggtatcagcaccgaagatgggggtgcgaccgcacgccgcatgtgagtctcggtcctcctgtcgatn

SEQ ID NO: 11055 - protein, 104 aa, Zea mays
  misc_feature: Ceres CLONE 1352199-F
MALEAATAPRALLAACLVLLVLGGGTGPSSVLRGAGAQAAGQCLPQVNRLLGCRAYLVPGAPDPSADCCSELNAAPHEWVCRIMGILNRLGRPGGPSPKPTASV

SEQ ID NO: 11056 - DNA, 1138 bp, Zea mays
  misc_feature: Ceres CLONE 1352201
  misc_feature: Encodes the peptide sequence at SEQ ID NO. 11057
ccccccgctcgtcctacacagtctgccactgtccctcgctgttgcagtggccaagtaacgaatcactgtctcgttctcaatgggacacagtttcttttcgatgcacaggataacatctcgctcgggtttgcttggtagatgttacagctctgccgtgaagggaggcacctcgatcgctggcgtatgtgacatcattgctgtcgcatctgggaaaggcggcgtaggcaagtccaccactgcagttaacattgctgtagcacttgcaaaggagtttaagcttcaggttggtttgctagatgctgacatctatggaccatccattcccacaatgatgaatctccatgccaagcctgaattaagtgaagacatgaagatgattccaattgagaaccatggtgtgagatgcatgtccattggttttcttgtagacaaagacgcaccaattgtttggagaggtcctatggtaatgagtgctcttgagaagatgacaaggggagttgcttggggggaccttgatattcttgttgttgatatgcccccaggcactggtgatgctcaactatcaatgtcccaaaggcttcggttatctggtgctttaattgtttcaactcctcaagatattgctcttatcgatgctagaagaggagccaacatgttccgcaaagttcaagttccaattctgggattggtagagaatatgagttgctttaaatgctcaaaatgtggtgagaaatcttacatctttggggaagctggagcacagaggactgcagaggaaatggacatgaaattacttggtgatgtacctcttgaaatcagtatcagaacaggttcagatgaaggcaaccctattgttgtatcatcacccaactcagcatctgcgcaagcgtacgtaaatgttgcggagaaggtgactcaaaggctcaaggagttagcagaggagcgacggatgggcccagaaatcttactttgagaaattcaggctgcttttctcacacctttccctgtttgacgctacggcgccaaaacaatgtactgataagtagattgctgttggaagtaaactttaaatttcgtcactctgtctgaaaatttactcaaacaaacttctgctgcttcaaaaaaaaaaaaaaaaaaa

SEQ ID NO: 11057 - protein, 297 aa, Zea mays
  misc_feature: Ceres CLONE 1352201
  misc_feature (39)..(250): Pfam Name: CbiA Pfam Description: CobQ/CobB/MinD/ParA nucleotide binding domain
  misc_feature: SWISSPROT Homolog: EC 1.18.6.1 Nitrogenase
MGHSFFSMHRITSRSGLLGRCYSSAVKGGTSIAGVCDIIAVASGKGGVGKSTTAVNIAVALAKEFKLQVGLLDADIYGPSIPTMMNLHAKPELSEDMKMIPIENHGVRCMSIGFLVDKDAPIVWRGPMVMSALEKMTRGVAWGDLDILVVDMPPGTGDAQLSMSQRLRLSGALIVSTPQDIALIDARRGANMFRKVQVPILGLVENMSCFKCSKCGEKSYIFGEAGAQRTAEEMDMKLLGDVPLEISIRTGSDEGNPIVVSSPNSASAQAYVNVAEKVTQRLKELAEERRMGPEILL

SEQ ID NO: 11058 - DNA, 893 bp, Zea mays
  misc_feature: Ceres CLONE 1352249-F
  misc_feature: Encodes the peptide sequence at SEQ ID NO. 11059
  misc_feature (581)..(581): n is a, c, t, g, unknown, or other
  misc_feature (722)..(722): n is a, c, t, g, unknown, or other
  misc_feature (723)..(723): n is a, c, t, g, unknown, or other
  misc_feature (725)..(725): n is a, c, t, g, unknown, or other
  misc_feature (757)..(757): n is a, c, t, g, unknown, or other
  misc_feature (794)..(794): n is a, c, t, g, unknown, or other
tccccgcggtggcggccgctctataactagtggatcccccgggctgcaggaattcggcaccagagaaacaaactgaggctgatggcagtggtgctacagaattggaaaaagaaaaagaagaaagtcgcccaaagaacgtcaagcccaacaaggaagaagatgataaaatgagggcgaatgctgcaaacgtcgctgcccggcaagcagttggaggaagtgatatgctctcaaagtggcagttgatggctgagcaagccagacagaagcgagaaggcattgatgtgtctgctgcttcacagccaggcagagggccaggttccaggcaattatccaaatttgggaaaggtcctggtgagcacccagaaggttcaaagaggagccattcgatggcattcggaactggaggcatgaaaagacccggcaggacagcgtttgctggtccacagcgattgatctccgtgaaggatgtcatttgtgcccttgagagggagcctcagatgacaaaatcaaggctaatctaccggctgcacgagcgattgcctgtagattctaccgtagattagaccggaatagtcatatanctttattgtgggcatgcccaattgccccttgcatggtattgaacagcgaagaagcatacccgccctccccatttgttgtgctttggagcgcacttggtatattgggtgtaaaatttgtatcgcaaaggcggcgaatacagnncnaaaaaagggtttctgtacaatcacttgttaanccgggggtctggcatttgccttttctgcacaaccggntgtgggaaggtaatttctaaaaaaaaaaaaaaaaaaaaaaaaaactccgcggggggggggccccggtacccattcgccccccatataggggtccgaata

SEQ ID NO: 11059 - protein, 131 aa, Zea mays
  misc_feature: Ceres CLONE 1352249-F
MRANAANVAARQAVGGSDMLSKWQLMAEQARQKREGIDVSAASQPGRGPGSRQLSKFGKGPGEHPEGSKRSHSMAFGTGGMKRPGRTAFAGPQRLISVKDVICALEREPQMTKSRLIYRLHERLPVDSTVD

SEQ ID NO: 11060 - DNA, 848 bp, Zea mays
  misc_feature: Ceres CLONE 1352252-F
  misc_feature: Encodes the peptide sequence at SEQ ID NO. 11061
  misc_feature (695)..(695): n is a, c, t, g, unknown, or other
  misc_feature (737)..(737): n is a, c, t, g, unknown, or other
  misc_feature (747)..(747): n is a, c, t, g, unknown, or other
ccccgcggtggcggccgctctagaactagtggatcccccgggctgcaggcccccacgaaccactcctcctacgaatcacctgccggcctggcctttccgtagctacaaccgaagccaccaccagcagtccagcacgactagcggaataatatccaccggcgacgggaacgggaggcggcgcggccggagattcgaagcgatggcgttcacgatgcgggcagtgaaggtgcctccgaactcggcctcgctggaggaggcccggcaccgcgtcttcgatttcttcaagcaggcatgccgctctatccccaccgtcatggagatctacaacctcgacgacgttgtcacgccctctcagctccgctcgaccatcgctaaggagatccgtaaaaaccagaacgtcaccaaccccaaggtgattgatatgcttctgttcaacgcgacggaggagctgaacaacatagtcgaacatgcaaagcagcgccatcatgtgattgggcagtatgtgatcggccaagagggcctggtgcacgagcttggggtcgaaggatctagggaactctgactttctgaagaaattctaccaagcaattacttctgatcctgtgttgcagatttacaacatctggataccttccgggtggtgctctgaataagacgacactgaggacctatcaggaccgattgttccccatggnaaggttttgatctatttggctctttgatcctctgttcatggngtactgctgncagctggttggcttggttaactgtttggactatcaaatggatgttgactgtttagtccgattcgagtaatcgaggctacaagattgaaactttgttgcaaa

SEQ ID NO: 11061 - protein, 120 aa, Zea mays
  misc_feature: Ceres CLONE 1352252-F
  misc_feature (19)..(89): Pfam Name: Complex1_LYR Pfam Description: Complex 1 protein (LYR family)
MAFTMRAVKVPPNSASLEEARHRVFDFFKQACRSIPTVMEIYNLDDVVTPSQLRSTIAKEIRKNQNVTNPKVIDMLLFNATEELNNIVEHAKQRHHVIGQYVIGQEGLVHELGVEGSREL

SEQ ID NO: 11062 - DNA, 924 bp, Zea mays
  misc_feature: Ceres CLONE 1352254-F
  misc_feature: Pfam Name: Spt4 Pfam Description: Transcription elongation protein Spt4
tggagctccccgcggtggcggccgctcttcaactagtggatcccccgggctgcaggaattcccccccccccatgttcctaaagcgacccactaggactacgatcttcgcgggcaagatggccacttcggtgcagagagagccaccagagagagagactcagatagagagagatggacgcagggaccacacgcggatccgatatcatgaggagccgcgccggcgacggcatgaagctcgatgaatagagggaggaccatgcactcaccccccgcagtttcgatcccgaggtgcgcgcctgcctccgacgcggaccccaccagacctacgaccacctcagggagaatggatgagaacactgcccatttctaaagatgtacacagagcaccgataggagcgtcaactgcacctccccccgcttctgggtaattatctctctggcggaccccatggatgagctggctcacccctatgtgggagagatcgaatgcgtcatccctggggtgctatacacgtagctgtatccggagcgagcttccaagaatgactatcaaagggcattctgctccagacaacagtcgttggaaaatcgccgccgccccaagcggcgatctagggtagtcaaccccggccaatcggcggcgcgttctcgcccgctctgctcaaggcaaacccgccttcccctttgatgcttttgccctccggaaagcctaatgtgcagccatatctcccaggcttagcgtaaaaaggccaacccgcattttaggccggttacacccgggtggaagtaatcgaactccccccagaaaatccatcgccgccttgctccttcgtcaacaatttcccctccttatttgcccgcacttgacctaacccacgcaattttgccctcttgacatatttaaccacataaatacacttgttg

SEQ ID NO: 11063 - DNA, 848 bp, Zea mays
  misc_feature: Ceres CLONE 1352260-F
  misc_feature: Encodes the peptide sequence at SEQ ID NO. 11064
  misc_feature (359)..(359): n is a, c, t, g, unknown, or other
  misc_feature (435)..(435): n is a, c, t, g, unknown, or other
  misc_feature (452)..(452): n is a, c, t, g, unknown, or other
  misc_feature (492)..(492): n is a, c, t, g, unknown, or other
  misc_feature (516)..(516): n is a, c, t, g, unknown, or other
  misc_feature (529)..(529): n is a, c, t, g, unknown, or other
  misc_feature (530)..(530): n is a, c, t, g, unknown, or other
  misc_feature (588)..(588): n is a, c, t, g, unknown, or other
  misc_feature (594)..(594): n is a, c, t, g, unknown, or other
  misc_feature (613)..(613): n is a, c, t, g, unknown, or other
cgcggtggcggccgctctagaactagtggatcccccgggctgcaggaattcggcaccaggccaaaacgcagaagctgcactgcatacatcgagctaactatctgcagcgatgtctcgctcctgctgcgtcgccgtgtcggtgcttctcgctgtcgccgcgacagccagcgccaccgcgccggcatggctgcacgaggaggccatggccacgggcccgctggtcgcagagggtgcaagggtggcgccctccgcgtccacctgggctgccgacaaggcgtcgccggcgaggccgagcggcggcatggccacgcagggcgacgaccagagctcgtcgggcggcagtggcagcagcggtgagncacggcaaggaggagggcgagaagcagggcaagagctgcctcaccaaggaggagtgccacaagaaagaagatgatnctgcggcaagggctgcnacgctctcggcgcacagcaagtgcgccgccaagtgcaccnaaagtcctgtgtccccacctgctnaagagccgagggnncggagcttgccggcggcgagacctcgaatcgatcgagtgcttcacttcacttctttgntatagntccttgggggggtggccgntgcgttgcgttgcgtagacgaagggaaataaggaaggggtaattggattacctgttccagatctctgtggaaagcgtgttgccgtgacaagtcatttgatccaaagcgagcgatggatagatcgcggtcgcagtttttaccaccaaatacccaaaaaaacaaaaaacttcgagggggttgtccgggaccccattcgccctataggggagccgtaattacatttactggccctttg

SEQ ID NO: 11064 - protein, 107 aa, Zea mays
  misc_feature: Ceres CLONE 1352260-F
  misc_feature (84)..(84): Xaa is any aa, unknown, or other
MSRSCCVAVSVLLAVAATASATAPAWLHEEAMATGPLVAEGARVAPSASTWAADKASPARPSGGMATQGDDQSSSGGSGSSGEXRQGGGREAGQELPHQGGVPQERR

SEQ ID NO: 11065 - DNA, 877 bp, Zea mays
  misc_feature: Ceres CLONE 1352269-F
  misc_feature: Encodes the peptide sequence at SEQ ID NO. 11066
  misc_feature (501)..(501): n is a, c, t, g, unknown, or other
  misc_feature (544)..(544): n is a, c, t, g, unknown, or other
  misc_feature (606)..(606): n is a, c, t, g, unknown, or other
  misc_feature (608)..(608): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (693)..(693): n is a, c, t, g, unknown, or other
ggagctccccgcggtggcggccgctctagaactagtggatcccccgggctgcagggagagagctcactagtcccccccccccgctgccacgcgccgccatccctaagacctatccattcgcctagtcaactagggctcgtctggaatggtgaatttgcggggaggaagaacagaaattggccgccgatgtagattccgcacgcgcgtcgtcaccttggcagtagattcctcccgccgcggcctcggtgtgctcctcttcgtggcgctcctccttctgctgcgctggtcgtctccgggtaccgtctggacacgcaccaccgctatagcgccgccatggaaactgcagcctgtcgtggtcggccttctcgacgtccatgtcgcagacgagcaagccactgtggaaactgaggttcaacaagtagaagtagctgagcaggagctcattgaaggagacgaacaggtggtcaaagaggagtcgcctaacattgaggcattcgatcntgatctaggtggcgtttctcagttgacattggcgccgacgatnccttagttcgtttttatggttattccctttattttgtaataagacttccgctatgtaatagntnactttgatgttattgacatttatctctnnnnnnngannnnnnnnnnnnnnnnnnnnnnnnnnnnnnnccnnnnaaaaaaaaaaanttccgaggggggggcccggtacccattccccctaataggagtcgattacaatccctgggccgcgtttttcaaggtcgggactggaaaaaccctggcgttaccaacttatcgcctggagcaatcccctttcgcagtggggaaaaataagaaaaggcccgaacgatccccttccaaagtgggcagc

SEQ ID NO: 11066 - protein, 134 aa, Zea mays
  misc_feature: Ceres CLONE 1352269-F
  misc_feature (119)..(119): Xaa is any aa, unknown, or other
  misc_feature (133)..(133): Xaa is any aa, unknown, or other
MVNLRGGRTEIGRRCRFRTRVVTLAVDSSRRGLGVLLFVALLLLLRWSSPGTVWTRTTAIAPPWKLQPVVVGLLDVHVADEQATVETEVQQVEVAEQELIEGDEQVVKEESPNIEAFDXDLGGVSQLTLAPTXP

SEQ ID NO: 11067 - DNA, 872 bp, Zea mays
  misc_feature: Ceres CLONE 1352269-R
  misc_feature (13)..(13): n is a, c, t, g, unknown, or other
gggtgtgtcaatncatctaagtacttattacattgcggaagtcttattacagaataaaggaataaccataaaacgaactaaggatcgtcggcgccaatgtcaactgagaaacgccacctagatcagatcgaatgcctcaatgttaggcgactcctctttgaccacctgttcgtctccttcaatgagctcctgctcagctacttctacttgttgaacctcagtttccacagtggcttgctcgtctgcgacatggacgtcgagaaggccgaccacgacaggctgcagtttccatggcggcgctatagcggtggtgcgtgtccagacggtacccggagacgaccagcgcagcaaaaggaggagcgccacgaagaggagcacaccgaggccgcggcgggacgaatctactgccaaggtgacgacgcgcgtgcgggaatctacatcgggcggccaattttctgttcttcctccccccgaaattcacccttccagaccaggccctagttgactaggcgaaatggataggtctttagggatggcggcgcgctggcagcgggggggggggggggaactaaaggaacctcccctcccccgcaggcccggggggggaatcccccatagttttttgaaacctggcccgtcccccccgcgggcgggagaccccccactttttttgttccccttgtttattgaggggggtcaacttgccgaaactttggggggtaatcatgggtggcataaacgcggtttcctcctcggtcaacaaggggtaaccccgccctcccgatattcctccccttatctcatgtctatatccccgaaaagactaaatgacgggtgaatcgccccggggctggcctcatttattaaatagt

SEQ ID NO: 11068 - DNA, 883 bp, Zea mays
  misc_feature: Ceres CLONE 1352308-F
  misc_feature: Encodes the peptide sequence at SEQ ID NO. 11069
ggccgctctagaactagtggatcccccgggctgcagggagagagagagagagagagagctcactagtcccccccccccccccccggattgaggccaggggcttcgtgttcggcccggcgatcgcgctggctattggcgccaagttcatacctctgcggaagccaaggaagctcccaggtgaggtgatctccgagaagtacgttctcgagtacgggactgattgcctggagatgcgtgtcggggccatcgagcgatccggcgagcgggtgctggtcatcgacgacctggttgcgaccggagggacactctgtgctgcgatcaggcttctagaacgtgctggagccgatgtggtcgagtgcgcgtgtgtcattgggctcccgaaattcaaggtgtcagagtgatcagggatattggctgtttactccttgctactgcgattgaacagtggagggacgacatggacaaggacaagtatattcggtgcatcactaagtcttggtgaggggagagattgtagtgttttaggctgagtagtgaagagcctgtagttctgcacggaacatgcatgatggttattagttgaaaaaaaaaaaaaaaaactcgagggggggcccggtacccatttcgccctatagtgagtcgtattacaattcactggccgtcgttttacaacgtcgtgactgggaaacccctggcggtacaaactttatccgcttgcagcacatccccctttcggcagctggggttatacgaaagaggcccgcacgatcgccttccccacagttgcgcagcctgaatccgaatggcaaattgtagcgttattattttgttaaattccgttaatttttgtaaatcagctatttttaaccaatagccgaaaccg

SEQ ID NO: 11069 - protein, 56 aa, Zea mays
  misc_feature: Ceres CLONE 1352308-F
  misc_feature: SWISSPROT Homolog: EC 2.4.2.7 Adenine phosphoribosyltransferase
MRVGAIERSGERVLVIDDLVATGGTLCAAIRLLERAGADVVECACVIGLPKFKVSE

SEQ ID NO: 11070 - DNA, 903 bp, Zea mays
  misc_feature: Ceres CLONE 1352313-F
  misc_feature: Encodes the peptide sequence at SEQ ID NO. 11071
acccgcggtggcggccgctctagaactagtggatcccccgggctgcaggccccccccccccccccgaagcccgaggagggcggcgcccacatcacaccttaaggtcaagggacaggatggcaatgaggtgttctttcccataagaggtccacccatgtgaaaaaggtgatgaacgcttattgtgaccgccagtctgtggacatgaatgccgttgcgttcctgtttgatggccgcaggcttcgcgaacgagcaaacccctgatgaactgaagatggaggacggagacgagatcgacgccatgcttcaccagaccggaggcagcgttcctagcaccacctaaaagcctcgttttgctctcgcgtcctgcgtataactaaacaagagggaaaaagtcttgttaaggaacttgtgatgctctgggtccttgtgccattgctgagggacatccttaacctttgataagtacgatgggatggcactttgctctgtcatcactcgctgatcgatccctgatacatggcgccatgattgatctcccaatgacgcgcagatcatttgctctaaataagatcataaaatactcgagggggcgcaccggtacccaattcgtcctatagcgagtcatattaccgttctctggccgactgtttactacgtcttgactgggagaaccctgtcgttgaccatgttactcgacgtgaaggacatcaccccttcgcagatggcgatagtacgataagtgcccatcgatcgaccctaccattatgtgcgcaagctggcatgagaatgtaaatctgaacccgatagtattcgccgaaattcagcttgacttttagtacatcagatcatttttaaacagtaagccgaaatcgaaagatccgtataatcaaataataaacggaa

SEQ ID NO: 11071 - protein, 30 aa, Zea mays
  misc_feature: Ceres CLONE 1352313-F
MNAYCDRQSVDMNAVAFLFDGRRLRERANP

SEQ ID NO: 11072 - DNA, 895 bp, Zea mays
  misc_feature: Ceres CLONE 1352324-F
  misc_feature: Encodes the peptide sequence at SEQ ID NO. 11073
tccccgcggtggcggccgctctagaactagtggatcccccgggctgcaggaattcggcacgagcccccccccccccccctagctccggcgcacacaaccacacacctgtttaattctgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgttcctgtaatcctgtactcgcttcgttttctctgcatgcgtctataattgtgttcaataataagtgagagcggtgtgatgtgtggctccaaaaaagataaaaaagaagaaaaccaaaaatcaaaattaaataatctcgagggggggcccgggacccaattcgccctatagggagtcgtattacaattcactggccgtctttttacaacgtcgtgactggaaaaaccctggcgttacccaacttaatcgccttgcagcacatccccctttcgccagttggcgtaataggaaagaggcccgcaccgatcgcccttcccaacagttgcgcaccctgaatggcgaatggcaaattgtaagcgttaatattttgtaaaaattcgcgctaaatttttgttaaatcagctcattttttaaccaataggccgaaatcggcaaaatcctttataaatcaaaagatacaccgagataggtttgagtgtttgtccagtttgaaacaggagtccactattaaagaacgtggactccaacgtcaaggggcgaaaaacggtctatcagggcgatggcccactacgtgaaccatcaccctaatcaagttttttggggtcgaggtgccgtaagcctaattcgtaaccttaagg

SEQ ID NO: 11073 - protein, 37 aa, Zea mays
  misc_feature: Ceres CLONE 1352324-F
MSPSPDLGSCLLVVSESVRLREKRWWAWGYVERGVFL

SEQ ID NO: 11074 - DNA, 789 bp, Zea mays
  misc_feature: Ceres CLONE 1352343-F
  misc_feature: Encodes the peptide sequence at SEQ ID NO. 11075
  misc_feature (506)..(506): n is a, c, t, g, unknown, or other
  misc_feature (507)..(507): n is a, c, t, g, unknown, or other
ttgtggatcccccgggctgcaggcccccccccccccccggcaaagtcctaatcagcgactactgtaagaatcctggaaaaccatcagaagaatttgctgcgtacattaagcagagaggctatgaccttcacgacgtgaaggcttatggacagatgctgaaggatgctggttttcataatgtcatcgcggaagatcgcactgagcagttcttgaatgttctacagagggagctaggtgaagttgaaaagaacaaagacgctttcctggcagacttcacccaggaggactatgacgacattgtgaatggctggaacgcgaagctgaaacggagctctgccggcgagcagaggtgggggttgttcattgccaccaagtgatttggcctggcagcaggagggctcttcggaataagaatggatgtggctgtaactctgcttctagaccggtgatggttcagcttaaaagcaggggatcttcatcatcagaataaaaacggggggctgtgnngtgctgtgtctacgccactagaatttctggtgtttactatggtcctaggaactgcgcatccgagcaaagtgaaaaaaatgactgctgcccgccctggggggggtggggccaccaacaaaatttcacttttgtggaaggaaacggcgaccccagagttgaaacccggatttgccgtttaacccctggggaacaacgacaaaaaggtttttgccagagccaaaaaaaaaaaaaaaaaaaaaaaacctggggggggggcccggaaccaattcccccaaaaggggg

SEQ ID NO: 11075 - protein, 124 aa, Zea mays
  misc_feature: Ceres CLONE 1352343-F
  misc_feature: SWISSPROT Homolog: EC 2.1.1.103 Phosphoethanolamine N-methyltransferase
  misc_feature: The sequence is a functional homolog of SEQ ID NO 40 in US patent 7151202
VDPPGCRPPPPPGKVLISDYCKNPGKPSEEFAAYIKQRGYDLHDVKAYGQMLKDAGFHNVIAEDRTEQFLNVLQRELGEVEKNKDAFLADFTQEDYDDIVNGWNAKLKRSSAGEQRWGLFIATK

SEQ ID NO: 11076 - DNA, 768 bp, Zea mays
  misc_feature: Ceres CLONE 1352344-F
  misc_feature: Translation starting site: 207
  misc_feature: SWISSPROT Homolog: EC 3.2.1.23 Beta-galactosidase
  misc_feature (663)..(663): n is a, c, t, g, unknown, or other
  misc_feature (736)..(736): n is a, c, t, g, unknown, or other
gctctagaactagtggatcccccgggctgcaggaattcggcaccagccccccccccgcttctcatggatgattgctgcttgtgtatgccgagaataaatgtggatggcgcgtgcctctggatgcgccaggctcatgctgagactggacatgttttgcacttttgcttcccttcctgctaccatctgtgacagaaccgctcgctaatatggtaccaaaaaaaaaaaaaaaaaaactccaggggggtgcccggaacccaattcgccctatagggagccgaattacaattcactggccgtcgttttacaacgacatgactggaaaaaccctgtagttacccaacttaatcgccttgcagcacatccccctttcgccagctggcgtaatagcgaagaggtccgtaccgatcgcccttcccaacagatgagcagcctgaatggcgaatgccaaattgtaagcgttaatattttgttaaaattcgcgttaaatttttgttaaatcagctcattttttaaccaataggccgaaatcggcaaaatcccttataaatctcaagaatagaccgacgataggactgagttgtcgttccagtttgtgaacaagagtccgctatctacagaacgtgcactccgacgtccaaggcagaaaagccgtctattaacgtncgatggcccactacgtgcacctgacccctataaacgttttcttggggagtcgaaggtgccgtgaaagcactangtcggcagcctacacggaagaccgcgcattaa

SEQ ID NO: 11077 - DNA, 768 bp, Zea mays
  misc_feature: Ceres CLONE 1352348-F
  misc_feature: SWISSPROT Homolog: EC 3.2.1.23 Beta-galactosidase
  misc_feature (763)..(763): n is a, c, t, g, unknown, or other
ggatcccccgggctgcaggcccccccccccccccccccacatcaccgactcggatgtcatcggcgcgttcctcgccggcaccacttgccgcaacctggtgcgcaagctgggtcgcaaaacccccaccagggcgagcgagctgatggacatcgccaccaagttcgcctccggccaggaggcggtcgaggctatctttcgaaaggacaagcagccccagggccgcccgtcggaagaagctcccgagacgtctgctccgcgcggcgccaagaagaaaggcaagaagaagtcgcaatcgaaacgcgacgccgcagacgcggaccttgtcgccgccgccgagtataagaaccctcggaagccccccggaggtgcaaacctcttcgacaagatgctcaaggagccgtgcccctaccatcaggggcccgtcaggcacaccctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagatagaccggnaatag

SEQ ID NO: 11078 - DNA, 942 bp, Zea mays
  misc_feature: Ceres CLONE 1352360
  misc_feature: Encodes the peptide sequence at SEQ ID NO. 11079
gtgccccatttgttaggggtcggctagtggcccggaggcgcgctccaaaagtacctgcgggtgatttgccagacccggtccccttttgacggggtccgagggctcgatgcctccctctgatgggattccgttacaaaaatcgttcccgttggtctcggaaatgtcctagggtacctcgggagcgtagcccgagccttggttatgtatcgaacgtacccagggtcatccctcgctctgcgtctgaggcggctgtcgaaccctttcgagggccagcctacgaacccctgatcagtagtgggcgcggagcccgagtggcctgaggcggccgttgaacccttccgaggggccggcctttgaacctctgaccagtagtgggcgcggagcccgagtgctctgaggcggctgttgaacccctccgaggggccagccttcgaacctctgatcagtagggggctcggggcccgtttccttcgcggagaaggatccctttcggggtatcccctttcctggtccctgttgtaagagagagaaagaggaaaaggaaaaggatacaaaatcgaatgacgtggcgcaccttttttgacgcggtcattatggcggaagcgaagcgtcgcctgcttcgcccgccaaaggtgtcgcctgtcctaccgtagagttaatgcgacgggacgagtggttcgcggggcagctgttgcgcgtgcgcgagccgttcgaggaacggaacacgggcgcgtcgtcttcacgccgtgggagagggttctctcgctaccccaggaggggacgtgagcttggctgacgacttgaccgctgcttccgcctgcctgccaccgccattactgtcggcccatttctggccgtatcgaccgtcacgccttctcccgcggctgactgacctgtgaccgatgtgcttggttggcactgttgggtcctgcgcagggttgc

SEQ ID NO: 11079 - protein, 66 aa, Zea mays
  misc_feature: Ceres CLONE 1352360
MGFRYKNRSRWSRKCPRVPRERSPSLGYVSNVPRVIPRSASEAAVEPFRGPAYEPLISSGRGARVA

SEQ ID NO: 11080 - DNA, 905 bp, Zea mays
  misc_feature: Ceres CLONE 1352383-F
  misc_feature (169)..(169): n is a, c, t, g, unknown, or other
  misc_feature (179)..(179): n is a, c, t, g, unknown, or other
  misc_feature (180)..(180): n is a, c, t, g, unknown, or other
  misc_feature (227)..(227): n is a, c, t, g, unknown, or other
  misc_feature (228)..(228): n is a, c, t, g, unknown, or other
  misc_feature (242)..(242): n is a, c, t, g, unknown, or other
  misc_feature (243)..(243): n is a, c, t, g, unknown, or other
  misc_feature (309)..(309): n is a, c, t, g, unknown, or other
  misc_feature (317)..(317): n is a, c, t, g, unknown, or other
  misc_feature (318)..(318): n is a, c, t, g, unknown, or other
  misc_feature (330)..(330): n is a, c, t, g, unknown, or other
  misc_feature (332)..(332): n is a, c, t, g, unknown, or other
  misc_feature (333)..(333): n is a, c, t, g, unknown, or other
  misc_feature (351)..(351): n is a, c, t, g, unknown, or other
  misc_feature (352)..(352): n is a, c, t, g, unknown, or other
  misc_feature (391)..(391): n is a, c, t, g, unknown, or other
  misc_feature (392)..(392): n is a, c, t, g, unknown, or other
  misc_feature (420)..(420): n is a, c, t, g, unknown, or other
  misc_feature (421)..(421): n is a, c, t, g, unknown, or other
  misc_feature (445)..(445): n is a, c, t, g, unknown, or other
  misc_feature (448)..(448): n is a, c, t, g, unknown, or other
  misc_feature (456)..(456): n is a, c, t, g, unknown, or other
  misc_feature (457)..(457): n is a, c, t, g, unknown, or other
  misc_feature (555)..(555): n is a, c, t, g, unknown, or other
  misc_feature (556)..(556): n is a, c, t, g, unknown, or other
  misc_feature (625)..(625): n is a, c, t, g, unknown, or other
  misc_feature (665)..(665): n is a, c, t, g, unknown, or other
  misc_feature (691)..(691): n is a, c, t, g, unknown, or other
  misc_feature (756)..(756): n is a, c, t, g, unknown, or other
cgggggcggcgctctagactagtggatcccccgggctgcaggcccccccccccccccccggctgaagcgcgtggagcagcagctgggagatggagcgcgagaatgcggcggcgcgaggtggtgggaggagttcgaaggccaagatggcgcaccatggcggctgggagcnaggcggccgnnccgcggagcgcgtgggagcggggaccacccggggagaaaggtgggcnncgagctcccgccgnncgacgcgccagggtcaaggggaggagaaagatggggcccgagcagtgggggccggccaaaggcaancgcgcgcnnggtcgccaaagntnntcgtcgaagcagaatggnnggggggtgggctcccgtttcatgggggtcctctggccannccgacatgggaactggtttgaactgggnnacaaacgagccggctggaccacanccncgtcgctnnagctatcgcggtggctacgtggctcccggtttcacgggctttttcttggcattctgggggacgcgacttggtaaacgcccatgggattccccttggcnntcacgttcacttccccgctttctttttttttccttttcctttttaatttacaaactggttgtttacggntcgggttcaatggcttctccctctctatctactaagtagntggatcagaagtcaagaaaatgtaantggctgcccgttactgggtcgtagttttcatcctctccctaaaacttgcggttcctggtctcttnctttgaaaaaaaaaaaaaaaaaaaaactccgagggggggggccccgggtaccccaaattcgcccctaataggggaggtcgtatttacaattcaccgtgggccggtcgtttttaacaaacggccgggggacttgggaaaaaaaccctggc

SEQ ID NO: 11081 - DNA, 914 bp, Zea mays
  misc_feature: Ceres CLONE 1352431-F
  misc_feature: Encodes the peptide sequence at SEQ ID NO. 11082
  misc_feature (783)..(783): n is a, c, t, g, unknown, or other
  misc_feature (784)..(784): n is a, c, t, g, unknown, or other
  misc_feature (816)..(816): n is a, c, t, g, unknown, or other
  misc_feature (870)..(870): n is a, c, t, g, unknown, or other
  misc_feature (871)..(871): n is a, c, t, g, unknown, or other
  misc_feature (885)..(885): n is a, c, t, g, unknown, or other
ccccgcggtggcggccgctctatactagtggatcccccgggctgcaggaattcggcaccagagtcccccccccccccgccccccttcccaaaccctcttcttccccctcacgtgctcgacccagatcgagggctcgatccgtcggccatggcgctggagtgggtggttctgggctacgcggcgggcgcggaggcgatcatgctgctgctgctgacgctgccggggctcgacggcctgcgccggggcatgatctccgtggtgcggagcgcgctgaagcccatgatgtcggtagtgcccttctgcctcttcctgctcatggacatctactggaagtacgagacgcgccccacctgcgacgacgagcacgcctgcaccccctccgagcacctccgccaccagaagtccatcatgaagtcgcagcggaacgcgctcctcatcgccgccgcgctgctcctctactggatcctcttctccgtcacccagctcgtcgtcaggctcgagcagatgcagcagcgcgtcgacaagctcaggaagcgcgacgactgatggatccgcatccatccggtgggctcgttcttcctctgcctgccttgtgttcctgctttatgttgtggtgctgatgttttagatctcggatcgtaatttgagacctgctggtagcatttgcttcctttgccttgccgtcttcagataaaaaagacagcgctcttggaaacgatgataatgtttaggatggttggacgaatggtatctgtcgtaattgatgtcttcatcatgaatggnntggtggtcactcatgtacactgagatattggntaatagctactaggggctggtttatcatgtgattatgccgatgctgtaatgagnntagtcttgttcgtnatagatgacattattagaggccggatttt

SEQ ID NO: 11082 - protein, 132 aa, Zea mays; identical to SEQ ID NO: 10924
  misc_feature: Ceres CLONE 1352431-F

SEQ ID NO: 11083 - DNA, 881 bp, Zea mays
  misc_feature: Ceres CLONE 1352435-F
  misc_feature: Encodes the peptide sequence at SEQ ID NO. 11084
  misc_feature (828)..(828): n is a, c, t, g, unknown, or other
  misc_feature (829)..(829): n is a, c, t, g, unknown, or other
  misc_feature (842)..(842): n is a, c, t, g, unknown, or other
  misc_feature (854)..(854): n is a, c, t, g, unknown, or other
  misc_feature (874)..(874): n is a, c, t, g, unknown, or other
  misc_feature (875)..(875): n is a, c, t, g, unknown, or other
ccccgcggtggcggccgctctatacctagtggatcccccgggctgcaggcccccccccccccccccaaaagatcgaagaaacaggagaccagaatctacttgccgacaacatggagatgctggcctctgcagtgtaccttcaagtgagcaccattagccaggcgttgatatttgtgacgaggtcgaggggttggtccttcatggagaggcctggcctgctgctgatggccgcattcgtgatagctcagctgatcgcgtctgtgcttgctgccatggtgagctgggagcttgctggcatcaaaggcatcgggtggcgttggaccggcgtgatctggctgtacaacttggttgtgtacctgctgctggacccgatcaagttcgcggtgcggtacgggctgagcggcaaggcctggaacctggtgatcgaccacaaggtggccttcacgaaccgcaaggactttgggaaggaggcccgggaggcggcatgggcgcacgagcagcgcacactgcatgggctggagagcgccgggacccctggggagaaagcggcgtcggtggagctggggcagatggcggaggacgcccggcggcgcgcggagatcgccaggctgcgggagctgcacaccctcaagggcaaggtggaatcggtggtgaagctcaaagggctggacctggaggacatcaacaaccagcactacacggtgtaaccgccgtgattgattcggcatagcctccttatcttagagagagggatataaagtaataattggatggcataaccatctgattggttgccccccactattttgtcctaactatcacatgcgnntgatttatctaancttctggttggntcaaaaaaaaaaaaaaaaannaaaaaa

SEQ ID NO: 11084 - protein, 198 aa, Zea mays
  misc_feature: Ceres CLONE 1352435-F
  misc_feature: SWISSPROT Homolog: EC 3.6.3.6 Proton-exporting ATPase
MEMLASAVYLQVSTISQALIFVTRSRGWSFMERPGLLLMAAFVIAQLIASVLAAMVSWELAGIKGIGWRWTGVIWLYNLVVYLLLDPIKFAVRYGLSGKAWNLVIDHKVAFTNRKDFGKEAREAAWAHEQRTLHGLESAGTPGEKAASVELGQMAEDARRRAEIARLRELHTLKGKVESVVKLKGLDLEDINNQHYTV

SEQ ID NO: 11085 - DNA, 903 bp, Zea mays
  misc_feature: Ceres CLONE 1352437-F
  misc_feature: Encodes the peptide sequence at SEQ ID NO. 11086
  misc_feature (777)..(777): n is a, c, t, g, unknown, or other
  misc_feature (783)..(783): n is a, c, t, g, unknown, or other
  misc_feature (791)..(791): n is a, c, t, g, unknown, or other
  misc_feature (792)..(792): n is a, c, t, g, unknown, or other
  misc_feature (800)..(800): n is a, c, t, g, unknown, or other
  misc_feature (844)..(844): n is a, c, t, g, unknown, or other
  misc_feature (845)..(845): n is a, c, t, g, unknown, or other
  misc_feature (885)..(885): n is a, c, t, g, unknown, or other
cgcggtggcgggccgctctagaactagtggatcccccgggctgcaggcccccccccccccccccgagctggcggcgtcgttcagcgatgtccttgtcacaccgcgcgagccgccagaaccccaagccaagagcttcctaccatcgccctccttctttactaagtttgccagggagacaggagacacccaaacgctttcagatgttgatataaatattattgctttggcttacatgttagaagctgagatccatgggactagccatttgcgagagcaccctcctcctctgaaaattctcgaatacttcctctgaagaatattgagagtcaagatatcttcatgtgtgataccaacagtctttgtggggcacaagaggatatagagctctagccatcaaagaaggatgcacctgttgcatgggaggacgatgagaacgatgtaggttggatgcatgctattagccatagcatgcacagaagatatttgcagaggaaggcaaggcgtgatgccctcaaggaatctggacaaagttttgagacaagttctgttgttccatcaattgatgatgataaagttctctctgaaaatagtggattggagcatggtctgacttcaactgatggcctttcttctgtctctgagaaaattagtgcacgttctgatgattttgaacatcaagcagagaatgacactgaaattcctggagaacatttgcattctgatcagcgagcttacggtgatgatgctgatgcgtgcaccaaagaattggaaacttanatatanaagtgggnnattgaggnaggtggtgatgcacatttcattggtgatgaagcaacgagcaagnnttggaccctggagtccttatctgaatcgagcatcccacgntattcctatggcaaagaa

SEQ ID NO: 11086 - protein, 152 aa, Zea mays
  misc_feature: Ceres CLONE 1352437-F
  misc_feature (110)..(110): Xaa is any aa, unknown, or other
  misc_feature (112)..(112): Xaa is any aa, unknown, or other
  misc_feature (115)..(115): Xaa is any aa, unknown, or other
  misc_feature (118)..(118): Xaa is any aa, unknown, or other
  misc_feature (133)..(133): Xaa is any aa, unknown, or other
MHAISHSMHRRYLQRKARRDALKESGQSFETSSVVPSIDDDKVLSENSGLEHGLTSTDGLSSVSEKISARSDDFEHQAENDTEIPGEHLHSDQRAYGDDADACTKELETXIXKWXIEXGGDAHFIGDEATSKXWTLESLSESSIPRYSYGKE

SEQ ID NO: 11087 - DNA, 876 bp, Zea mays
  misc_feature: Ceres CLONE 1352467-F
  misc_feature: Encodes the peptide sequence at SEQ ID NO. 11088
  misc_feature (406)..(406): n is a, c, t, g, unknown, or other
  misc_feature (827)..(827): n is a, c, t, g, unknown, or other
  misc_feature (857)..(857): n is a, c, t, g, unknown, or other
ggcgcgcgctctagaactagtggatcccccggtgtgcagggagagagagagagagagagctcactagtcccccccccccccacccacaaaaatgcacaactattcaaatgcgaccctgcgggtcagcttctttggacataaggcaactagtgccgggctcaaggagcaggaagcaataaattttttggagaagaaaatgaaggatgacccgaaattcacctatgatgaaactgttcagattgcaatatctgcattgcaatcagttctccaggaagatttcaaggccactgagatcgaagttggtgttgtgagaaaagaagaacgtcttttcagagttctcacaacagaggagattgaccagcacctgacggcaattagtgaacgggactgagctgccatatgttgnacatttgatccctccacactgcgccgtgccattgtgcttcagcactgccatttagtttgacatcaaatgaactgagtgtaccatttcatgtctaacactgaaaacaagctcgttgattgaatttggcacagtttggttttgcattgctaactatatttgcagggctgagcgattggtagttcatttcaccaatacgcgtaaccatttttaacggtgtttgttgtaaagttgccataagatttagctccacctacccatagttaagattgggagcaagaatagcaaaaaaaaaaaaaaaaaaactccggggggggccccgggcccaattccccctatagggaggcggatacaattccctggccggcgttttacaacgcgggactgggaaacacctgggggtacccaatttatccccttgaangacatccccctttccccagtgtgggaatancgaaagagccccacgatcg

SEQ ID NO: 11088 - protein, 99 aa, Zea mays
  misc_feature: Ceres CLONE 1352467-F
  misc_feature: SWISSPROT Homolog: EC 3.4.25.1 Proteasome endopeptidase complex
MHNYSNATLRVSFFGHKATSAGLKEQEAINFLEKKMKDDPKFTYDETVQIAISALQSVLQEDFKATEIEVGVVRKEERLFRVLTTEEIDQHLTAISERD

SEQ ID NO: 11089 - DNA, 853 bp, Zea mays
  misc_feature: Ceres CLONE 1352484-F
  misc_feature: Encodes the peptide sequence at SEQ ID NO. 11090
tccccgcggtggcggccgctctataactagtggatcccccgggctgcaggaattccttatcaaacttatctagacccccaagctccacggaaggcccgcccacaccactgctgcctataaagaagcctcattcactttcactgtggcgactgttttacctccgtcgagattcgcaaaaatcctgaacagtactcaagctgaatgctccttgaagctgcctctctccatttcgctcgcctggcgaaattaccacaagagcttccagcacctgatcttgccgttcccaacagccttgccagcgctgtgatgctccaatgaggatgttgtaagcataccttagtttgtgctgaaattcggacaccaattcttgctaccttccactgcattttttagccaacatcatcgaaatcggacattctccctgtataaatcagatcaatagaccgagatactaatcaccgcctgctccatcttggaacaagagtccaactattagagaacattgactctctcgtgccattgcaaagacaccatctatcagggttatgttccgctacgcgaaccattcttctactactgttgcttgtaccttaggtgccgtaattgattagatcgaatacctaaaggaactctgcgatgtaaagcttgactagcaaagccatgtaacctgctgaaacttgaacgcaataatgcgaacgatttgttcgctaaggcgctgaattgtgtaacggtgactgtgcgcgtaaccaccacacccgccgcgcttaatgcgccgctacagggcgcgtcaggtggcacttttcggggaactgtgcgcggaacccctatttgattatatctctaaatacattca

SEQ ID NO: 11090 - protein, 38 aa, Zea mays
  misc_feature: Ceres CLONE 1352484-F
MLLEAASLHFARLAKLPQELPAPDLAVPNSLASAVMLQ

SEQ ID NO: 11091 - DNA, 871 bp, Zea mays
  misc_feature: Ceres CLONE 1352523-F
  misc_feature (871)..(871): n is a, c, t, g, unknown, or other
ccccgcggtggcggccgctctagaactagtggatcccccgggctgcaggaattctgcaccacattcagagagatagagagtgaactcactagtcccccccccctccgatctcaccacataactgacacatgatgatcacacctcatccaacgtcctggacctcgtgactgcgccatgggctgaccttatcataacagggtacagcacacctgcaacttgattatcttgattcatcccacgcctaactctgtagaggtctatacaacactaaagagcgcatgacgtggttcccagacgccctactcaacctggattaactgaaccttttaatgatcgattgcctatttagcctgtttatctcttcactgcgaccatgactgttacccatgacataatccgtcatgagattgtaatatatccacataacacctggtcacgatgaatgctgaatgctcgccgttaaacggtccgtcccatactactctgtattgccgcgtctgcgggttatagttcgatggaggctgcacaatacacccgcttagatcgcataattacggctcatctagctgtctgtggacctgctcctacaccacctggactgcgaacaccgtcgtgttcccctactaatgcttctcatcgaagatctccctttatgacgatcagagagtattgaacagcacctgacctgtggcgcttcccaacagttgtcctgcgcatacggatattagacaaattgcaacggtatattatccgtcaccacccacgtcagatactgcgaggagcatctcctctttaatgccgataggcctattcgtcacccatccctcgtaactctgaatactgaccaacatacggtcttactgatgtaccn

SEQ ID NO: 11092 - DNA, 813 bp, Zea mays
  misc_feature: Ceres CLONE 1352540-F
  misc_feature: Encodes the peptide sequence at SEQ ID NO. 11093
  misc_feature (719)..(719): n is a, c, t, g, unknown, or other
  misc_feature (813)..(813): n is a, c, t, g, unknown, or other
gggctgcaggaattcggcacgaggagagagagagagagagagagagctcactagtccccccccccccccaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacgactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgacgacatggaactctggtacaagaaggtccgggctgccatccgtgctgatccttcctgtggtcaagtcaaccaagcagccaccaaaggagcaccagaggtaccacccccagaaactgacatagnagcagaaggaaggccgccctcattgaaaggttccaccactcaactcttcggggggggcaaatgaccaacacgagtttgccaagtaaagctcccn

SEQ ID NO: 11093 - protein, 222 aa, Zea mays
  misc_feature: Ceres CLONE 1352540-F
  misc_feature (1)..(100): Pfam Name: Ribosomal_L18p Pfam Description: Ribosomal L18p/L5e family
  misc_feature (202)..(202): Xaa is any aa, unknown, or other
MVLASAYSHELPRYGLEVGLTNYAAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPEKYQSHFSEYIKKGIEADDMELWYKKVRAAIRADPSCGQVNQAATKGAPEVPPPETDIXAEGRPPSLKGSTTQLFGGGK

SEQ ID NO: 11094 - DNA, 801 bp, Zea mays
  misc_feature: Ceres CLONE 1352556-F
  misc_feature: Encodes the peptide sequence at SEQ ID NO. 11095
  misc_feature (646)..(646): n is a, c, t, g, unknown, or other
  misc_feature (717)..(717): n is a, c, t, g, unknown, or other
  misc_feature (762)..(762): n is a, c, t, g, unknown, or other
ggatcccccgggctgcaggaattcggcaagagcttactagtcccccccccccccttttagcagtgggaagctatgatcaagcagtacggactttgaatcacttgacgtggaaaacttttgcggagttctcacatgcagggtatattcgtagtccttgcaatgctgctatttataaggaagtggatgacccatggcagcttgatatgtcggaattatgtctaagtgaaggcctctctcgtaacatgccagacaatggtgcagaaaatggcaccgagggaggaggctctagagttaaatatgctgtgatggatgttcccatcaccttaccttcgttgaaaccagcttttgacaagcctaaccccaaacaaggcattggtatgctgtcatggagcagcgacagccactatttcttcaccaggaatgacaacatgccaactgttctttggatatgggatatatgccgccttgagcttgccgctgtgctcgtgcagaaagatccaatccgtgctgcagcatgggaccctacctgcacacgccttgttttatgcacagagagccctcacttgtacatgtggacgccatccggtgcctgctgtgtcaacatcccctttctgaacttcgaatcgttgatttgaagtggagctcnaaatgggagctgtctcctcctgaaggagcgcgaatctttctgctgtgccacatcatatctgccttgcctgnagaagacctgatcattctgatgatactctgaagatgatgagtggncctcatggtatgtctagcagctattgcgatggactggga

SEQ ID NO: 11095 - protein, 210 aa, Zea mays
  misc_feature: Ceres CLONE 1352556-F
IPRAAGIRQELTSPPPPLLAVGSYDQAVRTLNHLTWKTFAEFSHAGYIRSPCNAAIYKEVDDPWQLDMSELCLSEGLSRNMPDNGAENGTEGGGSRVKYAVMDVPITLPSLKPAFDKPNPKQGIGMLSWSSDSHYFFTRNDNMPTVLWIWDICRLELAAVLVQKDPIRAAAWDPTCTRLVLCTESPHLYMWTPSGACCVNIPFLNFESLI

SEQ ID NO: 11096 - DNA, 795 bp, Zea mays
  misc_feature: Ceres CLONE 1352558-F
  misc_feature: Encodes the peptide sequence at SEQ ID NO. 11097
gctctagaactagtggatcccccgggctgcaggccccccccccccccgtttcccgctccgatcgaactgctccctccccaccaccgagcccatggcggaccagctcaccgacgaccagatcgccgagttcaaggaggccttcagcctcttccacaaggacggggatggttgcatcacgaccaaggagctgggcactgtcatgcgctcgctggggcaaaatcctacagaggctgagctccaggacatgatcaacgagggcgatgctgatggcaacggcaccattgatttcccagagtttctcaaccttatggctcgcaagatgaaggacaccgactctgaggaagagctcaaggaggccttccgtgtgtttgacaaggaccagaacggcttcatctcggccgccgagctccgccatgtcatgacaaatcttggtgagaagctaactgatgaggaggtggacgagatgatccgtgaggctgatgtcgatggtgatggccagatcaactatgaggagtttgtcaaggtcatgatggccaagtgagccacagaaccataatctgaaggcagagaagattctgcattgcatattagtcaagatgcaactttttattccatcgacttctagtgaacattctgctagttgtagttgctgaaaatggcaatgtagttcctgctttgtcttccctccagtggttttcataactggtgtttcctgggacctgtaatgatgccctctctgctgtggcttgattgcgttaaaaacatatgtaatttcccccccccacacatcaactt

SEQ ID NO: 11097 - protein, 149 aa, Zea mays
  misc_feature: Ceres CLONE 1352558-F
  misc_feature (121)..(149): Pfam Name: efhand Pfam Description: EF hand
  misc_feature (85)..(113): Pfam Name: efhand Pfam Description: EF hand
  misc_feature (48)..(76): Pfam Name: efhand Pfam Description: EF hand
  misc_feature (12)..(40): Pfam Name: efhand Pfam Description: EF hand
  misc_feature: SWISSPROT Homolog: EC 2.7.11.1 Non-specific serine/threonine protein kinase
MADQLTDDQIAEFKEAFSLFHKDGDGCITTKELGTVMRSLGQNPTEAELQDMINEGDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 11098 - DNA, 797 bp, Zea mays
  misc_feature: Ceres CLONE 1352569-F
agtggatcccccgggctgcaggcccccccccccccagacttttgcaaaatagacctggggcttgcacaaggaggcacaaaaggctgcttttgatgaggccgagaacaataagtaagatcatctgccgctcagggcggcgatgatgacgatgatgacctagagagatgaggaatactactctgaaggcagacgaggacgaggcctactctgatgcccaggatatcaaggattctgatgatgataagcaccacgaccagctctatatggtgaggatgatgttgcgaccgctggcctagatttatcagctctgccactatgaagttctttttttttcccgtgaccaccaagaatgtagaacactgctaataagcagatggacagtttgcgtcgccgtagcgctttgtagtcatttttcccattaaagccgataacactgaacaaggaggaaggatcttttgcccacgattgttatctccctttctgatgttaaatgtgagcctttggtaaagcactggttccgtcaaaaaaaaaaaaaaaaaaaaaaaaaactcgaggggggggccggtacccattccccctatagtgagtccaattacatttccccggccgtctcttttacactcccctgatcgcccaccccctgtgtatacccaatctaatcccctttctgtccttcccccccttcccctagattgtttgtttaccttcccatccctccttttccatttccatttcctctcttattttctcaccttacttctgcccctcttcttcctcccaccccccccactcttccg

SEQ ID NO: 11099 - DNA, 843 bp, Zea mays
  misc_feature: Ceres CLONE 1352582-F
  misc_feature: Encodes the peptide sequence at SEQ ID NO. 11100
gggctgcaggaattcggcaccaggggggcgacggggacgagagacgggggcgcctcctcggtcgtgacaccggtgccggtggcggcgattatggaaggctcggcctggcgcagcaaccactcgatggtctctccgtcggtgcggtgtccgagttcacgcgtgagctggaagacgcgcgccgccaccatggcgtcctcagtgtcccttacgccggtcccgtactacaccgcgctcctcatgcaaccaccgcccaccgccaatgagtcccctgtcgcctctgcatccgtatctggcactgttgcggataacaactaggctaggtggaagaggattatcaaatggcagttaggctaaaagttagttagtggttagggtttattatgtgtgctatgtggtcatggcttattaccttgggagaggattacggtgatttagctagcaaaactgattgagaatgtaacaacagaaggaatgacatctttttaaagtgttttttgagtcaaaaagaaaaaaaaaaaaaaaaaaacttcgagggggggcccggtacccaattcgccctatagtgagtcgaattacaattcactgggccgtcgtttactacgtcgtgactggggaaaccctggcctttcccatcttaattgccttgccgctattccccctttctccagttggtggcataccctaaaggcccccacttatttactcttacctcattccctcatcttgcttgcgcaaatgctacattcaactctatccctttttccacaaactccttcacacttttctctaccctccttcttttttatatctcttgtccatttcttccttctcccctaactattt

SEQ ID NO: 11100 - protein, 104 aa, Zea mays
  misc_feature: Ceres CLONE 1352582-F
GLQEFGTRGATGTRDGGASSVVTPVPVAAIMEGSAWRSNHSMVSPSVRCPSSRVSWKTRAATMASSVSLTPVPYYTALLMQPPPTANESPVASASVSGTVADNN

SEQ ID NO: 11101 - DNA, 843 bp, Zea mays; identical to SEQ ID NO: 11099
  misc_feature: Ceres CLONE 1352582-F2

SEQ ID NO: 11102 - DNA, 835 bp, Zea mays
  misc_feature: Ceres CLONE 1352585-F
  misc_feature: Encodes the peptide sequence at SEQ ID NO. 11103
  misc_feature (677)..(677): n is a, c, t, g, unknown, or other
  misc_feature (678)..(678): n is a, c, t, g, unknown, or other
  misc_feature (680)..(680): n is a, c, t, g, unknown, or other
gctcttcaacaagtggatcccccgggctgcaggaattggagagagagagagagagagagctcactagtcccccccccccccccatcttctgtgaggctgttgcaatttatggtgtaattgtggcaatcatcctccagacaaagcttgaaagtgtgccaacatcccaaatgtacgatccggagtctcttcgagctggctatgcgatctttgcatctggtcttatcgttggcttcgctaatcttgtttgcggggtatgtgtggggataatcggaagcagctgtgcactgtctgatgctcagaactcatcactctttgtaaagattttggtgattgagatcttcggcagcgctctgggactgttcggagtcattgtgggcatcattatgtcatctcaggcgaattggccagcaaaagcttgatcttacccgggaggggtccggaaatatttgcggaggaagtatcggatatgcatgctgccaaccaacgaaccttccgtgttcttttttttttaacaatctttccggaaaaacaaaaagaagtgtgaagcgtgcgcctacgatgtaaagttgtatctattccaaggcggaagggtcccagggggaaaaaatccttgagaggggatttttgttttgaaaaaatttaaaaatgggggccaaaaaaaaaggggtgggcccctnncnttttattttaaaaaaaaaaaaaaaaaaaaaaaaaaaaaaacgggggggggcgccgcccccccccccccccccatagggggttaattatcctcggcgggcgcccgttaaaaaaagggggggaagaaaaacccgcgtcaccaaatacatatgcgctt

SEQ ID NO: 11103 - protein, 138 aa, Zea mays
  misc_feature: Ceres CLONE 1352585-F
  misc_feature (66)..(131): Pfam Name: ATP-synt_C Pfam Description: ATP synthase subunit C
  misc_feature: SWISSPROT Homolog: EC 3.6.3.14 H(+)-transporting two-sector ATPase
SSTSGSPGLQELERERERELTSPPPPPIFCEAVAIYGVIVAIILQTKLESVPTSQMYDPESLRAGYAIFASGLIVGFANLVCGVCVGIIGSSCALSDAQNSSLFVKILVIEIFGSALGLFGVIVGIIMSSQANWPAKA

SEQ ID NO: 11104 - DNA, 824 bp, Zea mays
  misc_feature: Ceres CLONE 1354572-F
  misc_feature: Pfam Name: PsaD Pfam Description: PsaD
  misc_feature: SWISSPROT Homolog: EC 3.2.1.23 Beta-galactosidase
tggcggccgctctagaactagtggatcccccgggctgcagggagagagagagagagagagagctcactagtccccccccccccccctccaccccaaggacggcgtctacccggagaaggtcaaccccggcagggagggcgtcggccagaacttccgcagcatcggcaagaacgtcaaccccatcgacgtcaagttcaccggcaaggccaccttcgactaatcacacttcacgtacgccgcacgccccagccgggatccaaattaaagaacttcttcttctattaattacagtatattgtaatttggctgctggtacggtggtggcatgatttgagatgtgcatgatgatccttgtgtaattttattaccaagtctcttcttatatttacatgttcatttgcttgcttcttgcataacataacgcctatcgacaatgaccatcattagttttagtcctacgtgtatttgattcaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaacaataggccgaaatcggcaaaatcccttataaatcaaaagatagaccgagatg

SEQ ID NO: 11105 - DNA, 867 bp, Zea mays
  misc_feature: Ceres CLONE 1354587-F
  misc_feature: Translation starting site: 176
  misc_feature: SWISSPROT Homolog: EC 3.2.1.23 Beta-galactosidase
  misc_feature (621)..(621): n is a, c, t, g, unknown, or other
tggagctccccgcggtggcggccgctctagaactagtggatcccccgggctgcaggaattcggcacgagccccccccccccccgctacagcaaccgcgacgtcgacctgatccgccgcatggtcaagacccaggagagagagatatttctggctccctatcggggggcggccccaatggcctttggtcgcagaccatctttgctgcttgtctatgctgagaataaatgggaacggagcccctggacgctggatccatgctggctttggacacgttgcctttttgagtttaacttatctgctaccgtcctgtaacgaattcactaagccctagatcttgtgggctttgtcaagaatataaacaatgaggtttcaattttggtggcgccatccgggctgattgcgcactagatcccgaagtacggcgttaataggactcgagggggggcccgggacccacttcgccctatagcgagccgaattacaattgactggccggcgttttaccacgtcgtgactgggaaaaccctggcgtgacccaacttaatcgccttgcagcacgtccccctttcgccagctgaagtaatataccagatgcccgcagcgatcgcccttcccaaagngtgcgcaacctgaatggcgaatggccaatggaaacgcgaatattgcgtcagaatcgcgtataattcttgttaatcagctcatctgttaccaataggccgaagtcggaaaatcccctatacatcaaagatacaccgacatcggtgtgagtgatgtaccgtgtggaacagacgcacttattaagatcgcgaactctaccgacaagggcgcaaaacgtttatcgggcatatgcccactacgggtacatc

SEQ ID NO: 11106 - DNA, 862 bp, Zea mays
  misc_feature: Ceres CLONE 1354604-F
  misc_feature: Encodes the peptide sequence at SEQ ID NO. 11107
tggagctccccgcggtggcggccgctctagaactagtggatcccccgggctgcaggcgctcccccccccccctgcgcgtgtgcaggaagtatccatgatgactgaaccacagcccgatacccgattcagcctatagaggagcgcaatacgaatctgtgcccggccttccacaagtggagagtccgagacagtatcttcttcacgtaactcagctcgtggctgtcccgatgttcaccgctgaggcaatagccaaccaggcccctgctcatgccccttcacgacatggatccattgtgccaagtgtaccgcgagactggcatactaccccattctggacgccgtcaagacatacctatgggattactggtcatcattatatgcaagtagggcctctgctccgtcatcacttattgaaacggcaaaatggcgcagatggatagagacgcgtaatcgcgcattgttgcaagatgaacatactatggatgcatgactccaaatttcagggcgaacttgcggcgataaagtgaatcatttccatacgcgaacctgcaccacaaatgaaacttttaaatggcgcaggtgtcatgagagacactaaacccgcacctttgcagcctcccccgatttagagcttgacggggaaagccggcgaacgtggcgagaaaggaagggaagaaagcgaaaggagcgggcgctagggcgctggcaagtgcagcgatcacactgcgcgtaaccagcacaccattagcgcttaatgcggcgctacaggtttacgacaggtggcacttttacaacatatgtgcacgcaactcctatttgttgatgtatctacatctttcacagatgtatgcaatcatgagac

SEQ ID NO: 11107 - protein, 34 aa, Zea mays
  misc_feature: Ceres CLONE 1354604-F
MDPLCQVYRETGILPHSGRRQDIPMGLLVIIICK

SEQ ID NO: 11108 - DNA, 879 bp, Zea mays
  misc_feature: Ceres CLONE 1354623-F
  misc_feature: Encodes the peptide sequence at SEQ ID NO. 11109
  misc_feature (712)..(712): n is a, c, t, g, unknown, or other
  misc_feature (715)..(715): n is a, c, t, g, unknown, or other
  misc_feature (716)..(716): n is a, c, t, g, unknown, or other
  misc_feature (774)..(774): n is a, c, t, g, unknown, or other
  misc_feature (879)..(879): n is a, c, t, g, unknown, or other
ggagctccccgcggtggcggccgctctataactagtggatcccccgggctgcaggagagagagagagctcactagtccccccccccctatctcgcattctcccctcgttatcggtagaaaagttccatttacgatccactacttgcgtgcactacatagttccttgatgttaagctctggtgtgtcgcttttgaagtccattactccattttgctatgagcagccattcggccatgactactaaaacacatttgctttccaggactcgcgtttcacccactggatggtattctgcaagcgataccgcatgtgcttgcgctcttcctcctcccaacgcacttcaggacgcacatcgctctcgtgttcttggagggcgtgtggacgacaaacatccacgactgcattcacggcaaggtatggccagtcatgggcgctgggtatcacaccatccaccatacgacttaccgccacaactatggccactacaccgtctggatggactggatgtttggtacgctccgtgagccagatgatatcctcaagaaggcctgagttcgtcgtagctgtggttttcctacggtgctggatgtgcttggtctgttctgtccccagtgcctctaatccgctgagcctgttcagcgctctgtttctgtaggctttggtgtgctatttagtttgctaggttttatatggtgtgcttattctgtaattnagnngatgttgtctgatgacgcaacggagttcaggacgaataaaagaaagatttgctagacngaagaaaaaaaaaaaaaaaaactcgagggggggcccggtaccaattcgccttatagggagtcgtattacaattcctggccgtcgttttacacgtcgtgactgggn

SEQ ID NO: 11109 - protein, 41 aa, Zea mays
  misc_feature: Ceres CLONE 1354623-F
  misc_feature: SWISSPROT Homolog: EC 1.14.21.6 Lathosterol oxidase
MGAGYHTIHHTTYRHNYGHYTVWMDWMFGTLREPDDILKKA

SEQ ID NO: 11110 - DNA, 925 bp, Zea mays
  misc_feature: Ceres CLONE 1354635-F
  misc_feature: Encodes the peptide sequence at SEQ ID NO. 11111
  misc_feature (751)..(751): n is a, c, t, g, unknown, or other
  misc_feature (782)..(782): n is a, c, t, g, unknown, or other
  misc_feature (784)..(784): n is a, c, t, g, unknown, or other
  misc_feature (785)..(785): n is a, c, t, g, unknown, or other
  misc_feature (845)..(845): n is a, c, t, g, unknown, or other
  misc_feature (849)..(849): n is a, c, t, g, unknown, or other
  misc_feature (871)..(871): n is a, c, t, g, unknown, or other
  misc_feature (883)..(883): n is a, c, t, g, unknown, or other
  misc_feature (922)..(922): n is a, c, t, g, unknown, or other
tccccgcggtggcggccgctctagaactagtggatcccccgggctgcaggccccccccccccccccaattccaaccccagctttgactgccctcgcttggtgctcagttctttcctctgctcctccgcctcttctcgcacctcggcgcctccttcggcaactgcgagcgagatggaggcgcaagacgactgcaagtggcggcagatcccggcgttcggcgactggaacgtgtgggacggcgacatgcccgtcacccagtacttccaggcaggggccttcttcttcgcggcgccggcggagaagggcgacgcggatctcttcaaggtgccccagttgcctgccaagccctacggctacaagaagtgcgttgttcgagtgaagggggagaaagaaaccgctgtgccgccggcggcgaggaagggacgcaggaggcgctgcgtgagcgagcagcacaagtggaagcccaagggagctgtggacgaggacctgtacaagatctccccgcagcttctctgcaaggtgaagaagaagaagctgctgaggaatttgcttggagggtgcctgggcttgggctgcattgcctgagagtgagagatgcagagcttaataagtttcttgaaagttcgcttgcttgatgctctggagagagttgtatagttgtctacgctaatatgagagtaatgggaacttactactgcttctgcactcggttgaatggtacactaccctggtatcccatcttcctaccggntgctcagtgcctaactaagggctggttattnanntccgagaatgtataaatccaaaaaaaaaaaaaaaactcgagggggggcccgggtacccantcgncctatagtggagcgtataacanttcctggccgtncgtttacacgtcgtgactgggaaaaccctggcgtacccnatt

SEQ ID NO: 11111 - protein, 137 aa, Zea mays; identical to SEQ ID NO: 10772
  misc_feature: Ceres CLONE 1354635-F

SEQ ID NO: 11112 - DNA, 945 bp, Zea mays
  misc_feature: Ceres CLONE 1354652-F
  misc_feature: Encodes the peptide sequence at SEQ ID NO. 11113
  misc_feature (68)..(68): n is a, c, t, g, unknown, or other
  misc_feature (71)..(71): n is a, c, t, g, unknown, or other
  misc_feature (98)..(98): n is a, c, t, g, unknown, or other
tttctgttcggtgtggccatttcttctattatagcccgcctctcaaagctggagctccacgcggaggnggncgctctttcatacagaatcccccgggntgcaggttttcacccccccatcagccatcagatcagatcaaacaatccgcctccgcctccgcctctctacggttttgctctcggctcgtcggatccagttcgggggatcctccatggcgtcgcgtccgtcgctgaagtcgaagcccaagggcaagggcgggaagaaggccaccgctgacgacgaggacgccaccgcggcggcgaccacggtgaggctcatgaaggagtggaccacgtggacgatgaagaaggcgaaggtggtggcgcactactgtttcatccccctcgtcatcgtcatcggcatgaactccgagcccaagccctccgtcttccagctcctctcccccgtctgatcggatcatgacagggcccggatgaggtcggtccgtagtagtttgtagctggtacttcatttgcttacatatgtccgagatcgagttgaagaaggtggatcatgctttctgggcgaatttgaaggatttggtctaataattttgaagtggcggatgtcttctatacatcggatcaaaaaagtcttgggtatgggatctgcagcggctatatgattgtatgaacttatacccgttttcgcctggctggactgattttgttgcccgtcttgggctgatgttttgaaaaaaaaaaaaaaaaactccagggggggcccgggacccaattcccccaaaaggggggcgaataaaaatccacgggccgcggttttaaaactgcgggacggggaaaaccccggggggtaccaaatttaacgcgcttggggacatcccccctttccgtcgacgggggtaaaatggaagtagccccgaccctaatccgcctctcaaagaggtgg

SEQ ID NO: 11113 - protein, 79 aa, Zea mays
  misc_feature: Ceres CLONE 1354652-F
  misc_feature (37)..(76): Pfam Name: Tom7 Pfam Description: TOM7 family
MASRPSLKSKPKGKGGKKATADDEDATAAATTVRLMKEWTTWTMKKAKVVAHYCFIPLVIVIGMNSEPKPSVFQLLSPV

SEQ ID NO: 11114 - DNA, 883 bp, Zea mays
  misc_feature: Ceres CLONE 1354654-F
  misc_feature: Encodes the peptide sequence at SEQ ID NO. 11115
  misc_feature (31)..(31): n is a, c, t, g, unknown, or other
atagctggagctccccgcggtggcggccgcnctagcaacagtggattccccgggctgcaggtacccgagaccaggattgagctcactagtcccccccccccagccgcgacgcggacctttcgcgcgccttcgcttcagccgtgagcccgcaaccgacccgccgcaaaagaccaaaaccctagccgtcacagcgccgcccccgaaccataaacctccacctcgccggcggccatggcgttctccggcaggatccaggagctcgtgaggaagtatggcaaggtggccatttgcgtccacctatccgtctcctgcgcctccatcgccggcctttacgtcgccatcaacaacaacgtcgacgtcgaagccgttttccggaggttcggtatctcccccggcgttaccgtaggcggcgaggcctcacccgcccccgtttcccgcgatgaacacctgcgcgacgtccccctgccgcccatggccaacgaggtactgcaagaagagacggagcgagagcggcagccccgcaacaggacgatggagctcgtggcgtcaagtggcggcgcgttcgcgctcgctgtcgtctgcaacaaggcactattccccgtgagggtccccatcaccatcgcgctcacgccgcccgtcgccagggccctaagccgctggaggctcgtcaagagctgatctgtgtttttttcgtcacaactgctctgggatatagggtgcatccacatccaggaaatccagagagaaaattcgccgcggtttggtttttgtggtcatggatgaaagctgaaatccctggagcgaagtctcatgtttgactcccccttgttcatcagtgaggtgtgaatccctggcagaacgccttgctggatttgtaacatga

SEQ ID NO: 11115 - protein, 148 aa, Zea mays
  misc_feature: Ceres CLONE 1354654-F
  misc_feature (1)..(147): Pfam Name: DUF1279 Pfam Description: Protein of unknown function (DUF1279)
MAFSGRIQELVRKYGKVAICVHLSVSCASIAGLYVAINNNVDVEAVFRRFGISPGVTVGGEASPAPVSRDEHLRDVPLPPMANEVLQEETERERQPRNRTMELVASSGGAFALAVVCNKALFPVRVPITIALTPPVARALSRWRLVKS

SEQ ID NO: 11116 - DNA, 912 bp, Zea mays
  misc_feature: Ceres CLONE 1354673-F
  misc_feature: Encodes the peptide sequence at SEQ ID NO. 11117
  misc_feature (863)..(863): n is a, c, t, g, unknown, or other
tggagctccccgcggtggcggccgctctataactagtggatcccccgggctgcaggaattcggcacgagagtccccccccccccagacccgaccgcagcagcccggggcaacaagcgaaccgacggcggcgatggggatcggagagcacttcgagggcgtcaagcagcactgggcgagcaacttcgccttcctcgactacttcaagaaggtctacggccgcgccgagcccctccccaagtggtccgacgccgacgtcgacgagttcatcgcatccgacccggtctacgggccccagctcaaggccctgcgggagtcgaggaagttcgcgctcgccggggccctcgtcggcgccgcccacctcggcggcgtcgcgctcaagtactccaaggcgccgcacggcgtcctgctggcgaccggcttcggcgcgatcaccggcgccgtgctgggatccgaggtggcggaccactggtaccagctctacgagatggacaagcagggggccaacctcaggttcatctactggtgggaggacaaggtctcaggccagaagagctgaaccacatcgagtgatgcctattctactgagcacaccagcgtgacgacaaaacattgacgtctctcatgcccgaggtcgtagtttttctttcctagttttctctataagtgtggcattgggtgaggaagccgactggaccatgcatttttctctcccgcatgggttatggtcatccatgaccaatctggtgtaaacagcaaatctatccggttgcgagattgttttctcaaaccacaaaaaaaaaaaagactcgaggggggggccggaaccattcgccctataggagcgcattcaattccctggcgncggttaacacgcgagatgggaaaccctgggttaccacttaacgccttgc

SEQ ID NO: 11117 - protein, 141 aa, Zea mays
  misc_feature: Ceres CLONE 1354673-F
  misc_feature (66)..(110): Pfam Name: Rick_17kDa_Anti Pfam Description: Rickettsia 17 kDa surface antigen
MGIGEHFEGVKQHWASNFAFLDYFKKVYGRAEPLPKWSDADVDEFIASDPVYGPQLKALRESRKFALAGALVGAAHLGGVALKYSKAPHGVLLATGFGAITGAVLGSEVADHWYQLYEMDKQGANLRFIYWWEDKVSGQKS

SEQ ID NO: 11118 - DNA, 888 bp, Zea mays
  misc_feature: Ceres CLONE 1354680-F
  misc_feature: Encodes the peptide sequence at SEQ ID NO. 11119
tccccgcggtggcggccgctctataactagtggatcccccgggctgcaggaattcggcaccagaagtcccccccccctccctcactagctagctgtgtcctgcctacctagcggtatcaatacccggctgcagctcaccaccaccaccaaccaaccaaccaacccacagttcccatataggcagccatcggctacacagcctcgcctccgtaagcagagtgtgtcgttgcggaggcaggaagagagacgacggcggccatggcgacctccttccaggggacgaccaccaagtgcaccgcctgcgacaagactgtgtaccttgtggacaagctcaccgccgacaaccgcatctaccacaaggcctgcttccgctgccaccactgcaagggcaccctcaagctcgctaactacaactccttcgagggagtgctctactgcaggcctcacttcgaccagctgttcaagaggacagggagcttggacaagagcttcgaaggaactcccaaggttgtcaagccagaaagaaacgttgggaatgagaatgctactaaagtctcaagcgcctttgctggcaccagagagaaatgtgttggatgcagcaagacagtctatccaactgagagggtcactgttaacaacactatgtaccacaagagctgcttcaagtgctgccatggagggtgcaccatcagcccttctaactacattgcgcacgaggggaagctgtactgcaagcaccaccacatccagctgatcaaggagaagggaaactcagccagcttgagaatgacacgagaagactcccaggctgggtcactggaggagggatgacagagtatgatcactgagcacaacacagatgaatatgaatctcttggcattgctgag

SEQ ID NO: 11119 - protein, 190 aa, Zea mays
  misc_feature: Ceres CLONE 1354680-F
  misc_feature (110)..(166): Pfam Name: LIM Pfam Description: LIM domain
  misc_feature (12)..(68): Pfam Name: LIM Pfam Description: LIM domain
  misc_feature: SWISSPROT Homolog: EC 2.7.11.1 Non-specific serine/threonine protein kinase
  misc_feature: The sequence is a functional homolog of SEQ ID NO 1308 in the 11/479,226 US patent application
  misc_feature: The sequence is a functional homolog of SEQ ID NO 612 in the 10/412,699 US patent application
MATSFQGTTTKCTACDKTVYLVDKLTADNRIYHKACFRCHHCKGTLKLANYNSFEGVLYCRPHFDQLFKRTGSLDKSFEGTPKVVKPERNVGNENATKVSSAFAGTREKCVGCSKTVYPTERVTVNNTMYHKSCFKCCHGGCTISPSNYIAHEGKLYCKHHHIQLIKEKGNSASLRMTREDSQAGSLEEG

SEQ ID NO: 11120 - DNA, 891 bp, Zea mays
  misc_feature: Ceres CLONE 1354686-F2
  misc_feature: SWISSPROT Homolog: EC 3.2.1.23 Beta-galactosidase
  misc_feature (616)..(616): n is a, c, t, g, unknown, or other
  misc_feature (706)..(706): n is a, c, t, g, unknown, or other
  misc_feature (765)..(765): n is a, c, t, g, unknown, or other
  misc_feature (884)..(884): n is a, c, t, g, unknown, or other
ggagctccccgcggtggcggccgctctagaactagtggatcccccgggctgcagggagagagagagagagagctcactaacttcatcgtgacggtggccgtggttggcgcgggggtgcttctcttcaccaccgacatccgcaggtctggcgccctcttccgccgcaacgcgcgccagctccggcagtggctcgaggaggacacggcctccgccgcgtccaagtctgcaaaagaagcagctcaaaagaaactcgactcgacggtccccaaggagaaaccaaaggaagatagccactgactggagctgtttatatgaacggtataacccctatttgaagtattgcaagtcctgttttctacaattactgcaatagaaacttgtagctctcaagtaggtgcacggcaagattatgtttccgcttgaacatcggcctctgtggaacagctagctgaatgttggtattatgtcgtgtgcttatatggatccgaagcacttcgccaaaaaaaaaaaaaaaaaaaactcgagggggggcccggtacccaattcgccctatagtgagtcgtattacaattcactggccgtcgttttacaacgtcgtgactgggaaaaccctggncgtacccaacttaatcgccttgcagcacatccccctttcgccagctggcgtaatagcgaagaggcccgcaccgatcgcccttcccacagntgcgcagcctgaatggcgaatggcaaaattgtagcgttaatatttggtaaaattcgcgntaaatttttgttaatcagctcatttttaacccatagccgaaaatcgcaaatcccttataatcaaagaacaaacgagatagggtgagtggtgttccagttggaacagagtcactataaangacgtgg

SEQ ID NO: 11121 - DNA, 891 bp, Zea mays; identical to SEQ ID NO: 11120
  misc_feature: Ceres CLONE 1354686-F
  misc_feature: Encodes the peptide sequence at SEQ ID NO. 11122
  misc_feature (616)..(616): n is a, c, t, g, unknown, or other
  misc_feature (706)..(706): n is a, c, t, g, unknown, or other
  misc_feature (765)..(765): n is a, c, t, g, unknown, or other
  misc_feature (884)..(884): n is a, c, t, g, unknown, or other

SEQ ID NO: 11122 - protein, 98 aa, Zea mays
  misc_feature: Ceres CLONE 1354686-F
GAPRGGGRSRTSGSPGLQGERERELTNFIVTVAVVGAGVLLFTTDIRRSGALFRRNARQLRQWLEEDTASAASKSAKEAAQKKLDSTVPKEKPKEDSH

SEQ ID NO: 11123 - DNA, 878 bp, Zea mays
  misc_feature: Ceres CLONE 1354703-F
  misc_feature: Encodes the peptide sequence at SEQ ID NO. 11124
  misc_feature (585)..(585): n is a, c, t, g, unknown, or other
  misc_feature (674)..(674): n is a, c, t, g, unknown, or other
tggagctccccgcggtggcggccgctctagaactagtggatcccccgggctgcaggaattcggcacgagagagagagctcactagtcccccccccccccccagttccaactccaacctacgcagcagaggccagccacctccccgtcgctctcacgctcttcgtgcccgccgcctcccctccgtctctccctctcccctcccgtctgacgcacatggcctccatcgccggatcttccgccctctccttcgccaggcccgtcaaggcaatcaacacaaattctctagctttctcaccgttgaggaagggcaacacattcctccgcctgcaaccaatgcctatgagatctgtttcctgcgctgccaagaaggatacaacagacaaggtttgtgagattgtgaagaagcagcttgctcttcctgaccatactgaagtttgcggtgaatcgaaattctctgaactcggtgcagattcactggacacggttgagattgtgatgagtctcgaggagcacttcgatattagcgttgaggagtccagcgcacaaacaatcgccacagttgaagacgccgcggacctcatcgancagcttggtgctggcaaagcgtagttctgtacctccctctatcgtgtcctaccactctaggtctatcccttgatctaggtttctatggnctgaagattgtgatttttctcgcactggttgtgctatccccgtgtcgtataatacgagatggtttaagcggttgacattacgggggtgaatcaagtaatctgttgctgttaggggcttgttgaattgaaaaaaaaaaaaaaaaaaaaggaaaaaaaaaaaaaaacccgagggggggccggaaccattccccctaggggagcaat

SEQ ID NO: 11124 - protein, 131 aa, Zea mays
  misc_feature: Ceres CLONE 1354703-F
  misc_feature (56)..(123): Pfam Name: PP-binding Pfam Description: Phosphopantetheine attachment site
  misc_feature: SWISSPROT Homolog: EC 6.1.1.13 D-alanine--poly(phosphoribitol) ligase
  misc_feature (124)..(124): Xaa is any aa, unknown, or other
MASIAGSSALSFARPVKAINTNSLAFSPLRKGNTFLRLQPMPMRSVSCAAKKDTTDKVCEIVKKQLALPDHTEVCGESKFSELGADSLDTVEIVMSLEEHFDISVEESSAQTIATVEDAADLIXQLGAGKA

SEQ ID NO: 11125 - DNA, 761 bp, Zea mays
  misc_feature: Ceres CLONE 1354755-F
  misc_feature: Translation starting site: 271
  misc_feature: SWISSPROT Homolog: EC 3.2.1.23 Beta-galactosidase
  misc_feature (723)..(723): n is a, c, t, g, unknown, or other
tccccgcggtggcggccgctctagaactagtggatcccccgggctgcagggagagagagagagagctcactagtcccccccccccaacccgcagcgccgcagcgccaaggtcggcggcgaggacgacgccggcacctggcccttccaggtctgagggctggtcacattggccttggctgcgggaaggtggaactgagaaccgtgtgctcttggaagggaaatcaagcgtcgagtgttgttctactgatagaactgtgtgtgtgtgtgggaatgagatgggatgctgtgattcgtttattggttaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtcactattaaagacgtggactccaacgtcaagggncgaaaaacgtctatcagggcgatgggccactacgtgaa

SEQ ID NO: 11126 - DNA, 849 bp, Zea mays
  misc_feature: Ceres CLONE 1354773-F
  misc_feature: Encodes the peptide sequence at SEQ ID NO. 11127
  misc_feature (727)..(727): n is a, c, t, g, unknown, or other
  misc_feature (729)..(729): n is a, c, t, g, unknown, or other
  misc_feature (763)..(763): n is a, c, t, g, unknown, or other
  misc_feature (835)..(835): n is a, c, t, g, unknown, or other
ccccgcggtggcggccgctctagaactagtggatcccccgggctgcagggagagagagagagctcactagtcccccccccccaacaaccccaccatggtcgccatgtccatgctcaccaaggaggtgcaccgccgcaaccccaacttcaacgccggcagccccaccgagtacaccaactacctcatcatctccgtcggcaccgggtcggccaagcaggcggagaagtacaccgcggagcagtgcgcgaagtggggcctcatccagtggctctacaacggcggcttcacgcctatcatcgacatcttctcgcatgccagttccgacatggttgacatccatgcgtcgatcctctttcaggccctgcactgcgagaagaagtaccttcgcatccagttgtactatgcaggatgatactttgactgggaacgcatcgtccgtggacatcgccaccaaggagacatggagtctctgatatcgatcggccaggagctgctcaagaagccagtggcgagagtgaacatcgacacagggctgtacgagtcctgcgacggtgagggcacaaatgcacagtcgctagctgacttcgccaagcaactctctgacgagcgcaagctacgcaagagcaatctcaactccaactaataaatacctctctcagtcacagcatgtgctctttcccgcagattcaccgtttcttatttttaattaatttcaattctgtggggngngggggattggggtggggggactgtgtgtgtacantttaaaacatttaaagtcaatcaaaaaaaaaaaaaaaaaaacttcgaggggggggggccgggtacccatcgnccctaaataatgaa

SEQ ID NO: 11127 - protein, 105 aa, Zea mays
  misc_feature: Ceres CLONE 1354773-F
MVAMSMLTKEVHRRNPNFNAGSPTEYTNYLIISVGTGSAKQAEKYTAEQCAKWGLIQWLYNGGFTPIIDIFSHASSDMVDIHASILFQALHCEKKYLRIQLYYAG

SEQ ID NO: 11128 - DNA, 825 bp, Zea mays
  misc_feature: Ceres CLONE 1354778-F
  misc_feature: Translation starting site: 134
  misc_feature: Pfam Name: Ribosomal_L23 Pfam Description: Ribosomal protein L23
  misc_feature: Pfam Name: Ribosomal_L23eN Pfam Description: Ribosomal protein L23, N-terminal domain
  misc_feature (415)..(415): n is a, c, t, g, unknown, or other
  misc_feature (512)..(512): n is a, c, t, g, unknown, or other
  misc_feature (521)..(521): n is a, c, t, g, unknown, or other
  misc_feature (522)..(522): n is a, c, t, g, unknown, or other
  misc_feature (575)..(575): n is a, c, t, g, unknown, or other
  misc_feature (576)..(576): n is a, c, t, g, unknown, or other
  misc_feature (668)..(668): n is a, c, t, g, unknown, or other
tccccgcggtggcggccgctctagaactagtggatcccccgggctgcaggccccccccccccccagccgtcatcgcttcacgtccgctacagaccggcgaggagacgaaaggagggagttttgagaagctcaaatggctcctaaagccgctcctgccaagaagggtgatgccaaggcccaggccttgaaggtggccaaggctgtgaagtctggggcaggcaagaagaagaccaagaagattcgcacatctgtaacatttcaccagcccaagaccctgaagaaggccagggacccgaagtacccaagaatcagcactactggaagaaacaagcttgatcagtaccaaattctcaagtaccccctcaccacagaatctgcaatggaagaagaattgaagataacaacactcctggtnctttattgttgaccctcaggcagacaagaaaaagatcaagggctgcggtcagaagatgtatgacattcaagcaaagaagggtcacacccctgatcanggctgatgnnaagaagaaaggctatgtgaaactgacacccgactacgatgcccttgatgtggnncacaaattgccatcatctaaagtataggccactggatccgacatcgtgtcctactagttctgagataccaacaagattttctatgtactagnaattttgtttgccaaatttggtttttttggactaagccttgttcgcagttgaaactaatatgcctggaattgaaaatctggttgccaattaacatcttgaaatggcatattcccctttacggataaaaaaaaaaaaaaaaacccaagggggggcccg

SEQ ID NO: 11129 - DNA, 805 bp, Zea mays
  misc_feature: Ceres CLONE 1354797-F
  misc_feature: SWISSPROT Homolog: EC 3.2.1.23 Beta-galactosidase
  misc_feature (506)..(506): n is a, c, t, g, unknown, or other
  misc_feature (532)..(532): n is a, c, t, g, unknown, or other
  misc_feature (540)..(540): n is a, c, t, g, unknown, or other
  misc_feature (550)..(550): n is a, c, t, g, unknown, or other
  misc_feature (626)..(626): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
gctctgaactagtgactcccccgggctgcaggcccccccccccccccgagtgcctcaaggagtgggacggcaagccgctgcccatcaacatcaagtaaaagaacgccaaggagaagaggagggaggggaggaaatacgtgaaaaaaaataaaacctgtacacgtgtatgtccagatcgcgtgccgtcgatcgttcttcgttgttgatttttggttgtattgatcgatccgtatgtgtgcgtgcgtgtgtggcgttgctctttcttcttttgtgtagctgccctgccaccggccgacgtgtgcatgccatggtggcgggcagcgttttctaaggtcatatacagttgttgtgtttaagtacatcttgcgtactcaattccttctaagtaagtatcctaatactagaatgttcctctaaaaaaaaaaaaaaaaaaaactcgagggggggcccggtacccaattcgccctatagtgagtcgtattacattcactggcccgtcgttttancacgtcgtgactgggaaaaccctggncgtacccnacttaatcgncttgcagcacatccccctttcgccagctggcgtaataagcgaagaagcccgcaccgatcgcctttcccacagttgncaacctgaaatgcaaatggcaaatttgaaacgtttaaatttttgttaaattccgggtaaaatttttggaaacccgctcatttttaaccaaaggccgaatcggaaaatccctttaatcaaaaaccccnnnnngggggggggggggggttctcccctgttgaaaacaagccctttttaaag

SEQ ID NO: 11130 - DNA, 831 bp, Zea mays
  misc_feature: Ceres CLONE 1354826-F
  misc_feature: Encodes the peptide sequence at SEQ ID NO. 11131
  misc_feature (511)..(511): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (519)..(519): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (527)..(527): n is a, c, t, g, unknown, or other
  misc_feature (528)..(528): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (536)..(536): n is a, c, t, g, unknown, or other
  misc_feature (669)..(669): n is a, c, t, g, unknown, or other
  misc_feature (671)..(671): n is a, c, t, g, unknown, or other
ccccgcggtggcggccgctctagaactagtggatcccccgggctgcaggaattcggcacgaggacggctatgcccacctgtcgtctggccttgcctgtggtcttgctgggcttgctgcaggcatggccattggcatcgttggtgatgctggtgtcagggcgaacgctcagcagccgaagttgtttgttggcatgatcctcatccttatttttgctgaagcacttgccctctatggtctcatcgtcggcattatcctctcgtctcgtgccggccagtcccgcgcagattagaggcacgtttcagatgtcaacaccgtgccgccgacagttgcctggtcgtagctgggtcatgttctatatccatgagacaagaagctggagcactttgactctttgagaggcttacttttatgctgtctagttttccatcttctgttgagtcgagaaaacaagaaaggctgtgtagccaagggatgacttttacccttgtgccattcttttccctgcgtggnggnnnngntnnnnntnncnnnnnangccccattatgcaccgttttttgcttgggtcggcgcatgtggctgggcacgctacggccaagtgccgaaggagcgagcgcttgggccgctgttggagtataggacattctcgggaaaacctccttccgctgtngngtttattgattctttccccccccgtcaccctcgagttttcccccgaacacccaccccccccccaaggagtcaaatatccatcaccggccgctctttttaccggttctgggcaggctaaccgttgtgtgtaccaatatttcccccccgccccctcttccca

SEQ ID NO: 11131 - protein, 55 aa, Zea mays
  misc_feature: Ceres CLONE 1354826-F
  misc_feature (1)..(48): Pfam Name: ATP-synt_C Pfam Description: ATP synthase subunit C
  misc_feature: SWISSPROT Homolog: EC 3.6.3.14 H(+)-transporting two-sector ATPase
MAIGIVGDAGVRANAQQPKLFVGMILILIFAEALALYGLIVGIILSSRAGQSRAD

SEQ ID NO: 11132 - DNA, 850 bp, Zea mays
  misc_feature: Ceres CLONE 1354839-F
  misc_feature: Encodes the peptide sequence at SEQ ID NO. 11133
  misc_feature (509)..(509): n is a, c, t, g, unknown, or other
  misc_feature (514)..(514): n is a, c, t, g, unknown, or other
  misc_feature (569)..(569): n is a, c, t, g, unknown, or other
  misc_feature (571)..(571): n is a, c, t, g, unknown, or other
  misc_feature (583)..(583): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (767)..(767): n is a, c, t, g, unknown, or other
ccccgcggtggcggccgctctagaactagtggatcccccgggctgcaggcccccccccccatcttcaatctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccggcggagtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagaccgacctacgcttccagagctctgctgtctccgcgctgcaggaggcggctgaggcctaccttgtcgggctcttcgaggacaccaacctctgcgccatccacgccaagcgcgtcaccatcatgcccaaggacatccagcttgcccgcgcatccgncgggngagagggcctaagcgtcatattttctgtcatcagtgcccgatcagaagatgaagnantattgctggggntctgggaattttgggttactgtcgaatcatcgaggtgtgggctgttcactgctgtaacttaattatcatgatgcatatgaaatggcaatgaactctgttatcagttctcgaannnnnnnnnnnnnnnnnnngannnnnnnnnnnnnnnnnnnnnnnnnnnnnnnnnnnnnnnnnngannnnnanaaaaaaaatccgggggggggcccggtacccattcgccctaagggggcggatacaattccctggccgcgttttacaagccgggt

SEQ ID NO: 11133 - protein, 176 aa, Zea mays
  misc_feature: Ceres CLONE 1354839-F
  misc_feature (58)..(132): Pfam Name: Histone Pfam Description: Core histone H2A/H2B/H3/H4
  misc_feature (132)..(132): Xaa is any aa, unknown, or other
  misc_feature (134)..(134): Xaa is any aa, unknown, or other
  misc_feature (152)..(152): Xaa is any aa, unknown, or other
  misc_feature (153)..(153): Xaa is any aa, unknown, or other
  misc_feature (157)..(157): Xaa is any aa, unknown, or other
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARASXGXEGLSVIFSVISARSEDEXXLLGXWEFWVTVESSRCGLFTAVT

SEQ ID NO: 11134 - DNA, 987 bp, Zea mays
  misc_feature: Ceres CLONE 1354857-F
  misc_feature: Encodes the peptide sequence at SEQ ID NO. 11135
  misc_feature (987)..(987): n is a, c, t, g, unknown, or other
aaattttatcttaaatttttccccctcctcataataaccacctttctaaaaactggagctccccgcggtggcggccgctctataactagtggatcccccgggctgcaggttcccccccccgctccatgtctttagaagaagatcctggcttagagtacgagctgtctgctctgagagaagccatggcctctgggtttacgtatctcctagcacacggagatgtgagggcgaggaaggaatcagtcttcacgaagaagttcgtcatcaactatttctatgcgttcctcaggaggaactgcagggccggcactgcaaccctgaaggtcccccattcgaacatcatgcgtgttggtatgacgtacatggcctgactgggactctgctactgttgcgtcacaggactgtaccacgaatcttgtatggactggtgctgcaccagctcgtagtttaggggctgtactgtggtaccgattacattcattgctgcctctgggccatctgcccggaatttgtcacagaaatgactgtattttgttcgatgtgtgattccttccgccctttggccgcccaggcgggcctggcatgatataatggtggatacctgtaatcctgtatgaaacagggtattttggtgccaaatggctccccttggcattttggttgccccccctctctctatttccttagccctccacaacacttccagggggggggcccgcggtaacccctatttccccccttaatatgggacgccctatttaccaatttccctgggctccgtcgcttcttaccacgttccgggactgggggaaaacccctgcgctttcccccacactttatttcgcccttgcgaccacattcccccttttccggccgttgggcggaaataagcgaaaaaggcccccccccccattcctcccttcccacactgtggtcccacctgaaagtggtaagggccaaatctgaaccgctaaatttcttgtaaan

SEQ ID NO: 11135 - protein, 81 aa, Zea mays
  misc_feature: Ceres CLONE 1354857-F
MSLEEDPGLEYELSALREAMASGFTYLLAHGDVRARKESVFTKKFVINYFYAFLRRNCRAGTATLKVPHSNIMRVGMTYMA

SEQ ID NO: 11136 - DNA, 1255 bp, Zea mays
  misc_feature: Ceres CLONE 1354865-F
  misc_feature: Pfam Name: Gp_dh_C Pfam Description: Glyceraldehyde 3-phosphate dehydrogenase, C-terminal domain
  misc_feature: SWISSPROT Homolog: EC 1.2.1.12 Glyceraldehyde-3-phosphate dehydrogenase (phosphorylating)
  misc_feature (22)..(22): n is a, c, t, g, unknown, or other
  misc_feature (28)..(28): n is a, c, t, g, unknown, or other
  misc_feature (30)..(30): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (725)..(725): n is a, c, t, g, unknown, or other
  misc_feature (750)..(750): n is a, c, t, g, unknown, or other
  misc_feature (874)..(874): n is a, c, t, g, unknown, or other
  misc_feature (878)..(878): n is a, c, t, g, unknown, or other
  misc_feature (899)..(899): n is a, c, t, g, unknown, or other
  misc_feature (1255)..(1255): n is a, c, t, g, unknown, or other
actttctttctttttatgtgantccccntntntnnnnnncccgcannnnnnnnaaaatatgaaactcaacgcggtggcggccgctctagaactagtggatcccccgggctgcaggccccccccccccggctgcttctgagggcccactcaagggtattatgggctacgtggaggaggatctggtttccaccgacttcaccggtgacagcaggtcgagcatcttcgacgccaaggacgggattgccctgaacgaccaccttcatcaagctcgtctcttggtacgacaacgagtggggctacccgcaaccgcgtcttcgacctgatccgccacatgttcaagacccagaagagagagatattcctgcctccctatcgagggtcgtccccgatggcctttgggcccccaccattttttgtctttgcccacccccccaatgagggggggggggggccccctgtcagcctccatccatgcctgcgtctcgcccaaccgctggcctcttttgcgctcaaaccttgcctccgctgcccgcgcctcgtaatcgaatttccccctcaacctcttagtccctgtatccgcgcccctcctctaagacaacattccacagccccggccggcggtctgttgtacccacctctccagcctaacactattctctgccggcggcgcgggcgcgttgccagttcaccttcagcgactgcactcctctctactcaacgtagangcgttccgagcctcgcgcaccccantcttctcgctccgcgtcgccgccctgcctcttctgttctctacaactccccactccactgagtcgatccttcagatatcaacacgcaccactcactccgtgatgcatctccgcctcatatatangttntccaaaacgccagcgcttccnacctcgcacgctgtcacagcgacccgcgcctaacctccacacgcgcacaactagtatactgcgcacaacgtctacgatttacctctgcgtatggcagctcgctccccccctctacgcgcgtctctattatagttatcgcgcacttgttgtcgcagagatcgtagttgttattcacctctaccaccaccctctcctgcaccttcccctccccgtcacgcactgtgcctccgcacccaatcctgtcccccgcttctgactctacttagtgtgtcgcgcgatcgtctacaaccgcctcccttctctcgcatccacctcacgtcacacatgtcacgtcatcctctgacctctctaccacn

SEQ ID NO: 11137 - DNA, 862 bp, Zea mays
  misc_feature: Ceres CLONE 1354880-F
  misc_feature: Encodes the peptide sequence at SEQ ID NO. 11138
  misc_feature (705)..(705): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (826)..(826): n is a, c, t, g, unknown, or other
  misc_feature (828)..(828): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (839)..(839): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (858)..(858): n is a, c, t, g, unknown, or other
  misc_feature (859)..(859): n is a, c, t, g, unknown, or other
ggagctccccgcggtggcggccgctctagaactagtggatcccccgggctgcaggcccccccccccccccggcctccatttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtccttcgaccaaggtccacgctgctcctggcggtggctcttccctgggatacctgtttggtggcaactgatgccgctcaccaagctatcaccccccactgtcgccgcatgctttttctgaatcgtgaacagccgttgtcatttcatgtgtacccaaacctcccgtcccgcgtgggcccgtaagctgcgcctagatttcagggctaatcgtgtgcctgaaccctcatcataagtcgtctctgtacccagcttctcgttncgtttgcacccgtgatggtatggtttgggtgttgcccgctggacctatctattctttgcatttttcctttggaaaaannnnnnnnnnnnnnnnnnnnnnnnannnnaaaaaaaaaaaaaananannnnnnnaanaaaaaaaannnaaaaaaanntta

SEQ ID NO: 11138 - protein, 106 aa, Zea mays
  misc_feature: Ceres CLONE 1354880-F
MSRGGSAGGGQSSLGYLFGSGEPPKPAVAPAVSAPPAAAGAPPAEKPPAAKPDGTSQIAAGVTSQTNNYHRADGQNTGNFLTDRPSTKVHAAPGGGSSLGYLFGGN

SEQ ID NO: 11139 - DNA, 864 bp, Zea mays
  misc_feature: Ceres CLONE 1354884-F
  misc_feature: Encodes the peptide sequence at SEQ ID NO. 11140
ggagctccccgcggtggcggccgctcttcaatagtggatcccccgggctgcaggctccccccccccccccgaagcaattgagggccgaataattcgtcgccgtacttcacctcgcgccgcttgccgctgggatgcgtggacataatcatgagtgctttcatctccgcgcgaggttacgagccacctgaagatcatcctggtacctggaatctcaagtcccaggtcaagagcaggtaccgcaagatgaggcgcatggaggatgctatggtgtgttcgtgagaggtctaggccgtcgtctcccagtcaactttgggttgctggatcgtttcctcatatgatgtaattatttaattatttttgtacagaactccggttatatagtaaagatgtgacattcgatcctgtgccactaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcatttttttaccaatagggcgaaatcgggcaaaatcccttataaatcaaaagaatacaccgaaaatagggttgagtgttgttcccagtttggaacaagagtcccctattaaaagaacggtggactccaacgtcaaagggcggaaaaaccgtttatccaggcggg

SEQ ID NO: 11140 - protein, 43 aa, Zea mays
  misc_feature: Ceres CLONE 1354884-F
MSAFISARGYEPPEDHPGTWNLKSQVKSRYRKMRRMEDAMVCS

SEQ ID NO: 11141 - DNA, 855 bp, Zea mays
  misc_feature: Ceres CLONE 1354889-F
  misc_feature: Encodes the peptide sequence at SEQ ID NO. 11142
acagctggagctccccgcggtggcggccgctctataactagtggatcccccgggctgcaggccccccccccccccccccccgcaacagtgtcaaggacgaggaagggtacccggccttcgcgctcgtcaacagggtcaccggacgaggccatcaagcactcccagggcgagggccacccggtcaagctggtgccctacaaccccggctaccaggactagtcggtgctgtggacggagagccgcgacgtcggccacggcttccgctgcgtccgcatggtcaacaacatctacctcaacttcgacgccttccacggagacaaggaccacggcggcgtgcgcgacggcaccaacatcgtgctctggaagtggtgcgagggcgacaaccagcgctggaagatcgtcccctggtaaatgtgctgttctgtggctgcactggtcatcaccatgatctggagctttgaaggcatacccacctgtggtcagcaactgctgccgtgttgctagaataaaggtggtggagatcgatcgatcgatctttggtgatgggtgcccctccctgagtggttgtgtttagctccagtcgtttgtgaggaagtcagttatgtttgagtgagaggggaacttcgctcttcgggtaactctgaacttgtcatgaggagagttttcatacacggaggggagaactctgtactgtactcggatccttcctttttcatccaagggggtttttatttatcaaaaaaaaaaaaaaaaattcgaggggggggccgggtacccaaatccgcctaaagggagtcccattacaattgccctgggccgcgtttttacaaggccgcggactgggaaaaccctggg

SEQ ID NO: 11142 - protein, 45 aa, Zea mays
  misc_feature: Ceres CLONE 1354889-F
MVNNIYLNFDAFHGDKDHGGVRDGTNIVLWKWCEGDNQRWKIVPW

SEQ ID NO: 11143 - DNA, 1069 bp, Zea mays
  misc_feature: Ceres CLONE 1354894-F
  misc_feature: Translation starting site: 203
  misc_feature: Pfam Name: Prefoldin Pfam Description: Prefoldin subunit
tattccctactacacccaaataaaagcctggcgcccccccccccccctctccacgctggcgctccccgcggtggcggccggctctattctagtggatcccccgggctgcaggcctttcccccccccactcctccggcctccctccgcgaatacacccgccgccactcctgctttgttcccgtacctaacaaaggcgatatccatggcgagccctgcacggaccgagctggacaagccgagcgtggagcagctcaaggggctcaaggagcagacggatctggaggtcaacctcctcgaggacagccgtcaccaagatccgcaccgccgccacccgactcgagaacgcctccgccgcgctccaggacctatccctccgcccccaagggaagaaaaggctcgtgccgctcacggcgttactctacgttcccgctccactggacgacgcggagaatgccctccaccatgtcggcaccggctactccatcgaagaaaaccccgcctcaggccgaaccaaaactgccggaaggaaactcgaactcatcgaagtccaacttccgatgacctcgacttgaggcagcctacgacaaaaaaacagcccatccaagaccgataccgtgtattgccaactacctcagccacaggttatgggaaaaaccgccatccgcggcccccaagtgtacatgccccagcctggggaagccaacaacactccgatctcccttcctcaccggcactgcgtgggaacacaacgactgccattgttccggagcattttcggaacgcttggcgacactcacacccagtacagccgcagaaatctcgctcgtccctcacggtgcacctcttcttgaaccgccgtgaggcaaaatcacgatcttgcaaacgaggggcagcaaacatagcgcgccctaccagccccagctcactccgcccggggcacactgctccgatgaacccttggaatagtggtgtgagcaacaaagctcaatccatcttccacagcctcttcatactcaattcaaggcagcccctagtacccctccaccacactccctaaccggcggcgacc

SEQ ID NO: 11144 - DNA, 863 bp, Zea mays
  misc_feature: Ceres CLONE 1354909-F
  misc_feature: Translation starting site: 130
  misc_feature: SWISSPROT Homolog: EC 3.2.1.23 Beta-galactosidase
  misc_feature (505)..(505): n is a, c, t, g, unknown, or other
  misc_feature (506)..(506): n is a, c, t, g, unknown, or other
  misc_feature (522)..(522): n is a, c, t, g, unknown, or other
  misc_feature (564)..(564): n is a, c, t, g, unknown, or other
  misc_feature (787)..(787): n is a, c, t, g, unknown, or other
cggtggcggccgctctagaactagtggatcccccgggctgcaggcccccccccccccaactccaagcgccaccaatctcgccttccgaggaaacccaccagcccaccacagacccgagcggaagaagccatgtccgggcgcggcaagggtggcaaggggctcggcaagggcggcgcgaagcgtcaccggaaggttctgcgcgacaacatccagggcatcaccaagccggcgatccggcggctggcgaggaggggcggcgtcaagcgcatctcggggctcatctacgaggagacccgcggcgtgctcaagatcttcctcgagaacgtcatccgcgacgccgtcacctacactgagcacgcccgccgcaagaccgtcactgccatggacgtcgtctacgcgctcaagcgccagggccgcaccctctacggcttcggcggctaggctgatggactcctcgcgatgttctccccttctgcagatgcgacgtttttctggccgtgccccnnagtcttgcgggtcagnaaagtttcagggaactcttggttagttcatctctggctggtnggtaggtttatctgaatcgtgaggaactagtaaggtttatctgaaaaaaaaaaaaaaaaaacttctcaagggggggggcccggtacccaattcgcccttaataagtgagtcgtattacaattcccctgggccggtcgtttttaacacggccgggactgggaaaaaccctggcgttacccaacttaatcgccttgcagcacatccccctttcgccagctggggnaaaaaaagcgaagaggcccgcaacgatcgcccttcccaacagtgcgcaccctggaatgggaaatgcaaaatgtaaa

SEQ ID NO: 11145 - DNA, 830 bp, Zea mays
  misc_feature: Ceres CLONE 1354910-F
  misc_feature: Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature (434)..(434): n is a, c, t, g, unknown, or other
tacccgcggtggcggccgctctagaactagtggatcccccgggctgcaggccccccccccccccccgccgtccgccgcggagttcaccggcgaggcgcgcgggtacatgggccccgtgctgcagttcctggcccgcaccgggtcgccgctcatggccaacatctacccgtacctggcctgggcatacaaccccagcgccatggacatgagctacgcgctcttcacctcctccggcaccgtcgtgcaggacggcgcctacgggtaccagaacctcttcgacaccaccgtcgacgccttctacgtcgccatgggcaagaacggcggctccggcgtgccgctcgtggtgtcggagagcgggtggccgtccggcggcggcgtccaggccacgccggccaacgcgagggtgtacaaccagtacctcatcaaccacgtcngggcgcgggacgccgcgccaccccggcgccatcgagacctacctcttctccatgttcaacgagaaccagaaggagagcggcgtggagcagaactgggggctcttctaccccaacatgcagcacgtctaccccatcagcttctgaagaaccgttaaccgtaccgatccaagctagctgctactgggcccctggtggtggctccgaccgacgacggacgacgacgatcgacctgcagcccgtatgtgtcgattccggccgtatacagacgacagcacgtaagtatggaaggatatacaccgccatatgtgggcttggctttgcgaccgctgggaagtgagctccccatctcattgtgcacggacgccctcccccaggtttactccctgatagatacct

SEQ ID NO: 11146 - DNA, 879 bp, Zea mays
  misc_feature: Ceres CLONE 1354920-F
  misc_feature: Encodes the peptide sequence at SEQ ID NO. 11147
  misc_feature (537)..(537): n is a, c, t, g, unknown, or other
  misc_feature (606)..(606): n is a, c, t, g, unknown, or other
  misc_feature (607)..(607): n is a, c, t, g, unknown, or other
  misc_feature (618)..(618): n is a, c, t, g, unknown, or other
  misc_feature (683)..(683): n is a, c, t, g, unknown, or other
ggagctccccgcggtggcggccgctctagaactagtggatcccccgggctgcaggaattcggcacgagggtgtcctggacctgaccactgtgcgcgcgcactgctcctacgccgccaacagctacttccagcagaacagccaggccaacggcggcgccacctgcgatttcggcggcacggccaacctcaccgacacagacccgagctctggaacttgcaaataccctgcaacaccaagcgaagcagggacaagcggcaacgccaccggcacgggcacggcaccgccaggctcgacgagtaacccagctacgacgcccagcatgggagggagcgtcacgacgacacctgtcggcgcgtttggtcccgcgcctagcaccttcagcgcggccaccgccactgccgccgcgtttggtggtcgccgtgccctcctcctcgccgtcgtctccgtcctgtctttcttggcgcgctaacttgctcgatcagaagaaatccgtagcatcgtcaccctatggtgtaattggcggccgcacaggacangggcttttttttttggtgtcatgccgtcatcgtgaaatttcaccaattgttcgttcttctctctcaggnnttcctcgcggntttcattacttccgctcatgaaaaatggggatcgaggttttacctgaaaaaaaaaaaaaaaaaanctcgcaagggggggggccgggtacccaattcgcccttaataggggagtcgtattacaattcccctgggccgtcgttttaacacccgtcggggactgggaaaaaaccctggcggttaccccaacttaatccgccttgcagcacatcccccctttcgccagctggggggaaaaaacccgaagaggccccgcaccgatt

SEQ ID NO: 11147 - protein, 49 aa, Zea mays
  misc_feature: Ceres CLONE 1354920-F
MGGSVTTTPVGAFGPAPSTFSAATATAAAFGGRRALLLAVVSVLSFLAR

SEQ ID NO: 11148 - DNA, 888 bp, Zea mays
  misc_feature: Ceres CLONE 1354948-F
  misc_feature: Encodes the peptide sequence at SEQ ID NO. 11149
  misc_feature (580)..(580): n is a, c, t, g, unknown, or other
  misc_feature (587)..(587): n is a, c, t, g, unknown, or other
  misc_feature (624)..(624): n is a, c, t, g, unknown, or other
  misc_feature (664)..(664): n is a, c, t, g, unknown, or other
  misc_feature (690)..(690): n is a, c, t, g, unknown, or other
  misc_feature (767)..(767): n is a, c, t, g, unknown, or other
  misc_feature (800)..(800): n is a, c, t, g, unknown, or other
tccccgcggtggcggccgctctagaactagtggatcccccgggctgcaggaattcggcacgcgagagagacgcacatctatctgtcaagcgacgccgcggcctcgatcagagtcggaggcgaacacccccatggcggcggctggcggcggcgcaggagggaaggtatccttcaagatcatcctcacctccgaccccaagctccctttcaaagtgttcagcgtgcccgaggcggcgccctttaccgcggtgctcaagtacgccgcggaggagttcaaggtcccgccccagaccagcgccatcatcaccaacgatggaattggcatcaacccccagcaaagtgcaggcaacgtgtttctgaaacatggttcggagctgcgtctcatccctcgcgatagggttggagctgtagtcatgtcttccggttagaggatatatacagtccaatgcataatgagcaaaacttgagagaaataaagctttgatgttggccttgcttggctggtaggatgttgttacaaggataataagcgaaccttaccgtacatggtctcaagttgtatgctctcctgtttgtatggngggagangatttctgaaagtgaatccagtatctgaatcgactcnaattagccgctttctgtcaaaaaaaaaaaaaaaaaattcnaggggggggggcccggtaccaatcgncccaaaaaggggagcgattaaaatcactggggccgtcgttttaaaaaagggccgggactgaaaaaacccctggccgntacccaacttaatcgccttgcagcacatccccntttcgcagtggggggaaaaaaagggaagaggcccgcaccgatcgcccttccaacagtggggcacccccggaaaggcggatggcaaatt

SEQ ID NO: 11149 - protein, 98 aa, Zea mays; identical to SEQ ID NO: 10858
  misc_feature: Ceres CLONE 1354948-F
  misc_feature (10)..(85): Pfam Name: UPF0185 Pfam Description: Uncharacterised protein family (UPF0185)

SEQ ID NO: 11150 - DNA, 855 bp, Zea mays
  misc_feature: Ceres CLONE 1354949-F
  misc_feature: Translation starting site: 141
  misc_feature: Pfam Name: UPF0185 Pfam Description: Uncharacterised protein family (UPF0185)
aagctggagctccccgcggtggcggccgctctagaactagtggatcccccgggctgcaggaattcggcacgcgagagagactcacatctatctgtgcagtgaccccgcggactcaatcagagacggaggcgaacacccccatggcggcggctgatggcgacgcaggaggcaaggtatccttcgagatcatcctcacctccgaccgcaagctccctttcaaagtgctcagcgtgcccgaggcggcgaccctttaccgcgcgtgctctagtacgccgcggaggagttcaaggtcccgccccagaccaccgccatcatcaccaacgatggaattgggatcaacccccagcaaagagaaggcaacgtgtttctgaaacatggttcggagctgcgtctcatccctcacgatagggttggagctgtagacatgccttccggttagaggatatatacacgaccaatgcataatgagcaaaacttgagagaaataaaactttgatgttggccttgcttgactgcaggatgctgttacgaggataataagcgaaccttaccgtacatgtatcaagttgaatgctctctgttagtatgtggagagatttctgacagtgaatccagtatctgaatcgactcgattagccgctatctgtcaaaaaaaaaaaaaaaaacgactcgagggggggcccggtacccaattcaccctatagggaagcgcattacaattcactggccggcgttttacaacgtcgggactggaaaaaccccggcggtactcaagtaattccacttgcaggaatccccctttcgtcagttggcgaaaaaaggaaaaggcccccaacgatctgcctttccaaaagt

SEQ ID NO: 11151 - DNA, 904 bp, Zea mays
  misc_feature: Ceres CLONE 1354969-F
  misc_feature: Encodes the peptide sequence at SEQ ID NO. 11152
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (583)..(583): n is a, c, t, g, unknown, or other
  misc_feature (584)..(584): n is a, c, t, g, unknown, or other
  misc_feature (618)..(618): n is a, c, t, g, unknown, or other
tcaccgcggtggcggccgctctagaactagtggatcccccgggctgcaggccccccccccccccgttctctggctctctccaaatttccctcttcggactgaggagctgctgccattgcttgatattcttgcaaacaaagtgaaggcaattcgtcgtttgagggatctacttacaacaaaactccctccaggcacatttcctgtcaaggtcgctattccagtcgtgcctacaatcagagtgcttgtgacattcacaaaatttgaagagctacagccgctagatgagttcaccacaccaccctcaagtcctgacaacagcaagagcccagcagtgcagccttcttcaagttcctggattcagtggatcaaggcgccctacctccagaacttgtcgacggcacctggcccaagcagccgcgtggaggacatccaggacccattcgccattccttccaattacgtgtggacaacacctgaagagaagaaaaagaagacacaagaaaacaagaacaagtcgaagaaaggcaggagcggcgcatagatagtacgtaggtgatacatggtggnnnnnnnnnnnnnnaanntaaaggtatgtttgggagggggggggaaaggggntattattcttcaggatctaacaggagggatggattgggagaatttgaagatttcggttgctctgacgccagaatattggaaaaacgaccggcttgccttctttcattgggataacagatctgctggcaaaaattcttcgtttaaacccatcggttggggccaaaaaaaaaaaaaaaaactccgaaggggggcccgggacccaatttgccctataggggagggaataaaaatcatggccggcgttttaacaacgccggagtgggaaaaccgggtcttcaccaaatag

SEQ ID NO: 11152 - protein, 179 aa, Zea mays
  misc_feature: Ceres CLONE 1354969-F
HRGGGRSRTSGSPGLQAPPPPVLWLSPNFPLRTEELLPLLDILANKVKAIRRLRDLLTTKLPPGTFPVKVAIPVVPTIRVLVTFTKFEELQPLDEFTTPPSSPDNSKSPAVQPSSSSWIQWIKAPYLQNLSTAPGPSSRVEDIQDPFAIPSNYVWTTPEEKKKKTQENKNKSKKGRSGA

SEQ ID NO: 11153 - DNA, 912 bp, Zea mays
  misc_feature: Ceres CLONE 1354985-F
  misc_feature: Encodes the peptide sequence at SEQ ID NO. 11154
  misc_feature (527)..(527): n is a, c, t, g, unknown, or other
  misc_feature (535)..(535): n is a, c, t, g, unknown, or other
  misc_feature (848)..(848): n is a, c, t, g, unknown, or other
  misc_feature (886)..(886): n is a, c, t, g, unknown, or other
  misc_feature (895)..(895): n is a, c, t, g, unknown, or other
aaagtggagctccccgcggtggcggccgctctagaactagtggatcccccgggctgcaggccccccccccccagccgccgccgcgtgaggttctccttgagctggcccgcagccgaaacagaatgccgctgcccaaatcaattgctcctcctggctcaattcccctcccgcctgagcaggacacactgttggcccagaactaccaactcctgcctccgttgaagccgccacctcaatatgaggaaaacgaggatgagaatgaagaatccaacccaagtctgacaccgaacccggcaaattctaatccaaccttctcgcaggatcagcggagtaacgagcaacagcacactccccagcatggccagagggtttcatttcaactcaatgctgtggcagctgctgctgcaaagcgacctcggatgaccgtcgaccagctgaacatcggctaaccagttatcgttggttagactgtagtatcattttcccccatcttttagtgtggtgaatcatgtttcgaagagatttantgttgtanggggatgatcttatttaccacccacctatttaaccacgagatgtgccgtacagccacagcatcataaagtttctgactggcaaaacgttgcctgcagggaaaggaagtaactgagccactaacggacttggttaacttaagggtaaaaaccggcaaacatgcatccggcgtctccttattcctactttcctgtcaaaagggcccctaaaaaaaaaaaacactcttgggtggccccggccaccattcgccgtaaagagacccgaaaacaccccccaccctgtcgtcaccatccttcattatagagaaacgtgcnaaccctccctcctctcctgtgtacagcaagccaccctnaggagcagngaagcctacatagctcg

SEQ ID NO: 11154 - protein, 148 aa, Zea mays
  misc_feature: Ceres CLONE 1354985-F
SGAPRGGGRSRTSGSPGLQAPPPQPPPREVLLELARSRNRMPLPKSIAPPGSIPLPPEQDTLLAQNYQLLPPLKPPPQYEENEDENEESNPSLTPNPANSNPTFSQDQRSNEQQHTPQHGQRVSFQLNAVAAAAAKRPRMTVDQLNIG

SEQ ID NO: 11155 - DNA, 789 bp, Zea mays
  misc_feature: Ceres CLONE 1355003-F
  misc_feature: Translation starting site: 70
  misc_feature: SWISSPROT Homolog: EC 3.2.1.23 Beta-galactosidase
  misc_feature (468)..(468): n is a, c, t, g, unknown, or other
ggcggccgctctagactagtggatcccccgggctgcaggccccccccccggttctggagctcgctggtaatgctgccagggacaacaagaagactcgcattattccgcgccacgtgcttctggcgatccggaacgacgaggagctttgggaagctgttgggcggcgtgaccatcgctcacggcggtgtgctcccccatatcaacccctgttctgctgcccaagaagacggcggagaaggcgtccagtggcgggagcaaggaggcaagtcgccccagaagccgctaaagtccccccaagaggcatagactgactgtccggtgtgatctgatgtttagcagtaccttgttaccagtatgcggtgatgcgtaagctgtagatgggacgaatgtgctggtgtgtgtatgtgtcctgctgcaagttgccccttttgctattaaaatggaagaagaaatgcctggtttctctgnaggtgcaaaaaaaaaaaaaaaaactcgagggggggcccggtacccattcgccctatagtgagtcgtatacaattcactgggcgtcggtttacaacgtcgtgactgggaaaaccctggcgttaccccacttaatcgccttgcagcacatccccctttcgccaactggcgtattagcgaaagagccccgcaccgatcggcctttccaacagttgcgcagcctgaaatgcgaatggcaaattgtaagcggtaatattttgttaaaattcgcggttaaatttttgtaaaatcagctcatttttttaacaataggcccgaatcggc

SEQ ID NO: 11156 - DNA, 804 bp, Zea mays
  misc_feature: Ceres CLONE 1355025-F
  misc_feature: Encodes the peptide sequence at SEQ ID NO. 11157
  misc_feature (399)..(399): n is a, c, t, g, unknown, or other
  misc_feature (413)..(413): n is a, c, t, g, unknown, or other
  misc_feature (423)..(423): n is a, c, t, g, unknown, or other
  misc_feature (458)..(458): n is a, c, t, g, unknown, or other
  misc_feature (515)..(515): n is a, c, t, g, unknown, or other
  misc_feature (525)..(525): n is a, c, t, g, unknown, or other
  misc_feature (532)..(532): n is a, c, t, g, unknown, or other
cgctctagaactagtggatcccccgggctgcaggaattcggccgaggttcacacacattaaagatgaccttgaaagccacagagttgacaaaaaagaggagttgacagctgaggacgcttacttgaagcatggggtatccgcatctctcagggcgatctgctgtgtcatggagaggtggatcgtggagaagtcctccctgggcgaagacgaagacgacgccccaccgactgaaagcaccgttgaagatgctagacatcttctgaactactgccagaattatgacctgtagcttgcttactgcaactttagtggacatagctgacctgtgagtgtgcggttgcaacccgcggctgcctaaccgtagaaagtcgtttaaatactaatgttgctgtagaggnacacactgctacgnagtactcagnttgcatagaggacaacaggctctatatgtcatttngcattttctgtgcctccagcgtgagatataggggttatattttgcagctcccatagnccaatatggncatatgnatgctgataaatggatgaacggtggcaaaaaaaaaaaaaaaaaactcaaaggggggcccggaacccaattccccaaaagggacccgatacattcccggggccgccgtttaacaggtcggactgggaaaccggggggtacccaaataaacccctggaaaaatccccctttcccaggtgtgggaaaacgaaaaggccccaccgattccccttccaaagttggccacctgaatgggaagggaaattgaagcgttaaatttggaaaatcccgaaaa

SEQ ID NO: 11157 - protein, 40 aa, Zea mays
  misc_feature: Ceres CLONE 1355025-F
MERWIVEKSSLGEDEDDAPPTESTVEDARHLLNYCQNYDL

SEQ ID NO: 11158 - DNA, 752 bp, Zea mays
  misc_feature: Ceres CLONE 1355037-F
  misc_feature: SWISSPROT Homolog: EC 3.2.1.23 Beta-galactosidase
  misc_feature (569)..(569): n is a, c, t, g, unknown, or other
  misc_feature (752)..(752): n is a, c, t, g, unknown, or other
cacccgcggtggcggccgctctagaactagtggatccccccgggctgcaggattcggcacgaggagagagagagctcactagtcccccccccccctagactgcacccccatcccgcagcagccaaaacctacctagccgccgccgcaggcggtccccccatcgccgccaagatgcagatctttgtgaagactctgacgaggaagaccatcactttggagggtggagtccctcggacaccattgacaatgtgaaggccaagatccaggacaaggagggcatccccccggaccagcagcggctcatcttcgccggctagcagctcgagggggggcccggtacccaattcgccctatagtgagtcgtattacaattcactgggcgtcgtttttacaacgtcgtgactgagaaaccccgggcgttacccaacttaatcgccttgcagcacatccccctttcgccagctggcgtaatagcgaagaggcccgcaccgatcgcccttcccacagttgcgcagcctgaatggcgaatgccaaattgtaagcgttaatattttgttaaattcgcgttnaatttttgttaatcagctcatttttaaccaaaggcccgaatcggcaaatcccttataatcaaagatagacgagataggggtgagtgttgtcccgtttggaacagagtccctattaagaagtggactccacgtcaaagcgaaaaacgtctatcagggcgaggccactacggaacatcacctatn

SEQ ID NO: 11159 - DNA, 773 bp, Zea mays
  misc_feature: Ceres CLONE 1355040-F
  misc_feature: SWISSPROT Homolog: EC 3.2.1.23 Beta-galactosidase
tgtggatcccccgggctgcaggccccccccccccccccccaatgtcctcccccattcaccatagtacgatcctgtctacgccctcggtgcctccttgcactgcgacatctcatgttaccacctcttaaagagagtgcactaacgccctggaggacctgtagggattcgataaatactactggaatgccggaggttacttcaataatgtcgacgatggccacgagggtgacgagtactagagaagtttgctgatgacgcagcatcaggccagtgtgctgcccttatcccgtgatctgccgagagttgctcctgctatcgcgttatgtgtgtctggtctgaagtattgtgcggtttacaacacctgatgttgtaagagttgttaattcccctgcattgctaccgggttattgagaataattatggctgtttacgttgttgcttccaaaaaaaaaaaaaaaaaactcgagggggggcccggtacccaattcgccctatagtgagtcgtattacaattcactggccgtcgttttacaacgtcgtgactgggaaaaccctggcgttacccaacttcatcgccttgcagcacatccccctttcgccagctgacggaatagcctaccaggcccgtaccgatccctcttcgccaaagttgaaaaagccggaagggataatgtgaaaatgatacccggtaatatttttgttaaatcccccccttttttatccataaggccgcacattttttacccccttagtcgtcaacagataacccttta

SEQ ID NO: 11160 - DNA, 894 bp, Zea mays
  misc_feature: Ceres CLONE 1355062-F
  misc_feature: Encodes the peptide sequence at SEQ ID NO. 11161
tggcggccgctctagaactagtggatcccccgggctgcaggaattcggcaccagagagagagagctcactagtcccccccccccccctctcctgatgctgccccagacaagagggatagctcgagatacaaccgcaggcgcataagcagctcgaggtccagcagccctgatgctgatggaaacaaaggcttgggctcgcactgagatgtaacgccacaacgatttacatgcgccaagaaccatctttcttgctaacttaccggtatgtacgcttttgtaatgtcttctaaacttgtttttttgatgtagctgaacatttggatgtcctgtcagacgggaaatgttttttacgccagatattgataactacgtctgagccaaagaaaaaaaaaaaaaaaactcgagggggggcccggaacccaattcgccctatacggagtccaattacaattcaatgcgcgtcgttatacaacgacgtgactgaaaaaaccctggcgtgacccaacttaatcgcctgtgcaggacatccccctttcgccaggtggcgtaatagcgaagaggaccgccccgatcgcccttcccaaaagatgcgcaacctgaatgcggaatggcaactcggaagcgttaatattgtgttagaatacgcgttaaagttttgtcaactcagctcgttttttaaccaataggacgaaatcggcataatcccttataaatcacaagaatagaccgagatacgtctcgagcgttgttgcagataggaacaagattccactattacatgacgtggactgccacgtacacaggcgaacaactgtctatcaggacgatgtccactacctgtaccatcaccctaatcagttgtttaggagccgagtgagctaagtactaatctga

SEQ ID NO: 11161 - protein, 32 aa, Zea mays
  misc_feature: Ceres CLONE 1355062-F
MRNLNAEWQLGSVNIVLEYALKFCQLSSFFNQ

SEQ ID NO: 11162 - DNA, 887 bp, Zea mays
  misc_feature: Ceres CLONE 1355084-F
  misc_feature: Encodes the peptide sequence at SEQ ID NO. 11163
  misc_feature (788)..(788): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
cgcggtggcggccgctctatactagtggatcccccgggctgcaggcccccccccccccccccaaaagatcgaagaaacaggagaccagaatctacttgccgacaacatggagatgctggcctctgcagtgtaccttcaagtgagcaccattagccaggcgttgatatttgtgacgaggtcgaggggttggtccttcatggagaggcctggcctgctgctgatggccgcattcgtgatagctcagctgatcgcgtctgtgcttgctgccatggtgagctgggagcttgctggcatcaaaggcatcgggtggcgttggaccggcgtgatctggctgtacaacttggttgtgtacctgctgctggacccgatcaagttcgcggtgcggtacgggctgagcggcaaggcctggaacctggtgatcgaccacaaggtggccttcacgaaccgcaaggactttgggaaggaggcccgggaggcggcatgggcgcacgagcagcgcacactgcatgggctggagagcgccgggacccctggggagaaagcggcgtcggtggagctggggcagatggcggaggacgcccggcggcgcgcggagatcgccaggctgcgggagctgcacaccctcaagggcaaggtggaatcggtggtgaagctcaaagggctggacctggaggacatcaacaaccagcactacacggtgtaaccgccgtgattgattcggcatagcctccttatcttagagagagggatataaaagtataatttggatgcataaccatctgattggntgccccccactattttgtccctaactatcacatgcgttgattttatctaaacttctggttggttcnnnnnnnnnnnnnnnnnnnnnnnnnnnnnnnngg

SEQ ID NO: 11163 - protein, 198 aa, Zea mays; identical to SEQ ID NO: 11084
  misc_feature: Ceres CLONE 1355084-F
  misc_feature: SWISSPROT Homolog: EC 3.6.3.6 Proton-exporting ATPase

SEQ ID NO: 11164 - DNA, 889 bp, Zea mays
  misc_feature: Ceres CLONE 1355087-F
  misc_feature: Encodes the peptide sequence at SEQ ID NO. 11165
ccccgcggtggcggccgctctagaactagtggatcccccgggctgcagggatagagagagagagagagctcactagtccccccccccccccaagggcctccacggatgcaccttcaagaagaaagcccccaatgctatcaaggaaatcaggaagtttgcacagaaggcaatgggcaccactgacatcaggattgatgtgaaactcaacaagcacatctggagcagtggtatccggagtgtgcctaggcgtggccgtgtcaggatcccacgcaagaggaacgatgaggaatacgcctaggaagagctttactctcttgttaccgctgctgaaattcccccagaaagcctgaagggtctgggtaccaaggttgtggaggactactagtagatctgcctgcgtactgatctgtgtcaactgtcaaatcatttttttggtgttttgtgagtttgttagcactaagtcgatatgcttgagacaaatcttgagttttctgatggcgcgcttgttctcggctgcttttgaacttttgaagatacctgcacagagtattgtagactgtccttccaaatcttttctgtagggaaaaaaaaaaaaaaaaaaaactcaagggggggaccgtgacccaattcgccctatagtgatgcgaattacaattcactggccgtcgatttacaacgtcgtgactgtcacaaccctggcgttaccctacttagtcgacttgcatgacatccccctttcgtcggatggcgatatcactattaggcccgcagcgatcgaccttccaagagttgcacagtctgactggccgatggcacattgcaagcgatcatatcctgataaagtcgcgtgaagtcttgtgaagtcaactcattatttaacaactagcgg

SEQ ID NO: 11165 - protein, 42 aa, Zea mays
  misc_feature: Ceres CLONE 1355087-F
  misc_feature (1)..(43): Pfam Name: Ribosomal_L31e Pfam Description: Ribosomal protein L31e
MGTTDIRIDVKLNKHIWSSGIRSVPRRGRVRIPRKRNDEEYA

SEQ ID NO: 11166 - DNA, 1033 bp, Zea mays
  misc_feature: Ceres CLONE 1355102-F
  misc_feature (19)..(19): n is a, c, t, g, unknown, or other
taactcttctctctactcntttcccctcactcactcccccccccccccatcttcctctcctttaccccgccgcccctctataatagtggatcccccgggctgcaggaattcggccgagctcactagtccacccctccccccgccgcggaatgggacccgtgtcccaaatttcgcaacggtgagctcgctcagcccgcccgcttgccagcttgaacaactccatcctttgcactagcttagctccatcgttttaccgcgttttggtccggagtctacttatgtttgtatgatgatgatgatgatgagacgatgctcgtgaggttgaactatgtctgtaacgcttgatcccgccgctgcctgctacctccgcgtaaggagcaaccaagatggcttggtgcttttactgcattgcggcggcgctgttgacgagggagtagatggtgtttattttccaaaaaatacacccaaattactttaagcggtgaaccaacaaaaaaaaaaatctccaaggggggggcccgggaacccaatttcgcccctataaggggagtcggattcacaaatattcctggcgccggcggttttacaaacctctttgaactggggaaaaaaccctgggggttttaccccaattttaaattcccccttggcaacaaatatcccccctttttccccaaggtgtgggggtaaataaccctaaaaaagggcccggccaccgaaaatttcccctctttcccaaaatagtttgggccacaccccttgaaaaggggcacaaggggccaaatttctgcataacccttataatattttttgtgtaaaaatacccccgggtagaatttgttgggtaaaacacaaccccttatttttttatcccaaaaagggcccggaaatctggaaaaaattccctttaatactttcacaaaaaataaacccgcaaatatgcgttccgacgttttttctctcatttgaaaaaaaaagtccccctataaaaaggaggggggcccccaccgccaaggtggaacaatctcccatt

SEQ ID NO: 11167 - DNA, 876 bp, Zea mays
  misc_feature: Ceres CLONE 1355115-F
  misc_feature (315)..(315): n is a, c, t, g, unknown, or other
  misc_feature (426)..(426): n is a, c, t, g, unknown, or other
  misc_feature (473)..(473): n is a, c, t, g, unknown, or other
  misc_feature (483)..(483): n is a, c, t, g, unknown, or other
  misc_feature (508)..(508): n is a, c, t, g, unknown, or other
  misc_feature (509)..(509): n is a, c, t, g, unknown, or other
  misc_feature (532)..(532): n is a, c, t, g, unknown, or other
  misc_feature (555)..(555): n is a, c, t, g, unknown, or other
  misc_feature (557)..(557): n is a, c, t, g, unknown, or other
  misc_feature (558)..(558): n is a, c, t, g, unknown, or other
  misc_feature (578)..(578): n is a, c, t, g, unknown, or other
  misc_feature (581)..(581): n is a, c, t, g, unknown, or other
  misc_feature (586)..(586): n is a, c, t, g, unknown, or other
  misc_feature (587)..(587): n is a, c, t, g, unknown, or other
  misc_feature (599)..(599): n is a, c, t, g, unknown, or other
  misc_feature (604)..(604): n is a, c, t, g, unknown, or other
  misc_feature (607)..(607): n is a, c, t, g, unknown, or other
  misc_feature (612)..(612): n is a, c, t, g, unknown, or other
  misc_feature (625)..(625): n is a, c, t, g, unknown, or other
  misc_feature (632)..(632): n is a, c, t, g, unknown, or other
  misc_feature (638)..(638): n is a, c, t, g, unknown, or other
  misc_feature (688)..(688): n is a, c, t, g, unknown, or other
  misc_feature (708)..(708): n is a, c, t, g, unknown, or other
  misc_feature (813)..(813): n is a, c, t, g, unknown, or other
  misc_feature (849)..(849): n is a, c, t, g, unknown, or other
cgcggtggcggccgctctagaactagtggatcccccgggctgcagggagagagagagagagagagctcactagtccccccccccccaaccccccccagacgtacctcctgctcggcttcatgctcttcatgttcgtcgccgccgtcgccgtgctcatggcttcgtcaggtcacaggaccacacagtgatcctggtcctgtcagtcaggctgtcacgctctaacatgcatgaaatcttcggtacaaaggaatggagatgtacataaaaatgtttgtgttgttgtgacaggaatataacaccatataaaaggctatntatattctttccaaagaaattggctgaaaaaaaaaaaaaaaaaaactcgagggggggcccggaacccaattccccgtatagagagtcgtattacaattcactggccgtcgntttacaacgtcgtgactgagaaaaccctgacgctacccaaattaatntcttttgaanaacatccccctttcaccagctgggnncaataggaaagagggcccgcacnaattgccctctccagaagattgncnnctctaaatggtgaaatgganaantgaannagcgtaatattnctgtnaantttgnagataaattttanttaactnaaactnattttttaaacaagatagccgaaatcggcaaaatccccttaattaataanaaaaacaccgaaaaaaggtngaaggagtgttccaattcgggaaagagacccactattaaaagaacgcgctccccaatacgatgggagaagactgcctataaggactagggcccaaaccataacancacctaattaagatgttgtggggcgaaggcgcctanccgctaaatgtgaaccaaaaaagcacc

SEQ ID NO: 11168 - DNA, 876 bp, Zea mays
  misc_feature: Ceres CLONE 1355120-F
  misc_feature: Encodes the peptide sequence at SEQ ID NO. 11169
acttgtggatcccccgggctgcaggaccccccccccccctgatgtcgtcgctgtcgctcctgccaccattattgtccttgcccatcaattgctgttgatgtccgcgtaggggggtgtcgtgctcgtgcattattgtttggtgacgaagagatgtttgtttgacgtttgccactctcggaaatggtttctgctgagtagcagcggctgctggaagttgcagttgccctgttgcccgcggggcgcgagcaaaccacaatcatcgggaactagcattcgtatcctgcatgcacgcccataccgtgtcagatctgaagtgggaagaactgcaacaagtaccactacgaatgcaccatggtgaggtgctttccaatcacttgagaatatattcatttttttatccaggtctcatatgccaaagcgccaaagctcgagtgttgtcccggtacccatttcgccctatactgagtcgtattacaattcactggcctccgttttacaacgactcgactgtttaaaccctgtagttacccaacttattcgccttgcatcacatccccctttcgcagatggcgtaatagatgagaggcccgcaccgattgcccttcacaaatttgcatatcctttatgtcaataggcaattgtacctattaatatgttgttaagattcgcgctaaattcttgttaatcaactcattttttaactatatgccgtgatcggcaaatccctcataatcatgagatcaccgagatatgctgagtgatgttctgtttggatcagcgtccctattatagacgtgactccacgtccaaggcgaaaaacgtctatcagggatggccactagttgacgtcaccctatcagtatttggtgttagtgc

SEQ ID NO: 11169 - protein, 74 aa, Zea mays
  misc_feature: Ceres CLONE 1355120-F
  misc_feature: SWISSPROT Homolog: EC 3.2.1.23 Beta-galactosidase
MPKRQSSSVVPVPISPYTESYYNSLASVLQRLDCLNPVVTQLIRLASHPPFADGVIDERPAPIALHKFAYPLCQ

SEQ ID NO: 11170 - DNA, 891 bp, Zea mays
  misc_feature: Ceres CLONE 1355123-F
  misc_feature: Encodes the peptide sequence at SEQ ID NO. 11171
  misc_feature (413)..(413): n is a, c, t, g, unknown, or other
  misc_feature (748)..(748): n is a, c, t, g, unknown, or other
  misc_feature (749)..(749): n is a, c, t, g, unknown, or other
ggcggacgctctatttctagtggatcccccgggctgcaggccccccccccccccacctttcgtccgggcttgcctgtggtctcgctgggcttgcagctggcatggacatcgacattgtcggtgatgctggagtcagggcaaatgcgcaacagccaaagcttttcgtcggcatgatcctcatcctcatttttgcagaagcgcttgctctctatggtctgattgttggaattatccttgctactcgcgctggccaatcccgggcggattaagtgcaccaccattctgtgattaccgcaccgtatattatgctattctgagagaagtggaactctattcccttgtctagctgattctcgctaccatgtattacatgtaaaaatctgtagctgaaggaaggtgacttccagtccagncatgatttgatagtggcggtgcggagcaccggtcatttttttgtttgggctgaagggggatggatgctttggggctgagaggatttgattttatccttgctgaataaagaagacggaattgtagccaaataagaacgtggagatataattatttctatttccataaaaaaaaaaagaaaaaacccgaaggagggggcccggtacccaattacgcccgatagggaggcgtattacaaattcatgggcgctgccatacaacgggcggactggcaaaaacctgggggtaccaacttaatcggcatgcacacctccccctttctccatgtgggcgaggnnccaaaaagccctgaaccgacgcccttacacgaagtctgggaaccataaagggaaagtgcaaattgtaagcgtgtgaaattttatgaaaatcacgaagggatatgtagtgaagccaagcgattttttaccaagaaggcgaaag

SEQ ID NO: 11171 - protein, 55 aa, Zea mays
  misc_feature: Ceres CLONE 1355123-F
  misc_feature (5)..(48): Pfam Name: ATP-synt_C Pfam Description: ATP synthase subunit C
  misc_feature: SWISSPROT Homolog: EC 3.6.3.14 H(+)-transporting two-sector ATPase
MDIDIVGDAGVRANAQQPKLFVGMILILIFAEALALYGLIVGIILATRAGQSRAD

SEQ ID NO: 11172 - DNA, 840 bp, Zea mays
  misc_feature: Ceres CLONE 1355145-F
  misc_feature: SWISSPROT Homolog: EC 3.2.1.23 Beta-galactosidase
  misc_feature (706)..(706): n is a, c, t, g, unknown, or other
  misc_feature (812)..(812): n is a, c, t, g, unknown, or other
tccccgcggtggcggccgctctagaactagtggatcccccgggctgcaggattcggcaccagccccccccccccgctcttcgaggacaccaacctttgcgccatccacgccaagcgcgtcactatcatgcccaaggacatccagctcgcgcggcgcatcaggggcgagagggcttgagcgcccgtcgtgctgctcgtcgttgtagtgttactagaagtagatggtggcattcgtttcgtggcttccttatcctgtaggagtaatgttctagatgtcttggcttcagtgcaatggactgtgattgctcatttctgaaatttatcaatggacttgttcttgcaaagatttgccgtctgttaaaaaaaaaaaaaaaaaaaactgccagagagaactagtctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccataggccgaaatcggcaaaatcccttatnaatcaaaagatagaccgagataggggtgagtgtttgtccagtttggaacagagtcactattaaagaacgtggactccacgtcaagggcgaaaaacgtctatcaggncgatggccactacgtgaacatcacccta

SEQ ID NO: 11173 - DNA, 802 bp, Zea mays
  misc_feature: Ceres CLONE 1355170-F
  misc_feature: SWISSPROT Homolog: EC 3.2.1.23 Beta-galactosidase
  misc_feature (783)..(783): n is a, c, t, g, unknown, or other
  misc_feature (794)..(794): n is a, c, t, g, unknown, or other
tggcggccgctctagaactagtggatcccccgggctgcaggagagagagagagagagagctcactagtccccccccccccgcgaccttggcgagctcggcgcccaccttggtgggccttaggagctttgagcaagaaggaatcgccctgtggccttcctccctcccacctgcctacgtaggcctatctaactgctgtgcgtgctagtcgatcgatcgaaaccgaacggttctgataaaccttatggtgtctaaagctccagatttatggattgccaaacacccagcaccgaattccagtttaatttccttgttttcgtgcgggtgacatctgcgccgtgaatttgcatgcttgtgcgtcttgttattgctcaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtggttgtcccagttgggaacagagtccactattaaagaacgtggactccnacgtcaaaggncgaaaaac

SEQ ID NO: 11174 - DNA, 855 bp, Zea mays
  misc_feature: Ceres CLONE 1355181-F
tggcggccgctctagaactagtggatcccccgggctgcaggaatacagagagagctcactagtcccctccctacccccaactgccacccctgccttattagcaaaggaaggccagtctcattgaaaggctcaaacaactcaactcctcggggggcgcagatgaccacaacgaggatgaccagtaaggtttcctgccatggaataatggatgtcgtatgcgttaatcataatttgtgctatggcctttatcgttacctgtgagcgagcaccatgcatttttgttcttgatagtcatatgcgtaatgaagctgttatctcgtgatgtagcagatgcggttctgcttattccttcgctaccatccattggaggccatccttcctgaccatttccatcattccagtcgaactcacacacgacaccatatgcatctaggtcgcttgaaattgctataagcacagcatgttgcgccagtatgattaatatgggggggcccgttacccaattcggcctatagagcgccgtattaccattcactggccgtccttttacaagcccccgatttggaaaaccctgttgttacccaatttaccgccttggggcccttcccccttttgccgcttggggaaataagaaaaaaggccctaaccggttccccttttccaaaatttgcccaccccgtatgtggaagggcaatttttatcccccaaattttggcaaaatccccgctccttttttgtttaaaaaccctctttttttaaacggagtgggcgaattcccaaatcccctttaatccccaaataaacaccgggattgccttctgctgtttccctatactcatataatgccccatactc

SEQ ID NO: 11175 - DNA, 827 bp, Zea mays
  misc_feature: Ceres CLONE 1355183-F
  misc_feature: Pfam Name: Ribosomal_L35Ae Pfam Description: Ribosomal protein L35Ae
cgggctgcaggcccccccccgctcagaaagagctgcataaacatcccccccccccccccggtaggaagataaagatgaattgtgaacctgacgacatgcgggaggaactacctttcttgcgatgcattgtctacgcctgggggaacatgcctccctgacatgaggccacaggcccaccatcacgagaccgccttgctcgctctatatcgagggcatttttcactcgaaggcataactgcatcgtgaatacactggttgccgcataggataacttctacattcgtatttgcgagccgcagcgagacccgctacaggtgcatctggggccaggtcacccgcccgcactataactcgggcgattaccgctccatgttcgagtccaaactcccgcctgagtgcatgagacctaaggtcacactgttcatgtacccgagcagcatctaacgtttgcctttgtgggaatataggaggactctacatgcccatggtcattccctctctctgagcttataaagtgatgagtgggaaactgaaatcgttaatgtactgatacaagtcgagttcaacttttgttagatcggctattgttttaaccattaggccaaaatcgggataatcccttattaatctcaagataaaccgagatagggattgagggttggtcccggttgccaaatgagccctattataaagaacgtgcattcccccggccagggtgtaaaaccgtcttttcaggggaaagcccctttcttcaactttaactctattcagacttctttctccttacggcacctaacatacacaacttgcaaccccccctgcatcct

SEQ ID NO: 11176 - DNA, 809 bp, Zea mays
  misc_feature: Ceres CLONE 1355192-F
  misc_feature: Encodes the peptide sequence at SEQ ID NO. 11177
gctctataactagtggatcccccgggctgcaggccccccgtttctgttcggacttccgccgcgcttcgccctctcgctccagccgcttcacagcgccgccgctcgcctctccgaccgccgcgagaatgccgttcaagaggttcgtggagatcgggcgcgtggccctggtgaactacggcaaagactatggccgcctcgtcgtcatcgtcgatgtgggcgaccagaacagggcacttgtggacgcccctgatatggtcaggtgccagattaacttcaaacggctctcacttactgacatcaagattgacatcacacgcgttcccaagaagtcaaccctgatcaaggctatggaggaagctgatgtgaagacgaagtgggaaaacagctcatggggcaagaagctgattgtccagaagaggagggctgcgctcagtgactttgacaggttcaaggtcatgctggcaaggatcaagaggggtggtgctatcaggcaagagctcgccaagctgaagaaggcgtccacggcttaagtcccttttggtggatggcatgttagtttttggattcatgttgcatcagcattttgatttgagtgctggccaacccagaattgaaactatgtttcatgtgtacccttttcaaacttctcaagaatgggtgtgctccgggaaaaacaagaagaaaaatttcgagagatgggcgggcacccactctccctatagggatccgataacccctccatggcccgcggtctgaaactttaccctggtaaatgccttcatatcacgaacaatcccgttagggcactc

SEQ ID NO: 11177 - protein, 134 aa, Zea mays
  misc_feature: Ceres CLONE 1355192-F
  misc_feature (44)..(120): Pfam Name: Ribosomal_L14e Pfam Description: Ribosomal protein L14
MPFKRFVEIGRVALVNYGKDYGRLVVIVDVGDQNRALVDAPDMVRCQINFKRLSLTDIKIDITRVPKKSTLIKAMEEADVKTKWENSSWGKKLIVQKRRAALSDFDRFKVMLARIKRGGAIRQELAKLKKASTA

SEQ ID NO: 11178 - DNA, 806 bp, Zea mays
  misc_feature: Ceres CLONE 1355203-F
  misc_feature: Translation starting site: 139
  misc_feature: SWISSPROT Homolog: EC 3.2.1.23 Beta-galactosidase
  misc_feature (227)..(227): n is a, c, t, g, unknown, or other
ggatcccccgggctgcagggagagagagcttactagtccccccccccccccccacgagtgttggggctgtcattatgggatttgagctcacttggtttctgtttaaatgtcagctgctgtggtttttttggtcactggatgactgctgctgttggctggtcaggtttgatatcgagaaatatccattgcattctgcgtttgaaaaaaaaaaaaaaaaaaactcgagnggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagatagaccgagattagggttgagttgttgttccagtttggaacaagagtccactattaaagaacgtggactccaacgtcaaagggcgaaaaaccgtctatcagggggatggcccactagtgaaccctccccctaatcaagtttttggggttcgagggcccccaaagccctaaatcgcaaccccaaaaggtcgcctccgtattataaccttcacgaaaaacgccggcacacgtggctaacaattacgtaaaacaccccacccccccg

SEQ ID NO: 11179 - DNA, 827 bp, Zea mays
  misc_feature: Ceres CLONE 1355220-F
  misc_feature: SWISSPROT Homolog: EC 1.11.1.7 Peroxidase
  misc_feature: SWISSPROT Homolog: EC 3.2.1.23 Beta-galactosidase
  misc_feature (827)..(827): n is a, c, t, g, unknown, or other
ctttactagtggatcccccgggctgcaggaagtctgctgccagagagagagagacagagatatacagctcagtactccccaccccccccaaagtctaaagtgcagcagtgggactaaaaggatagatacgagcactgagaccaaattgtgggaagatacctacacagacttttccattatgtacactctctgctattataaagcgccacgctacactgaggcagaatggaggatgaaattctactaagagacatgtcctcaagacgaaaacgtcctacgtagattacagcgactcctctacgaaatccttataaacacggctttctcctgcatccctaacatcatccatgactgctgcgatgatccatgtgatgcggcactttatgctgaattcgacaagaagagagctatgatagaaagaatgcgactggagcttccgacttataaactgttacgtacctggaggatatcaaggaaccgtctcgagggcggatacggtacccaaatcgccctatagcgagtcgtattacaattcactgcgacgcgatttacaacgtgatgactgaaaaaaccctgcggttacccaacttaatcgccttgcacgacatccccctttcgccagatggcgtaatagcccgagaggcccgcaccgatcgacctttcccaacagatgcgcacgctggaatggcgaatgacaaattgtaagaggtaaaattttgtttaattcgcggtaaacttttgctaagccagcgtcattttttaccaataggccgaatcggcaaagtccctttaatccaagaagcccccgttccggtaatacccccctn

SEQ ID NO: 11180 - DNA, 679 bp, Zea mays
  misc_feature: Ceres CLONE 1357045-F
  misc_feature: Encodes the peptide sequence at SEQ ID NO. 11181
agagctggagctccccgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgattgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtcttttttcgcctccgtgctctccgggctcttcggccaggccgaggccgaggacgaggacgaggacgaagagatgcccacgcgcaaccacaacgctgccgcggctgccgctccgcagcatcaccatcacaaccgaggtggtgctcccgctcttggaaagagcaaggccgtgcccggccgagctgatgccatgaaccggcgagcccccctcggcgatattggcaacctcgtcagcgtccgcccagccgaa

SEQ ID NO: 11181 - protein, 59 aa, Zea mays
  misc_feature: Ceres CLONE 1357045-F
MPTRNHNAAAAAAPQHHHHNRGGAPALGKSKAVPGRADAMNRRAPLGDIGNLVSVRPAE

SEQ ID NO: 11182 - DNA, 697 bp, Zea mays
  misc_feature: Ceres CLONE 1357053-F
  misc_feature: Encodes the peptide sequence at SEQ ID NO. 11183
  misc_feature (380)..(380): n is a, c, t, g, unknown, or other
  misc_feature (395)..(395): n is a, c, t, g, unknown, or other
  misc_feature (476)..(476): n is a, c, t, g, unknown, or other
tggagctccccgcggtggcggccgctctagaactagtggatcccccgggctgcaggaattcgcacgagaccattacctagaacatcctaatcgaaaaatctcttctgcctccgtctcaatctcgaccggtcaccccatctccaccgccacatccgtcgtcttccgccgccgccgatggcccgcctcctcacgcaaaccctcaccctagcccgccccgcctcctccccctccactaccgccgcatccgcttccctccgtggcctcgccaccaaggtcgagatcatcgagatcgatctcgccgaggaagacgctggctcctcgtcccacggctccccctcctcgtccccgtcggtcgaggcggtcgggatccggcgcctggnaggaggcatccacgncgtcatggtgcgccgcgccgcgcccgactggctcccctcgtggcgggagggcccttctggtgcccccgctgcgccgcccgnacgggtccgcaaggtcttggccggatcccgttgctggggccaccaaagggggccccgggcctttgggggcccgccaaatttttggatctcaccccccctgagggagaaaaagggtttttttccccccacccgggggggggcccccggccctttttcttggcaagggaaattcccccttttggaaaaaccgggagaggggcccccccccctgttgggaaaaa

SEQ ID NO: 11183 - protein, 99 aa, Zea mays
  misc_feature: Ceres CLONE 1357053-F
  misc_feature (26)..(26): Xaa is any aa, unknown, or other
MVRRAAPDWLPSWREGPSGAPAAPPXRVRKVLAGSRCWGHQRGPRAFGGPPNFWISPPLREKKGFFPPTRGGAPGPFSWQGKFPLLEKPGEGPPPLLGK

SEQ ID NO: 11184 - DNA, 698 bp, Zea mays
  misc_feature: Ceres CLONE 1357086-F
  misc_feature: Encodes the peptide sequence at SEQ ID NO. 11185
  misc_feature (417)..(417): n is a, c, t, g, unknown, or other
tggagctccccgcggtggcggccgctctagaactagtggatcccccgggctgcaggaattcgcacgagaccattacctagaacatcctaatcgaaaaaaagatggctgagtcctttgttctcaataccggctcgaggatcccatcggttgggcttggcgtatggcaaatacaacctgacgctgccaacgacgccatctacgctgctgtcaaggctgggtatcggcatattgactgtgcagcagcatacaacaatgagaaggaggtgggcctggctttgaagaaattatttgaagatggtgtggttaagcgtgatgatttgtttatcacctctaagctatgggctgctaatcatgcacctgaagatgtggaagagggaatcgacaccacactttcagatttgcagcttgactacttgnacttgtacctcatccatggtccaaatccgcatcaaaaaaagaactagcacgatgacccctgaaaactttcccctacagaaatccctgctacatgggcagcgatggaaaattatacgactctggaaaaggtcggggaatcgggggggagaacctccccttgaaaaaactgcatgaattcgtttcccttgcccaaaggcccccagaaacaaccaagttgaatggcatccggttgggaaaaaaaaaaactccggaaaattttcaaacccaggggggcccctttt

SEQ ID NO: 11185 - protein, 120 aa, Zea mays
  misc_feature: Ceres CLONE 1357086-F
  misc_feature (7)..(120): Pfam Name: Aldo_ket_red Pfam Description: Aldo/keto reductase family
  misc_feature: SWISSPROT Homolog: EC 1.1.1.2 Alcohol dehydrogenase (NADP(+))
  misc_feature (106)..(106): Xaa is any aa, unknown, or other
MAESFVLNTGSRIPSVGLGVWQIQPDAANDAIYAAVKAGYRHIDCAAAYNNEKEVGLALKKLFEDGVVKRDDLFITSKLWAANHAPEDVEEGIDTTLSDLQLDYLXLYLIHGPNPHQKKN

SEQ ID NO: 11186 - DNA, 706 bp, Zea mays
  misc_feature: Ceres CLONE 1357103-F
  misc_feature: Encodes the peptide sequence at SEQ ID NO. 11187
  misc_feature (268)..(268): n is a, c, t, g, unknown, or other
  misc_feature (397)..(397): n is a, c, t, g, unknown, or other
  misc_feature (469)..(469): n is a, c, t, g, unknown, or other
  misc_feature (470)..(470): n is a, c, t, g, unknown, or other
aaagctggagctccccgcggtggcggccgctctagaactagtggatcccccgggctgcaggaattcgcacgagaccattacctagaacatcctaatcgaaaaattccccacacgcgcccacctcctctgctctctcctctcccccacctctgcgtccgtgcgttgtggtttggtttaggcggcaaccgcgaggcgcaatggcggccgggcgagagctggtggtgagtttcggcgagatgttgatagacttcgtgcccaccgtggcggnggtctcgctggcggaggcgccggccttcctcaaggcgcccgggggcgcgcccgccaacgtcgccatcgcggtctcgcgcctcggcgggcggggccgcctttgtcggcaagctcggcgacgacgagttcngccgcatgctcgccgccatcctccgcgacacggggtcgacgacgggggggtcgtcttcaacttcgggggggnnacgggttcgcttcgtaacctgggggccaaggggaggccgagtcatgttttaccggaccccagggttgaatggtcctaccgccgaagagttcaaggggagttttttaaagggggtggggtcctcccctaagggataaaaagtttgtttggggagccggggggaaagaaattccggggaaggggaattgccaaaaagggggggcctttttttttttacccacaccgggggggggcttg

SEQ ID NO: 11187 - protein, 133 aa, Zea mays
  misc_feature: Ceres CLONE 1357103-F
  misc_feature: SWISSPROT Homolog: EC 2.7.1.4 Fructokinase
  misc_feature (24)..(24): Xaa is any aa, unknown, or other
  misc_feature (67)..(67): Xaa is any aa, unknown, or other
  misc_feature (91)..(91): Xaa is any aa, unknown, or other
MAAGRELVVSFGEMLIDFVPTVAXVSLAEAPAFLKAPGGAPANVAIAVSRLGGRGRLCRQARRRRVXPHARRHPPRHGVDDGGVVFNFGGXTGSLRNLGAKGRPSHVLPDPRVEWSYRRRVQGEFFKGGGVLP

SEQ ID NO: 11188 - DNA, 716 bp, Zea mays
  misc_feature: Ceres CLONE 1357109-R
  misc_feature (716)..(716): n is a, c, t, g, unknown, or other
cgattggggaccgggccccccctcgaggtcgacggtatcgataagcttttttttttttttttttgaggaaaatcttgaggttttgcctcctattatgtcagaatgcataagtatatcatccagaatcttgacaaacaaatttgtgggcgctcataaccataagccatacagcatagctgcataacacatacacacaacgtagcaataaataggagtaaaatgaaccatcttccgtcgtcagatactgtagcacgtttaggtgttaagattctggaacagctcaggcagatgggcattcgtgagcttggtccgttttgtgatctcacgctgcttcttcttgggcttagccttgggttttacgccattgatctgggcagctgctcgtcgtttggcagtattcgtcatgggcttgaaaccgtttttctgtagctccttctctatgtcgaccatgtcacgtggcagctctatttcacgggagagttgcttcaggtcatcatcaaccttgatctttgcttttggatcatttgggtatacaatggtcctcctgggaagtcatgtttgataacaagcaaacctccacagcagctttcaaagcctgcaaatcttccaaaaacattgaaaaatgcatccctgactcccaaaaaacaagaacttctgggaactttcttatcaaaacagcagctgaacttttcccttcagccaagcctggacttgan

SEQ ID NO: 11189 - DNA, 686 bp, Zea mays
  misc_feature: Ceres CLONE 1357126-F
  misc_feature: Encodes the peptide sequence at SEQ ID NO. 11190
aagctggagctccccgcggtggcggccgctctagaactagtggatcccccgggctgcaggaattcgcacgagaccattacctagaacatcctaatcgaaaaatacttttcctccttcagtttttatcacacgtcaatggagtggggctagcaatggcatggtaacttttccaatctttttgcattaaaaaagaaatcctaaagaaaaaggattactaaacgagcacgctcgccggcgctgggaccaggctctgggtctcgcatcacgatcagatccaatccaaggccgcgccccagcccggcggatggattccgccgccgtggccatcgtgacggtgccgttcccggcgcagggccacctgaaccagctgctgcacctgtccctgctcctggcatcgcgggggcttcctgtccacttcgccgcgccggagccgcacctccgggaggcccgcgcgcgcctgcacggctgggggcccgaccccgcgtcggtgtgcttcccgcgcgctggacgtgcccgcgaacgacttcccctccccggaccattctccccgttcccggagaaatggagcccctgttaaaggccttttgaaccggcggcggggcctccctaagccccgttcctggggaattggccgggccaacccccgcgtgttcggccctaaaacccgatggggggctttccggggt

SEQ ID NO: 11190 - protein, 90 aa, Zea mays
  misc_feature: Ceres CLONE 1357126-F
  misc_feature: SWISSPROT Homolog: EC 2.4.1.215 Cis-zeatin O-beta-D-glucosyltransferase
MDSAAVAIVTVPFPAQGHLNQLLHLSLLLASRGLPVHFAAPEPHLREARARLHGWGPDPASVCFPRAGRARERLPLPGPFSPFPEKWSPC

SEQ ID NO: 11191 - DNA, 835 bp, Zea mays
  misc_feature: Ceres CLONE 1357129-F
  misc_feature: Encodes the peptide sequence at SEQ ID NO. 11192
  misc_feature (36)..(36): n is a, c, t, g, unknown, or other
  misc_feature (39)..(39): n is a, c, t, g, unknown, or other
tggcgccgccccccccccccccagaccctataaaanaanaataacacaaaaactggaggtccccgcggtgggggccgctctataactaaggatcccccgggctggaggaattcgcacgagaccattacctacaacatcctaatcgaaaaagcctacaacaccctaatcgaaaactcactcgtagctcaggcgtcagcgcccaggagctctggcgagcgtgcgcacgtaggggtacctagctcgctctgctagtctaccatggatgatgaccaccggtgcgcgaaccgaggtgggggacgctacggcgacctccagcgcgggggcgggatgcacggcgaggcgcagcagcggcagaagcagggcgccatgatgacggcgctcaaggccgcgacggtcgcaaccttcggcaggtcggagctggagctgggcgggctgaatctgcccggcaccggggatcgcgctcacggggggccaagcgccgtgctgggtgatcttgcagcccggctgctgggtggccgcgccgcccatctccgtctggggatgatggacgctccggggcagcgatcagccttccgggcccgctccgggagagcgcaagccagcgggtcacaagcgccccctgggcgaggtaaaagtagctgggagcggggaggtaagcacgcccgttgaggccaggccccgctgcgggcggggggagaatagttggccttggagggccgcagggggttcgtacgggccccgggatggggtgctgtactagcgcgcctcaggaggcgggggctagggaagcgtaggtgaccccgccaggccccctcttaaagcgggcccgacggcg

SEQ ID NO: 11192 - protein, 136 aa, Zea mays
  misc_feature: Ceres CLONE 1357129-F
MDDDHRCANRGGGRYGDLQRGGGMHGEAQQRQKQGAMMTALKAATVATFGRSELELGGLNLPGTGDRAHGGPSAVLGDLAARLLGGRAAHLRLGMMDAPGQRSAFRARSGRAQASGSQAPPGRGKSSWERGGKHAR

SEQ ID NO: 11193 - DNA, 697 bp, Zea mays
  misc_feature: Ceres CLONE 1357141-F
  misc_feature: Encodes the peptide sequence at SEQ ID NO. 11194
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcgaaaattacctagaaacactcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcaggggcatggacgtcgtcaaggccatcgagaaggtgggcacccgcaacggctccacctccaaggtggtcaaggtcgctgactgcggacagctctcctagatctcntctgatctg

SEQ ID NO: 11194 - protein, 172 aa, Zea mays
  misc_feature: Ceres CLONE 1357141-F
  misc_feature (5)..(171): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MANPRVFFDMTVGGAPAGRIVMELYANEVPKTAENFRALCTGEKGVGKSGKPLHYKGSTFHRVIPEFMCQGGDFTRGNGTGGESIYGEKFPDEKFVRKHTAPGVLSMANAGPNTNGSQFFICTVATPWLDGKHVVFGQVVRGMDVVKAIEKVGTRNGSTSKVVKVADCGQLS

SEQ ID NO: 11195 - DNA, 681 bp, Zea mays
  misc_feature: Ceres CLONE 1357143-F
  misc_feature: Encodes the peptide sequence at SEQ ID NO. 11196
  misc_feature (384)..(384): n is a, c, t, g, unknown, or other
  misc_feature (404)..(404): n is a, c, t, g, unknown, or other
  misc_feature (448)..(448): n is a, c, t, g, unknown, or other
ggagctccccgcggtggcggccgctctagaactagtggatcccccgggctgcaggaattcgcacgagaccattacctagaacatcctaatcgaaaaatttctccacagcacgcacgcagcacccaacaacatacacaccacagaccaaaacgaccgccgcaccttcagcagcaaagtgtccaagcggcggcatggcagcgagcaaggcgcgtgtcgcgctgttcctggcggcgctcgcggtggcgagcctgctggcgctggccccggccccggccggcgccgcgacgacgtgcgcgccgacgcagctgaccccgtgcgcgcccgccatcgtcgggaacgcggcgcccaccgcggcgtgctgcgccaggctcaaggcgcacccgncgacctgctttctgcagtancagaggaaccccagcatgcagcgctacgtcaactccccaacggnaagaaaggtttccccgcctgtaaggtgtccctgcccaagggctgatgctgaaggattcctctgctgaagggctgccccgccaggccaaggcaaaccatggtggtcgaacgataaatcaaccaaccccggggccgggatgggccaaaaacttgggaccctttgggcaaaatttaaatttggccgaaaaaaataaaggggaaagggcccctccccgtttttgggaaagggggggg

SEQ ID NO: 11196 - protein, 107 aa, Zea mays
  misc_feature: Ceres CLONE 1357143-F
  misc_feature (65)..(65): Xaa is any aa, unknown, or other
  misc_feature (71)..(71): Xaa is any aa, unknown, or other
  misc_feature (86)..(86): Xaa is any aa, unknown, or other
MAASKARVALFLAALAVASLLALAPAPAGAATTCAPTQLTPCAPAIVGNAAPTAACCARLKAHPXTCFLQXQRNPSMQRYVNSPTXRKVSPPVRCPCPRADAEGFLC

SEQ ID NO: 11197 - DNA, 676 bp, Zea mays
  misc_feature: Ceres CLONE 1357161-F
  misc_feature: Encodes the peptide sequence at SEQ ID NO. 11198
  misc_feature (541)..(541): n is a, c, t, g, unknown, or other
  misc_feature (546)..(546): n is a, c, t, g, unknown, or other
  misc_feature (676)..(676): n is a, c, t, g, unknown, or other
tggagctccccgcggtggcggccgctctagaactagtggatcccccgggctgcaggaattcgcacgagaccattacctagaacatcctaatcgaaaaaacacgtgacaccccgcgcgcgcgcctccgccgcacgcccccactctctcaccgccaccgccgagatggccgcctgctcccacctcgccgccgcgggtggctcttcccctgccgccgccgcagtggttcgttccccggcgcattcctcagccgccgccgccttcgcgcgcctccggtcgacgctgcgtttctcgagcgccggcctgtcggttaagggaagcagggcgactttcccgtgggtcgccgccgcggggccggccgcggcggcgccggtggccgacctggacggccgcccagccacggagaagcagcccatcattgtcatcgataactacgacagcttcacctacaacctctgccagtatatgggggagcttggattgaacttcgaagtataccgcaatgatgaactgaccatagaagatgtaaagaggaaagaccccnagagnatacttattttctccagggctgggtgaacacaagattcagggatatcattgcagactgttcttgatttaggccaccatcccatttttcgaatttgcatgggctgcagtgcattggggaggatttgaagan

SEQ ID NO: 11198 - protein, 136 aa, Zea mays
  misc_feature: Ceres CLONE 1357161-F
  misc_feature: SWISSPROT Homolog: EC 4.1.3.27 Anthranilate synthase
  misc_feature (127)..(127): Xaa is any aa, unknown, or other
  misc_feature (128)..(128): Xaa is any aa, unknown, or other
MAACSHLAAAGGSSPAAAAVVRSPAHSSAAAAFARLRSTLRFSSAGLSVKGSRATFPWVAAAGPAAAAPVADLDGRPATEKQPIIVIDNYDSFTYNLCQYMGELGLNFEVYRNDELTIEDVKRKDPXXILIFSRAG

SEQ ID NO: 11199 - DNA, 648 bp, Zea mays
  misc_feature: Ceres CLONE 1357169-F
  misc_feature: Encodes the peptide sequence at SEQ ID NO. 11200
  misc_feature (594)..(594): n is a, c, t, g, unknown, or other
ggagctccccgcggtggcggccgctctagaactagtggatcccccgggctgcaggaattcgcacgagaccattacctagaacatcctaatcgaaaagatttcgaggtcggttttctgttgcacagggagaaaggtcacgtccaaccgccgcgaactgcgcatgtgaactgtgcccgacgaggcgcgcggcacgggtgaggggagctgcgccggagccccaggcctagggttttcaccgccctgccgcgagatggacgtccgggacctgcaccagcagccgcagcatcagcagcagcaggcgccgccgcgcgtgggatccccgccgcaggccggcgccggcggtgtcatgatgcagcataccgccgcgttcggctcggcggcgccgccgccgcccgggttgccgcaggcctcggcggccaacgttatgcacgggatgtcccttgcctttaaccctatggcttcgccggacgcctcgtcacccataagcagcatgaagattgtggacatgccgctggggtctatgtaccgccctgattccggcgcgacgggcttgcagcagcagcagcccggctccggtggcgttggtgccagcgntggtgctatcgtcgccgtcagcggcgggaaccttgtgaagaagaagagggggag

SEQ ID NO: 11200 - protein, 132 aa, Zea mays
  misc_feature: Ceres CLONE 1357169-F
  misc_feature (115)..(115): Xaa is any aa, unknown, or other
MDVRDLHQQPQHQQQQAPPRVGSPPQAGAGGVMMQHTAAFGSAAPPPPGLPQASAANVMHGMSLAFNPMASPDASSPISSMKIVDMPLGSMYRPDSGATGLQQQQPGSGGVGASXGAIVAVSGGNLVKKKRG

SEQ ID NO: 11201 - DNA, 656 bp, Zea mays
  misc_feature: Ceres CLONE 1357186-F
  misc_feature: Encodes the peptide sequence at SEQ ID NO. 11202
  misc_feature (199)..(199): n is a, c, t, g, unknown, or other
  misc_feature (227)..(227): n is a, c, t, g, unknown, or other
  misc_feature (275)..(275): n is a, c, t, g, unknown, or other
  misc_feature (276)..(276): n is a, c, t, g, unknown, or other
  misc_feature (279)..(279): n is a, c, t, g, unknown, or other
  misc_feature (296)..(296): n is a, c, t, g, unknown, or other
  misc_feature (306)..(306): n is a, c, t, g, unknown, or other
aaagctggagctccccgcggtggcggccgctctagaactagtggatcccccgggctgcaggaattcgcacgagaccattacctagaacatcctaatcgaaaatcgtctccactgctctgctgctcctcgcaccgccgccgccgccgccgcagcgacgtaatggcttccgccgcggtgctccggaacgccggctcccggngcctcttctccctacctactctccgcgncgctgcgatatatgtaccttctgcgctacccgatgcggccgcggcggnnggnagcggcggcccagccgncaacgaaggncgggacctctgggcgaaggctatgggcaacctcacgcgaacgaagccccatgtggatgtccggaccattggggaacgcggatatcgggaaaaacactctcactggtggcattaccaaagtcctgggcgaaggaaagggaagaccaaaacccctggtttttaacaagaattaccagggttcccgcgggagaaaaacccccagggattacccattggtggcagcgtcacctccgaggatgtagaacggggtaaaaaggctttttgctccccccttggatttgtcccccgccccccccaattaattgctaagaacaaggtcgcctgggggctgctcaaaggggaggggggggt

SEQ ID NO: 11202 - protein, 102 aa, Zea mays
  misc_feature: Ceres CLONE 1357186-F
  misc_feature (14)..(14): Xaa is any aa, unknown, or other
  misc_feature (23)..(23): Xaa is any aa, unknown, or other
  misc_feature (39)..(39): Xaa is any aa, unknown, or other
  misc_feature (46)..(46): Xaa is any aa, unknown, or other
MASAAVLRNAGSRXLFSLPTLRXAAIYVPSALPDAAAAXGSGGPAXNEGRDLWAKAMGNLTRTKPHVDVRTIGERGYREKHSHWWHYQSPGRRKGKTKTPGF

SEQ ID NO: 11203 - DNA, 668 bp, Zea mays
  misc_feature: Ceres CLONE 1357193-F
  misc_feature: Translation starting site: 248
  misc_feature: SWISSPROT Homolog: EC 2.7.11.1 Non-specific serine/threonine protein kinase
  misc_feature (266)..(266): n is a, c, t, g, unknown, or other
  misc_feature (464)..(464): n is a, c, t, g, unknown, or other
  misc_feature (528)..(528): n is a, c, t, g, unknown, or other
  misc_feature (537)..(537): n is a, c, t, g, unknown, or other
tggagctccccgcggtggcggccgctctagaactagtggatcccccgggctgcaggaattcgcacgagaccattacctagaacatcctaatcgaaaaaagccgccccactgttcctcctcgactccaagcaccgcgccggcagcgtgaggagaggggtcagggtgacgccgatgcaccccaagctgtcgcgggccgcccgcaggctcctctgctgcggcagggccgcctccccggaggacctatctgatgaaggaagtggatcatntgaggtgggtgttctcattgagagagcttcgatcagcaacaaacagcttcaattacgataacaagattggagaagggccacttggggagtgtgtattggggacaagtttgggatggttctcagatcgctgtcaagaggttgaagagtgcaaagaatggcacagaagcggaatttgcttcagaagtcgagatattgggnaagaataagacacaaaaacctcctggagttttcgtggatatttgtgcggatggacccgaacggnatttctggntgtatgactttatggcaaactcaagtctctatgcacatcttcatggacactttcctgctgagtgtctccttggactggccggagaagaatatctattgccataaacactgctcggggctctcttgtacctt

SEQ ID NO: 11204 - DNA, 667 bp, Zea mays
  misc_feature: Ceres CLONE 1357208-F
  misc_feature: Translation starting site: 215
  misc_feature: SWISSPROT Homolog: EC 5.4.2.1 Phosphoglycerate mutase
ctccccgcggtggcggccgctctagaactagtggatcccccgggctgcaggaattcgcacgagaccattacctagaacatcctaatcgaaaaattaatatcgccgcggcctcgcacctccatctgttctatatcgccccattgctcgctcgccaagagttcttcttgttaggcaaggcaaaagcagaagcaaaaaaagaaaggtcttgttgccgatggggagctcagggttctcgtggacgcttccggaccaccccaagctccccaaggggaaaccggtggctgtcgtcgtgctggacggatggggcgaggccaaccccgaccagtacaactgcatccatgtcgctcagactcctgtcatggactcgctaaagaatggccctcctgagaatgaagactagtgaaggctcatggaacagctgggggtctcccatctgatgatgacatgggcaacagtgaagttggccacaatggacttttgggggctgggcccaaatttttccccccagggggcttaacttgccgaatcagctcctgccccccggaaaaattagggggggaaaggggtccaaaaatcaaaaaaccttttgaaaagggaccctcccccttattggggttaaaaaaaaagggggggccccccccccgctttggaaaacgggaaaatttat

SEQ ID NO: 11205 - DNA, 660 bp, Zea mays
  misc_feature: Ceres CLONE 1357212-F
  misc_feature: Encodes the peptide sequence at SEQ ID NO. 11206
  misc_feature (509)..(509): n is a, c, t, g, unknown, or other
  misc_feature (531)..(531): n is a, c, t, g, unknown, or other
  misc_feature (540)..(540): n is a, c, t, g, unknown, or other
  misc_feature (637)..(637): n is a, c, t, g, unknown, or other
  misc_feature (638)..(638): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
tggagctccccgcggtggcggccgctctagaactagtggatcccccgggctgcaggaattcgcacgagaccattacctagaacatcctaatcgaaaaataaaaaaaactgagcctgcccgcccgcccgcccgcgcgctccgctccgtgaactatatctatctatcacctgctgctccaaggaggcggacagaggcaggcaggaaggcactcacttctccaggagctcggagtcggcagcaagagagaatggccgccgacgccgccgccgccgccacccttcgtactgctctctcccaaggtctggtgctgtggcatgtttagtgcaatcttcattgcttgctgtcttgctgcatttaacacagcacgagcttcagagaatagtccaagcctatctgtgttgccaagagatctcatccaaggtttacggcaatgaaccatttctaaagcacaaagacgtgatgtctttatcaattcatcaggagagcaaatggcgtcaacaggaggtcancgacgagcggttcgtcgactancccgagganggtcatcgacgtgtacaagctctggcgcccgacgcccctgatcagggcccaggagggctggagaagctgctcgggcacgccggcgaaatctacaacnnagtacgaggacccnnnnccccg

SEQ ID NO: 11206 - protein, 67 aa, Zea mays
  misc_feature: Ceres CLONE 1357212-F
  misc_feature (17)..(17): Xaa is any aa, unknown, or other
  misc_feature (24)..(24): Xaa is any aa, unknown, or other
  misc_feature (27)..(27): Xaa is any aa, unknown, or other
  misc_feature (60)..(60): Xaa is any aa, unknown, or other
  misc_feature (65)..(65): Xaa is any aa, unknown, or other
  misc_feature (66)..(66): Xaa is any aa, unknown, or other
MSLSIHQESKWRQQEVXDERFVDXPEXGHRRVQALAPDAPDQGPGGLEKLLGHAGEIYNXVRGPXXP

SEQ ID NO: 11207 - DNA, 659 bp, Zea mays
  misc_feature: Ceres CLONE 1357216-F
  misc_feature (327)..(327): n is a, c, t, g, unknown, or other
  misc_feature (450)..(450): n is a, c, t, g, unknown, or other
  misc_feature (479)..(479): n is a, c, t, g, unknown, or other
ggagctccccgcggtggcggccgctctagaactagtggatcccccgggctgcaggaattcgcacgagaccattacctagaacatcctaatcaaaaaactcgcacggacgagcgaggcagccccgcagggcgcagccacaacccaagcgcagcgatctacctccgctccggctcagctcccgccctgcctccgccttccattccgccgcgcggggctgccgagtgccgacgtcgtccccgccggagtttctggtttctgagttgcatctctcgcagtcggagcgagcgatgatgagcgtcggcaacgttgaaaccacccagctgaggnagccactgctgtcgaataaggcgaaggtgtaacgtcctacgtgccccggctggcggatgtaccgcctccacgcggagtggaagggggtcttccttcgtcaggacctctcctcatttggctcgncaccatcacctgcaccctggcggaccagnccctggtccccttcctggaattcctggaaagggatccggctaatggctaaaacaaaccaaaaactgggatttaaggcggggttttggggggcttacaaaaggggggggaggggaatcccccccaagaaatgggaaaccggggttgaaaaatgggagggaaacccttttcccccttggccc

SEQ ID NO: 11208 - DNA, 539 bp, Zea mays
  misc_feature: Ceres CLONE 1357245-F
  misc_feature: Encodes the peptide sequence at SEQ ID NO. 11209
  misc_feature (276)..(276): n is a, c, t, g, unknown, or other
  misc_feature (307)..(307): n is a, c, t, g, unknown, or other
  misc_feature (321)..(321): n is a, c, t, g, unknown, or other
  misc_feature (401)..(401): n is a, c, t, g, unknown, or other
aaagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcagtgctgctacggcgaccatttcccgcatgctcgcagctcctatagcttcccttcttccccgtactctcnacagcggtgtcttcggtatgtgaaaacccanttcttcaccctacnggatccaacaaggcatcacagctggcatcttaactttatcacccttggttctcccaacatcatcaagcctattaatcagntacctttggggcattaattggacaaaacattcggggacaaaaattacccaaattggggtatgaaaacttgggtggctaattcagaaaaaggaagtttctttctttaaccaactaactgggattgaacctcgcttctta

SEQ ID NO: 11209 - protein, 30 aa, Zea mays
  misc_feature: Ceres CLONE 1357245-F
MAAKIFCLLMLLGLSAVLLRRPFPACSQLL

SEQ ID NO: 11210 - DNA, 649 bp, Zea mays
  misc_feature: Ceres CLONE 1357269-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (309)..(309): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctggggctccccgcggtggcggccgctctagaactagtggatcccccgggctgcaggaattcgcacgagaccattacctagaacatcctaatcgaaaaagcatagtacgatttagggtttccttaccttacaagctttttcttccgccgccgcctcagccctcgccccgcgctgctgtactctctcacctcctttcgcgntgtctaccagatcatcccatgggcgtcgaaaagaagcagtcgaaccccgatgcggggagatgaagtccagaagctcgtggtcaacatcttcgtcggggaagagcggggattgccttacccggggccgccaaggactgggggaaattaaggggccagtcacccggtttcccccaaggaaaggaaccttgggagggggccttgtggaatcccggggcaatggaaaaaaacccctgtttttttgacccggggcggggggagaaaaaaccaacgcgccttcttgggaagaggggttttaaaggggaaaaaaaaaaccccctccctgggtgaaggggaaaatttt

SEQ ID NO: 11211 - DNA, 659 bp, Zea mays
  misc_feature: Ceres CLONE 1357282-F
  misc_feature: Encodes the peptide sequence at SEQ ID NO. 11212
  misc_feature (394)..(394): n is a, c, t, g, unknown, or other
  misc_feature (395)..(395): n is a, c, t, g, unknown, or other
  misc_feature (542)..(542): n is a, c, t, g, unknown, or other
  misc_feature (600)..(600): n is a, c, t, g, unknown, or other
  misc_feature (634)..(634): n is a, c, t, g, unknown, or other
  misc_feature (656)..(656): n is a, c, t, g, unknown, or other
tggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggttggcgacgctgttcccgctgggcgggctgctgctggtgtggnntcggggctgggcgctgacggcctccgtgggggtgggggctggccgtggccacacgcccggtggttcctgatcttcagcccccgtggctggtccccgccgcgctggctcatcgggacggccgggtcatggggtcccttcacgtcgggncgcgctgggggggcttcggggggcctgtccctcgctcacgtgcctcgccaacacggcngccggcaggcgttccagcgcacccgggacttaangtggaggaggcgcaccgcaggnaag

SEQ ID NO: 11212 - protein, 153 aa, Zea mays
  misc_feature: Ceres CLONE 1357282-F
  misc_feature (65)..(65): Xaa is any aa, unknown, or other
  misc_feature (134)..(134): Xaa is any aa, unknown, or other
  misc_feature (145)..(145): Xaa is any aa, unknown, or other
MADRDRSGIYGGAHATYGQQQQQGGGGRPMGEQVKGMLHDKGPTASQALTVGDAVPAGRAAAGVXSGLGADGLRGGGGWPWPHARWFLIFSPRGWSPPRWLIGTAGSWGPFTSGRAGGASGGLSLAHVPRQHGXRQAFQRTRDLXWRRRTAGK

SEQ ID NO: 11213 - DNA, 670 bp, Zea mays
  misc_feature: Ceres CLONE 1357294-F
  misc_feature: Encodes the peptide sequence at SEQ ID NO. 11214
  misc_feature (541)..(541): n is a, c, t, g, unknown, or other
  misc_feature (641)..(641): n is a, c, t, g, unknown, or other
aagctggagctccccgcggtggcggccgctctagaactagtggatcccccgggctgcaggaattcgcacgagaccattacctagaacatcctaatcgaaaactcgaaaccctagcgccggcgcctccacttcgttttcctcactctctcctccagctcagggtccggcggcgaagggaaggcaagatgtacaccgcgaggaagaagatccagaaggagaagggccttgagccctccgagttcgaggactccgttgcccaggctttctttgatctggagaacgggaaccaggagctcaagagcgacctcaaggacctgtacatcaacaatgctatccagatggatgttaccgggagcaggaaggctgttgtcatccacgtcccataccgcctgcgcaaggccttcaggaagatccatgtcagactcgtcagggagctggagaagaattcagcggcaaggatggtggtaattgttgctacaaggaggattgtgaggcaccccaagagggggttcagctgttctgcgccctcgcaccaggactnctgactgctgttccgatgcatccttgggggaaggatggtgtctaccccagctgagattgggggggaaagcgtgtcagaaaccccggtctggatggttccnagaattatccaaagattttcttggacccc

SEQ ID NO: 11214 - protein, 118 aa, Zea mays
  misc_feature: Ceres CLONE 1357294-F
  misc_feature (6)..(118): Pfam Name: Ribosomal_S7e Pfam Description: Ribosomal protein S7e
MYTARKKIQKEKGLEPSEFEDSVAQAFFDLENGNQELKSDLKDLYINNAIQMDVTGSRKAVVIHVPYRLRKAFRKIHVRLVRELEKNSAARMVVIVATRRIVRHPKRGFSCSAPSHQD

SEQ ID NO: 11215 - DNA, 670 bp, Zea mays
  misc_feature: Ceres CLONE 1357298-F
  misc_feature: Encodes the peptide sequence at SEQ ID NO. 11216
  misc_feature (300)..(300): n is a, c, t, g, unknown, or other
  misc_feature (335)..(335): n is a, c, t, g, unknown, or other
  misc_feature (365)..(365): n is a, c, t, g, unknown, or other
  misc_feature (366)..(366): n is a, c, t, g, unknown, or other
tggagctccccgcggtggcggccgctctagaactagtggatcccccgggctgcaggaattcgcacgagaccattacctagaacatcctaatcgaaaaataggaaaaacgactccacacggtccacggcgtcgtctccggcgaaccttcgcgagccctcggctcccctctaccaccgctgccgcgaccccgcctacggagcatcctcgggtagcgctctggcttcccgtgccggcggacgtcctgcaggaggcggcggcctccgtggcatgttgatgagggccgccgctgccctccctcgncgatcgtcgcggccctcggagccggggtcctcccntcctcccgggctccccgcccctgggggccnntcctccagccggggtctggcccccggggctccttcgaccccttcgatgtcgatacgaccccgcatcgcggttgagctgacgccgaacaaatcgggctctgcggtgacggctcggggatttcgagacaagggaaacgccccgaatgacttggcccaaaaattcaaaaccccccgggttcgggatttaaccttggaaacgccgcggggggcctccttaccctgggaaataaggaaaaacccgaaatttgggggggcgtccctttgggggaacacaggagaaatataaaaccccccgacgccccccc

SEQ ID NO: 11216 - protein, 127 aa, Zea mays
  misc_feature: Ceres CLONE 1357298-F
  misc_feature (23)..(23): Xaa is any aa, unknown, or other
  misc_feature (33)..(33): Xaa is any aa, unknown, or other
MLMRAAAALPRRSSRPSEPGSSXPPGLPAPGGXSSSRGLAPGAPSTPSMSIRPRIAVELTPNKSGSAVTARGFRDKGNAPNDLAQKFKTPRVRDLTLETPRGASLPWEIRKNPKFGGASLWGNTGEI

SEQ ID NO: 11217 - DNA, 671 bp, Zea mays
  misc_feature: Ceres CLONE 1357308-F
  misc_feature: Encodes the peptide sequence at SEQ ID NO. 11218
  misc_feature (264)..(264): n is a, c, t, g, unknown, or other
  misc_feature (296)..(296): n is a, c, t, g, unknown, or other
  misc_feature (325)..(325): n is a, c, t, g, unknown, or other
  misc_feature (326)..(326): n is a, c, t, g, unknown, or other
  misc_feature (353)..(353): n is a, c, t, g, unknown, or other
  misc_feature (405)..(405): n is a, c, t, g, unknown, or other
  misc_feature (409)..(409): n is a, c, t, g, unknown, or other
  misc_feature (485)..(485): n is a, c, t, g, unknown, or other
tggagctccccgcggtggcggccgctctagaactagtggatcccccgggctgcaggaattcgcacgagaccattacctagaacatcctaatcgaaaaagaccttctttcggtcccgtcctttcccctgcgcgccgcgagtgaattccggagtccccaatctatccgacgccacacgaaacgaaacacaagagaagagagaagagaatagagagaaagtcgaagggctagacccggtcccccaattccaattcgcccctctcgcnggcggcctcgcgagacgccgatttcgatcccnatctctgctcagagcctcgattcgacggnncggggggcgacgattcgaccgggtcgntaaccaggcaaaagcagcggaaggaaaagatgagcttcccagacctggagcngggnacgtccgcggggggcccttcggggggggccggagaaaaggaggggccccggggggcggggggggcccgggccccgncttttaaaaactggggggtgggggttttcaaaaaaaaacgcggggtggacattttaaaggtccttaaaaaggttgggggccccagaaaacccccccccccggggggggatataaaacgggggacaccaaaccatcggggggggggtcctcaaaaagttaataacgtggggggggggtgtctttgtt

SEQ ID NO: 11218 - protein, 96 aa, Zea mays
  misc_feature: Ceres CLONE 1357308-F
  misc_feature (8)..(8): Xaa is any aa, unknown, or other
  misc_feature (35)..(35): Xaa is any aa, unknown, or other
MSFPDLEXGTSAGGPSGGAGEKEGPRGAGGARAPXFKNWGVGVFKKKRGVDILKVLKKVGGPRKPPPPGGDIKRGTPNHRGGGPQKVNNVGGGCLC

SEQ ID NO: 11219 - DNA, 634 bp, Zea mays
  misc_feature: Ceres CLONE 1357331-F
  misc_feature: Encodes the peptide sequence at SEQ ID NO. 11220
  misc_feature (453)..(453): n is a, c, t, g, unknown, or other
  misc_feature (601)..(601): n is a, c, t, g, unknown, or other
aaagctggagctccccgcggtggcggccgctctagaactagtggatcccccgggctgcaggaattcgcacgagaccattacctagaacatcctaatcgaaaaacaaaatttctctacttttcttcgaccgtcctaccctatccgctcccctcgccggcgccgcggcggcggcgagaaagagagaacgcgctcctcttccttctcgactcgatctgccccttccagcccgctcgcccctcatcgagcggcctccgtagccctaggtgatccgcgcctccttccgccgcagcggaacaggacgcctgaccgtcgaccgtcgaagcgattcctctctcgcgggcgtcctcgtctcgccctcctcgcctcctcggtgccagtgggtcggcgcggggaggcatccgtccgggctacggtcgatttgttctccacttgctgttgaactttaaatagacnatggatctggagacagaaaatcgtcttgcttctttactacttgaagaggcccgaagattacaattagaggtaaacaaggggaaggtgttcaagcatatctgcgaaaacctaatgttaggcatcgccccaaactctcggttctcacagncacagggttttcgtgggagttcagcagcaaatc

SEQ ID NO: 11220 - protein, 60 aa, Zea mays
  misc_feature: Ceres CLONE 1357331-F
  misc_feature (50)..(50): Xaa is any aa, unknown, or other
MDLETENRLASLLLEEARRLQLEVNKGKVFKHICENLMLGIAPNSRFSQXQGFRGSSAAN

SEQ ID NO: 11221 - DNA, 670 bp, Zea mays
  misc_feature: Ceres CLONE 1357341-F
  misc_feature (356)..(356): n is a, c, t, g, unknown, or other
  misc_feature (369)..(369): n is a, c, t, g, unknown, or other
  misc_feature (384)..(384): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattnggcagaacatggntggcgccgctcctgntgctcaacctcatcatgaacatcatcgtcatcgggttcgcgagctggaacctgaaccctttcattagggggaaacaattaacccgcggggggcgaaaaggggcgaagttaaattttcggggtccccccgggccccccgttgggggggcccccgcccaaaatgggggggggggaaccagtgggggcgtgggggcaaaaatggggacaacaaaacggggggggtttttacccggggggccacaggggtttccttttgggggggctggaggaagaacccctcgggcgcc

SEQ ID NO: 11222 - DNA, 656 bp, Zea mays
  misc_feature: Ceres CLONE 1357357-F
  misc_feature: Encodes the peptide sequence at SEQ ID NO. 11223
  misc_feature (595)..(595): n is a, c, t, g, unknown, or other
tggagctccccgcggtggcggccgctctagaactagtggatcccccgggctgcaggaattcgcacgagaccattacctagaacatcctaatcaaaaacccttttccaccccgccgccgaagccaccgtgccgctagccttccccgccgccgcaaaatggccgcctccgcgcgacccctggttaccgtgagggccctggagggcgacatggccacggactccgccggtgttccgctggcggacgtcctccgcgcaccgatccgcccggacatcgttcgcttcgtccacaagctcctgtcctgcaacagccgccaaccctatgcggtgtcgcgtcgcgccggacaccagacctccgcggagtcctggggcacggggcgtgcggtatcccgtatcccccgcgttcctggcggtggtacccaccgcgccggccagggagcgttcggaacattggtggtcgtgggtggacgcatgttcgcgcccaccaagatctggcgccgctggcaccgtcgcgtcaaatacaccttcgccgtgtcgccatcgcctccgcactctccgccaccggcgttccgtcccttgttctcgcacgtggacaccgnctgtggagtctgtgcccgagctcccgctgggtcggttcgggactccgcggagtccagttga

SEQ ID NO: 11223 - protein, 166 aa, Zea mays
  misc_feature: Ceres CLONE 1357357-F
  misc_feature (23)..(162): Pfam Name: Ribosomal_L4 Pfam Description: Ribosomal protein L4/L1 family
  misc_feature (147)..(147): Xaa is any aa, unknown, or other
MAASARPLVTVRALEGDMATDSAGVPLADVLRAPIRPDIVRFVHKLLSCNSRQPYAVSRRAGHQTSAESWGTGRAVSRIPRVPGGGTHRAGQGAFGTLVVVGGRMFAPTKIWRRWHRRVKYTFAVSPSPPHSPPPAFRPLFSHVDTXCGVCARAPAGSVRDSAESS

SEQ ID NO: 11224 - DNA, 658 bp, Zea mays
  misc_feature: Ceres CLONE 1357360-F
  misc_feature: Translation starting site: 142
  misc_feature: Pfam Name: Peptidase_M20 Pfam Description: Peptidase family M20/M25/M40
  misc_feature: SWISSPROT Homolog: EC 3.5.1.14 Aminoacylase
  misc_feature (261)..(261): n is a, c, t, g, unknown, or other
  misc_feature (406)..(406): n is a, c, t, g, unknown, or other
  misc_feature (435)..(435): n is a, c, t, g, unknown, or other
  misc_feature (438)..(438): n is a, c, t, g, unknown, or other
tggagctccccgcggtggcggccgctctagaactagtggatcccccgggctgcaggaattcgcacgagaccattacctagaacatcctaatcgaaaacactcgccgcggctaacccagctcccagcccccgtctcgtcgccatgggaaccaggaatcttacgcggaaccgcgccgcttccatgggcgacgcatccactacgctgctcctctcccttgccttcctcgccttcgcctgggcggcgtcgccgtcgccggatgcnggagcgatctccccggtccaggagtacctccgcatcgacacggcgcagccggcgccagaatacgccgcggccgtggccttcctccggaaacaggccgccgaggctggactcgaggcgcgcacgcttgagctcgtcgccggggagnccctgctgctgctgcggtggcccggtcgnggnccgtccctcccctccatactcctcaactcccacactgacgtggtggcgtcggaagccgaacaagtggaaccacccgcccttttccgccgccctcgatgagccatcgggtcgcatctacgcggggaggttccaaggacatggaatggggtggggatgcagtacctttggaaccattcgcggtctccgttctgagggatttgttcagaaccaaaaatcaatt

SEQ ID NO: 11225 - DNA, 642 bp, Zea mays
  misc_feature: Ceres CLONE 1357362-F
  misc_feature: Encodes the peptide sequence at SEQ ID NO. 11226
  misc_feature (642)..(642): n is a, c, t, g, unknown, or other
tccccgcggtggcggccgctctagaactagtggatcccccgggctgcaggaattcgcacgagaccattacctagaacatcctaatcgaaaaatcctgccttcggaagccactgctaaccgctttctctgcccttctctacctacataagcgcgagggagcacgcctcccggcctctcctcatccaattcctatgccctgcacccgcagacggggagctcgcgtcttccttcggatggtggatgcatgcatgcatgacacgccggcccaaccagaattgacaagtggaagcgtatgggtattaccagcaacgacgcggcccctcgtgccgtcctcctccgcttcttgtttctgctctgcataggctgcaaatgcctggcatcagaggtagaggccacccagacggcgaccctcgcggtggacgcctcgccgcagcttgctcggaagatccctgatacactgttcgggatcttctttgagatcaaccatgcaggggctggtggcatatgggctgaacttgttagtaacagagggtttgaagctggaggcctccatactccatcaaacattgacccatggtccatcattggagacgactcctctgtatttgtggagaccgatcgcacatcatgtttcagtcgaan

SEQ ID NO: 11226 - protein, 116 aa, Zea mays
  misc_feature: Ceres CLONE 1357362-F
  misc_feature: SWISSPROT Homolog: EC 3.2.1.55 Alpha-N-arabinofuranosidase
MGITSNDAAPRAVLLRFLFLLCIGCKCLASEVEATQTATLAVDASPQLARKIPDTLFGIFFEINHAGAGGIWAELVSNRGFEAGGLHTPSNIDPWSIIGDDSSVFVETDRTSCFSR

SEQ ID NO: 11227 - DNA, 664 bp, Zea mays
  misc_feature: Ceres CLONE 1357371-F
  misc_feature: Encodes the peptide sequence at SEQ ID NO. 11228
  misc_feature (643)..(643): n is a, c, t, g, unknown, or other
tggagctccccgcggtggcggccgctctagaactagtggatcccccgggctgcaggaattcgcacgagaccattacctagaacatcctaatcgaaaaatcttgctctgaacgcattcctcccatctcccaagacctcctcagacccgagaagcgcatctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgccccacggcggcgtgttgcccaacatcaccccggtcctgctgcccaagaagacggggggagaaggcgtccagcggcgggaagcaaggagggccagtccgcccagaaaggccgcagtccccagaaagggntatagggtttggagcgggaac

SEQ ID NO: 11228 - protein, 159 aa, Zea mays
  misc_feature: Ceres CLONE 1357371-F
  misc_feature (31)..(104): Pfam Name: Histone Pfam Description: Core histone H2A/H2B/H3/H4
MDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLTGVTIAPRRRVAQHHPGPAAQEDGGRRRPAAGSKEGQSAQKGRSPQKG

SEQ ID NO: 11229 - DNA, 636 bp, Zea mays
  misc_feature: Ceres CLONE 1357375-F
  misc_feature: Translation starting site: 214
  misc_feature: SWISSPROT Homolog: EC 1.2.1.3 Aldehyde dehydrogenase (NAD(+))
  misc_feature (282)..(282): n is a, c, t, g, unknown, or other
  misc_feature (395)..(395): n is a, c, t, g, unknown, or other
  misc_feature (413)..(413): n is a, c, t, g, unknown, or other
  misc_feature (414)..(414): n is a, c, t, g, unknown, or other
  misc_feature (431)..(431): n is a, c, t, g, unknown, or other
tggagctccccgcggtggcggccgctctagaactagtggatcccccgggctgcaggaattcgcacgagaccattacctagaacatcctaatcgaaaaaagaatcagagacgagtcgagtgaggggcagaggccacaaaacagaggtacccaaacgatcgatctgtgcatctccccgtccgtcccgcaaccatctgattcataagcacacatcaatgccgagcaacggctgcaacggtaacggcaatgcggagccggcgggtgtggtggtgcccgaaataaangtcaccaagctcttcatcaacggcgagttcgtcgacgccgacctcgtcaagacatacgataccatggacctacggaccgtcgacgtgctggcccaccgtagcagagtcagacntagctgatgtggacctgnnggtcaagtccgcccgtnacgtcttcgagcacggcaagtggcccgcatgccaggctacaagcgcgggcggaatatgaccaagctggcggacctggtggaccaacaaccggaggatttgggagctttggacggtgcccaaacccgaaaattggttgttgttggaaaaaaaaatcaaaattccccgggccacgaaaatgttgggatacttaccccggggccgcca

SEQ ID NO: 11230 - DNA, 661 bp, Zea mays
  misc_feature: Ceres CLONE 1357378-F
  misc_feature: Encodes the peptide sequence at SEQ ID NO. 11231
  misc_feature (530)..(530): n is a, c, t, g, unknown, or other
  misc_feature (620)..(620): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaatcgaaaagtaaaccacactccactccagcactgaacacttgattgattcaacgagtagctagctagctgaatcacaatggatcctaccaagttccgtccgtccagcagccacgacacgacggtgacgacgacaaacgcggtcgctcctgtgtgtaacgaccacgaggcgctgactgtggggcctcgcggtcccatcctgctggaggactaccacctgatcgagaaggtggcgcacttcgcgcgcgagcgcatcccggagcgcgtggtgcacacgcgcggggcctccgacaaggtcttcttcgagtgcacccacgacgtgacgtcgctgacgtgcgccgacttcctgcgcgcgcccggagtgcgtacgcccgtgatcgtgcgcttctcgacggtgatcatcgagcgcgagtccccggagacgaccgcgacccgcgngtgtttcgccgcgtagttctacacccgcgagggtcactgtggacctgctgtgaactacttccacgtcttctgcatccgcgacagctcagntttcccccgacgggatccacgcgttcagnccccacctgcgt

SEQ ID NO: 11231 - protein, 124 aa, Zea mays
  misc_feature: Ceres CLONE 1357378-F
  misc_feature (18)..(125): Pfam Name: Catalase Pfam Description: Catalase
  misc_feature: SWISSPROT Homolog: EC 1.11.1.6 Catalase
  misc_feature (120)..(120): Xaa is any aa, unknown, or other
MDPTKFRPSSSHDTTVTTTNAVAPVCNDHEALTVGPRGPILLEDYHLIEKVAHFARERIPERVVHTRGASDKVFFECTHDVTSLTCADFLRAPGVRTPVIVRFSTVIIERESPETTATRXCFAA

SEQ ID NO: 11232 - DNA, 640 bp, Zea mays
  misc_feature: Ceres CLONE 1357381-F
  misc_feature: Encodes the peptide sequence at SEQ ID NO. 11233
  misc_feature (640)..(640): n is a, c, t, g, unknown, or other
tccccgcggtggcggccgctctagaactagtggatcccccgggctgcaggaattcgcacgagaccattacctagaacatcctaatcaaaaaactgcctacgatagcagcagcggcaccggccgcataagtaggttgggggggagggctggagtgcgcttcaagcacgagagcgctgttgctgcgtctgaaccgatcccattatttgtttggtttcgctgtacgagcgatctctctcctggccgggctccggcacgttgtaatattcggccttctcggagcagcagcaacttgttcttgtgcactgctacttccctgctctgggccgtttgccgttgctgctgcggacaagtatgggatagcgctgctgtgctgagcagttcttgcttcttacaactggtagtggtgctctgctctccgtgtgagcatttgacctagaagagcgtgaagctgtgcggctcttctttcgtattcaagatgaagttcatgaagcttggatcgcatcctgatacctttcacgacgatgggaatgaagtcagtattgcggcatctgaattgctgagcgacatcactgttcgtatagggactacgaagctttaccttcacaagtttccgctcctctccagtgtgctcgctttcaan

SEQ ID NO: 11233 - protein, 54 aa, Zea mays
  misc_feature: Ceres CLONE 1357381-F
MKFMKLGSHPDTFHDDGNEVSIAASELLSDITVRIGTTKLYLHKFPLLSSVLAF

SEQ ID NO: 11234 - DNA, 652 bp, Zea mays
  misc_feature: Ceres CLONE 1357386-F
  misc_feature: Encodes the peptide sequence at SEQ ID NO. 11235
  misc_feature (458)..(458): n is a, c, t, g, unknown, or other
  misc_feature (515)..(515): n is a, c, t, g, unknown, or other
  misc_feature (524)..(524): n is a, c, t, g, unknown, or other
  misc_feature (646)..(646): n is a, c, t, g, unknown, or other
  misc_feature (652)..(652): n is a, c, t, g, unknown, or other
tggagctccccgcggtggcggccgctctagaactagtggatcccccgggctgcaggaattcgcacgagaccattacctagaacatcctaatcgaaaaacgagtagacgggcaggacaggacaagggaggaacggcggcggcggcgcagggcagggtaaaccatggcggcatcggctaagggacggctcgtgcccgtgctcgcggtggcggcggcgctcgcggccgtgctcctctaccgcgcgcccttctccaagagcttgggcggccaagggtgcagcctcctcccgcacgaccacttctggatcgccagcgaccgcgtcgtcacgctcggacgcgtcggccccgccgcagtagaggtcaaaggagggctcatcaacgccatcgccgtcggggactaccggagcttcgtgctccgccgaccgctccttgactacggggacgccgtcatcatgcccggnctcatcgacgtgcatgcccatctggatgagcctggacgtgccgagtggggaagcttnctccatggncacagagcagctgcggcatgtgggataacgacgctggtggatatgcccactcacagcttccccgtcacagtctctgaagaactctcaaactgaagctggaagcagctcggataactatatgntgtggn

SEQ ID NO: 11235 - protein, 151 aa, Zea mays
  misc_feature: Ceres CLONE 1357386-F
  misc_feature: SWISSPROT Homolog: EC 3.5.2.5 Allantoinase
  misc_feature (118)..(118): Xaa is any aa, unknown, or other
MAASAKGRLVPVLAVAAALAAVLLYRAPFSKSLGGQGCSLLPHDHFWIASDRVVTLGRVGPAAVEVKGGLINAIAVGDYRSFVLRRPLLDYGDAVIMPGLIDVHAHLDEPGRAEWGSXLHGHRAAAACGITTLVDMPTHSFPVTVSEELSN

SEQ ID NO: 11236 - DNA, 619 bp, Zea mays
  misc_feature: Ceres CLONE 1357388-F
  misc_feature: Encodes the peptide sequence at SEQ ID NO. 11237
  misc_feature (200)..(200): n is a, c, t, g, unknown, or other
  misc_feature (205)..(205): n is a, c, t, g, unknown, or other
  misc_feature (288)..(288): n is a, c, t, g, unknown, or other
  misc_feature (291)..(291): n is a, c, t, g, unknown, or other
  misc_feature (336)..(336): n is a, c, t, g, unknown, or other
  misc_feature (337)..(337): n is a, c, t, g, unknown, or other
  misc_feature (394)..(394): n is a, c, t, g, unknown, or other
  misc_feature (395)..(395): n is a, c, t, g, unknown, or other
  misc_feature (510)..(510): n is a, c, t, g, unknown, or other
aagctggagctccccgcggtggcggccgctctagaactagtggatcccccgggctgcaggaattcgcacgagaccattacctagaacatcctaatcaaaaagttagtagttcaccagagttcacacaaaaatcacaagcaagcagtcgcgtgtgtagctcgcaacaatggcgacgaaccccggcctcttcaccgagtggncgtgnaaagagctcggcaacttcaagtacctgctgctgggcgcgtgggtggcgcacggcggctaccaagcgcgaccagggggtgaggncgnccgacctggggtacgtggccatcctcccgtcgctgctcctccggnngctgacaaaccagcgtggatcaccgccgtcccgctggaaagagcgcgcggccggggnnaagtcctggaccccggaatccaatccaagaagtgggaccccgaagccacttggaacaacaaattctggtcaagggaatcctcctgttactggtcacaacccgggggggggggggnagaacaccccccctttgggggggggggagggggcccccctttatttccctggtgtaaggccgggcccccccgaagttttcaaaaaaattggtgggtcccccgggcttcc

SEQ ID NO: 11237 - protein, 151 aa, Zea mays
  misc_feature: Ceres CLONE 1357388-F
  misc_feature (12)..(12): Xaa is any aa, unknown, or other
  misc_feature (13)..(13): Xaa is any aa, unknown, or other
  misc_feature (41)..(41): Xaa is any aa, unknown, or other
  misc_feature (42)..(42): Xaa is any aa, unknown, or other
  misc_feature (57)..(57): Xaa is any aa, unknown, or other
  misc_feature (77)..(77): Xaa is any aa, unknown, or other
  misc_feature (115)..(115): Xaa is any aa, unknown, or other
MATNPGLFTEWXXKELGNFKYLLLGAWVAHGGYQARPGGEXXRPGVRGHPPVAAPPXADKPAWITAVPLERARGRGXVLDPGIQSKKWDPEATWNNKFWSRESSCYWSQPGGGGXEHPPFGGGGGGPPLFPWCKAGPPRSFQKNWWVPRAS

SEQ ID NO: 11238 - DNA, 661 bp, Zea mays
  misc_feature: Ceres CLONE 1357392-F
  misc_feature: Encodes the peptide sequence at SEQ ID NO. 11239
  misc_feature (551)..(551): n is a, c, t, g, unknown, or other
  misc_feature (634)..(634): n is a, c, t, g, unknown, or other
aagctggagctccccgcggtggcggccgctctagaactagtggatcccccgggctgcaggaattcgcacgagaccattacctagaacatcctaatcgaaaaagttccatcccaatcgccgagaaggggaagccaaatcgatggcggcggcggcggccggcggcgagaacagcggcgcgggcgcgggcgcgggcgagggcgagttctacctgcggtactacgcacaccggccggtgaccctgcgtgcgtgcctctctctctctctctctctctcccctcccgcatccggtggatcgtcaacgccgcccggcccgggcggcagcgccgcgcgccacctgagggcagcgggagccagcagccgctgcttcaccaaggcggtcgcgccgcttttggagcgcttatgcccccggtccgctgagcgcttagtgcagttttttggaacatgagacctcctagcagtggcaaaaagactgaggtctcccataacgtggagaaaatggtggggtttctgatcaagcttgtcatggcaaatgccaaagctgtggctcgagnaaaaaacccttttttgtgctgaagtgaacgaagtctccttgttgaccgcagtcacactggggtgtggaggcctcaaaagaganttgtggagcatgcagtttttaacaatt

SEQ ID NO: 11239 - protein, 101 aa, Zea mays
  misc_feature: Ceres CLONE 1357392-F
MAAAAAGGENSGAGAGAGEGEFYLRYYAHRPVTLRACLSLSLSLSPPASGGSSTPPGPGGSAARHLRAAGASSRCFTKAVAPLLERLCPRSAERLVQFFGT

SEQ ID NO: 11240 - DNA, 592 bp, Zea mays
  misc_feature: Ceres CLONE 1357393-F
  misc_feature: Encodes the peptide sequence at SEQ ID NO. 11241
  misc_feature (246)..(246): n is a, c, t, g, unknown, or other
  misc_feature (247)..(247): n is a, c, t, g, unknown, or other
  misc_feature (460)..(460): n is a, c, t, g, unknown, or other
aaagctggagctccccgcggtggcggccgctctagaactagtggatcccccgggctgcaggaattcgcacgagaccattacctaaaacatcctaatcgaaaaatctgttctatatcgccccattgctcgctcgccaagagttcttcttgttaggcaaggcaaaagcagaagcaaaaaaagaaaggtcttggttgccgatggggagctcaggttctcgtgacgcttcggacacccaagctcccaggnngaaacggtggctgtcgtgctggacgatggggcgaggccaccccgaccagtacactgcatccatgtcgctcagactcctgtcatggactcgctaaaagatggcgctcctgaaaaatggagactagtggaggctcatggaacagctgggggcctcccatctgaggaagaactgggcaaacagtggaattggccaaaatgcactttggggctgggncaaattttccccccagggggtaaatttggcgaataaaggccttgcctccggaaaaatttttgattggaaaaggggttccactaaccaaaaaaaacttttttggaagggggcccctccccctaatgggggggt

SEQ ID NO: 11241 - protein, 55 aa, Zea mays
  misc_feature: Ceres CLONE 1357393-F
  misc_feature: SWISSPROT Homolog: EC 5.4.2.1 Phosphoglycerate mutase
MDSLKDGAPEKWRLVEAHGTAGGLPSEEELGKQWNWPKCTLGLGQIFPPGGKFGE

SEQ ID NO: 11242 - DNA, 630 bp, Zea mays
  misc_feature: Ceres CLONE 1357394-F
  misc_feature (295)..(295): n is a, c, t, g, unknown, or other
  misc_feature (355)..(355): n is a, c, t, g, unknown, or other
  misc_feature (358)..(358): n is a, c, t, g, unknown, or other
  misc_feature (361)..(361): n is a, c, t, g, unknown, or other
  misc_feature (497)..(497): n is a, c, t, g, unknown, or other
  misc_feature (526)..(526): n is a, c, t, g, unknown, or other
aaagctggagctccccgcggtggcggccgctctagaactagtggatcccccgggctgcaggaattcgcacgagaccattacctagaacatcctaatcgaaaaaaaaatatgaaacgagcaaaggtctggcgagctacctaccaataaactaccatctccgcaaacaggctagcacgtagctatatgacagaactgacctagtagaggatcgatcgcacatggtgtttcctgacatcctactccaggtgggcgtacgatggatcttcacgttcgtacgcgccgtcagtaagctcangggccacggcttccaggtctagtatcgtacagcggcggccagttgttgtgcagcgtctcncancanaaaggcggggcccgctgcactggcactgtcgccctctggccttcagaacggggccggcattccttgaacctcgcgcggaacgttgtgtttcaaatttacgaggccctggttgggttcaccgggctctcccctattnatgtcgggcctgcgccgggaggaggaagnccccaacacagccatgttgggggagatgggacatccccccccccccgggggggcccccgggccgccccccttttccccccggttatggggggaggggggttccc

SEQ ID NO: 11243 - DNA, 664 bp, Zea mays
  misc_feature: Ceres CLONE 1357396-F
  misc_feature: Encodes the peptide sequence at SEQ ID NO. 11244
  misc_feature (564)..(564): n is a, c, t, g, unknown, or other
tggagctccccgcggtggcggccgctctagaactagtggatcccccgggctgcaggaattcgcacgagaccattacctagaacatcctaatcgaaaaacatccagatccgtccagatccagattcacccgtctggcacttcacttggcatcacccccgccgtcgcgccgcggccggccgggcctgcaccaaggggtccaggtgaataggtgatgcggccgactcacccgcggcgcggcgcggccctcgtgagaactgcaaaaccaccggccgtatacagtaggcctgcctgcctgcctgccagcaaaccctcccgatcggccgcactgaaatgatcagagtgagtcccctcctcctcgtccgcccgctccgtgttcattgccccactccctcacgcctctcgcgcccgccgctccaccacccccatccacgctcagggaaagggggtctgggttgcatacaggcgaaaggcacgcgccgccgctgccgcgcgagcctctccgtccccatcgccgcgcagatggatccgtcgtcggagcccctgtacgcgcaggtcgagccgtancgactccgggttcctcaggggtctccgatgtccacaccatctactacgagcagtccgggaaaccgaggcccctttggcggcggtgtttcctccacggcgg

SEQ ID NO: 11244 - protein, 48 aa, Zea mays
  misc_feature: Ceres CLONE 1357396-F
  misc_feature (15)..(15): Xaa is any aa, unknown, or other
MDPSSEPLYAQVEPXRLRVPQGSPMSTPSTTSSPGNRGPFGGGVSSTA

SEQ ID NO: 11245 - DNA, 670 bp, Zea mays
  misc_feature: Ceres CLONE 1357402-F
  misc_feature: Encodes the peptide sequence at SEQ ID NO. 11246
  misc_feature (628)..(628): n is a, c, t, g, unknown, or other
aaagctggagctccccgcggtggcggccgctctagaactagtggatcccccgggctgcaggaattcgcacgagaccattacctagaacatcctaatcgaaaatgaatatgttgaggctagacagaaagtcatgaatgttgatcctaaggagcaataacacttctagcgacagctcacagcccttcttcaagagagcttgcagtctcgtaaatcagaggcccgttcaaggctccctttgaatatgatggcgccgatgaacgtcctcgaggcctcaaaagactcaagggccacagaatctgagagtggacaagaaacagtagacgaagagcgtgtcaatgctggatgtagcaacaaggcgcgcgggaaggtgctaatgaataacggaccaagcaacagagaagacaaatgttaattccggtcgatagttcgattgtgcaaagcactaatcagcacgaagctgctgagcttgaggataatcacagcatcatgcggaggacttggagatttccattgtagaggtctgcatgaactgactgtagcatcccaactgagagacgtgcagccaaagtagctactactagcaccagtatccagatcacggtgctcatggcaaactggcatgtgtcgncaccggggaaggctggtcgactacgccccccattaagggggt

SEQ ID NO: 11246 - protein, 56 aa, Zea mays
  misc_feature: Ceres CLONE 1357402-F
MMAPMNVLEASKDSRATESESGQETVDEERVNAGCSNKARGKVLMNNGPSNREDKC

SEQ ID NO: 11247 - DNA, 670 bp, Zea mays
  misc_feature: Ceres CLONE 1357418-F
  misc_feature: Encodes the peptide sequence at SEQ ID NO. 11248
  misc_feature (347)..(347): n is a, c, t, g, unknown, or other
  misc_feature (348)..(348): n is a, c, t, g, unknown, or other
  misc_feature (436)..(436): n is a, c, t, g, unknown, or other
  misc_feature (476)..(476): n is a, c, t, g, unknown, or other
  misc_feature (487)..(487): n is a, c, t, g, unknown, or other
  misc_feature (493)..(493): n is a, c, t, g, unknown, or other
  misc_feature (494)..(494): n is a, c, t, g, unknown, or other
  misc_feature (530)..(530): n is a, c, t, g, unknown, or other
  misc_feature (550)..(550): n is a, c, t, g, unknown, or other
aaagctggagctccccgcggtggcggccgctctagaactagtggatcccccgggctgcaggaattcgcacgagaccattacctagaacatcctaatcaaaaaaccatcaccgcctcgtgtgcagcgtgctcgcccacctcctctgtcgacactcagggtactgacgcaccaccccgaagccctcccgccgcgctcgcagggtgttcgacccttcgcccgcgcgccctcacgacatgcctcctccgtctccgccgccgccaaggccgccgcggcgttcgcgcacaaggtccagaaggagctggccgcgccggcgcagcgccgcgcgggcttgacccgccggaccaagnncgtgcagcgtgcgcgccgtcgcttcgcccgcgcgcgccctgtcgtccaccggctcggtgaagagcgcgatgacgatgacggagaaatnactggcgcgggcgtcggagcgcgcggcgctggagcccggngagaaacgtgntgggcnnaacgtcgacgtgctcatgacgcacgacgtctgcggncccggcgccttcgaatcttncaagaaaggagtttcggggaggacgcccagggtctggggaccgcgaggaagctcgtcgtcatcccggaccactacatctttcaccaggcgacgggcgtgccaaaacgcaacgtcgaacat

SEQ ID NO: 11248 - protein, 84 aa, Zea mays
  misc_feature: Ceres CLONE 1357418-F
  misc_feature (7)..(7): Xaa is any aa, unknown, or other
  misc_feature (24)..(24): Xaa is any aa, unknown, or other
  misc_feature (26)..(26): Xaa is any aa, unknown, or other
  misc_feature (45)..(45): Xaa is any aa, unknown, or other
MTMTEKXLARASERAALEPGEKRXGXNVDVLMTHDVCGPGAFESXKKGVSGRTPRVWGPRGSSSSSRTTTSFTRRRACQNATSN

SEQ ID NO: 11249 - DNA, 760 bp, Zea mays
  misc_feature: Ceres CLONE 1357419-F
  misc_feature: Encodes the peptide sequence at SEQ ID NO. 11250
  misc_feature (760)..(760): n is a, c, t, g, unknown, or other
aaagctggagctccccgcggtggcggccgctctagaactagtggatcccccgggctgcaggaattcgcacgagaccattacctagaacatcctaatcgaaaaatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcgggggggcccggacggcgtcgggggggtgacttgcgccgaggtgacgtcgccggtggggccgtgcctcgggtacgcaatggcgagcgcggtgttcgcccctccgcgggggtgctgaaggggggttggcctcccctcaaaaagccgccccggcctccggcgggggaaccgggcaaggccaccttggaaattgcctccaaaaagcatggaccgggtcccgggtttcggggggggggggtgtcagactggggccaaaggcccaccaaacattcccccggggaaaggggggggcgctctcccggcgggcggggcccctttaggcccccccccgggccgattggccccaaagaacccactggatcggaagggaaccccaagtgggaaaggtaccctccctcttattggggattggaaggaataacgtgggccccatccccaggaataggaatcccgcgcattctaacaagaaaagggtccttaagatccgn

SEQ ID NO: 11250 - protein, 185 aa, Zea mays
  misc_feature: Ceres CLONE 1357419-F
MAARSSSQQLVAAAVLAAALLLLAGGPGRRRGGDLRRGDVAGGAVPRVRNGERGVRPSAGVLKGGWPPLKKPPRPPAGEPGKATLEIASKKHGPGPGFRGGGVSDWGQRPTKHSPGERGGRSPGGRGPFRPPPGPIGPKEPTGSEGNPKWERYPPSYWGLEGITWAPSPGIGIPRILTRKGSLRS

SEQ ID NO: 11251 - DNA, 691 bp, Zea mays
  misc_feature: Ceres CLONE 1357420-F
  misc_feature: Encodes the peptide sequence at SEQ ID NO. 11252
  misc_feature (691)..(691): n is a, c, t, g, unknown, or other
aaagctggagctccccgcggtggcggccgctctataactagtggatcccccgggctgcaggaattcgcacgagaccattacctagaacatcctaatcgaaaaccacacagcaagccagcagagcagaaagcagccgcagccccagcccccacaagacgaggcaacaatggcgctagaagcagccaccgccccccgcgcactcctcgccgcgtgcctcgtcctgctggtcctcggcggcggcaccggcccgtcgtcggtgctgcgcggcgccggggcgcaggccggcgggcagtgcctgccgcagctgaaccgcctcctggcgtgccgcgcgtacctggtgcccggcgcgccggaccccagcgcggactgctgcagcgcgctgagcgccgtgtcgcacgagtgcgcctgcagcaccatgggcatcatcaacagcctgcccggccggtgccacctcgcccaagccaactgctccgcttgaagcagggacctggcacgcgtgctgcaatggatggcaggaggggagaggaataagaaggttttccatttcacagggagagaagccgagctccacggtggtcgtcggcgccgaccttcttcttttgatattcagacctcggtcttgcgggcctatatcttccgcctaattaataataagattaagtgaaaaccaacccgtggcaaaaaaaaaaan

SEQ ID NO: 11252 - protein, 103 aa, Zea mays; identical to SEQ ID NO: 6200
  misc_feature: Ceres CLONE 1357420-F
  misc_feature (43)..(101): Pfam Name: Tryp_alpha_amyl Pfam Description: Protease inhibitor/seed storage/LTP family

SEQ ID NO: 11253 - DNA, 650 bp, Zea mays
  misc_feature: Ceres CLONE 1357422-F
  misc_feature: Encodes the peptide sequence at SEQ ID NO. 11254
  misc_feature (306)..(306): n is a, c, t, g, unknown, or other
  misc_feature (309)..(309): n is a, c, t, g, unknown, or other
  misc_feature (464)..(464): n is a, c, t, g, unknown, or other
  misc_feature (500)..(500): n is a, c, t, g, unknown, or other
  misc_feature (610)..(610): n is a, c, t, g, unknown, or other
  misc_feature (639)..(639): n is a, c, t, g, unknown, or other
  misc_feature (650)..(650): n is a, c, t, g, unknown, or other
tggagctccccgcggtggcggccgctctagaactagtggatcccccgggctgcaggaattcgcacgagaccattacctagaacatcctaatcgaaaaaaccgaagcaatccgacctgagaccaagacccgcaccacgcggctcgccgccgatggcgaacgccgacgccgacgaagcgccgctgctctctgtggaacacctccgtccaggatcctgcagccgcgagctcgagctgcgggagttccgcgaccgctacgtgatccgttcgctcgacggcgccgccgctttcgccgtccttcgctccggnggntccatccgccctctctccccagaggaagccgtagctgagagcgactgcaaggtttccagaatatacggggtgggtagcaccataagattgctcgctggaagctatgtactcgttatcacttctcagaaagatgctggctcttatctgggctcccntgtgtaccagtgaactcaatggaattcttatgctgncacgaggctatcaagcacttgactccacaggaaagaagggatgaggcatacttcatgtctctcctgagaatgcagaaactacttgtggattgtattatcatacgacgggnatttgacactaaacttgcagaggcatccnagtggctggan

SEQ ID NO: 11254 - protein, 108 aa, Zea mays
  misc_feature: Ceres CLONE 1357422-F
  misc_feature (105)..(105): Xaa is any aa, unknown, or other
MANADADEAPLLSVEHLRPGSCSRELELREFRDRYVIRSLDGAAAFAVLRSGGSIRPLSPEEAVAESDCKVSRIYGVGSTIRLLAGSYVLVITSQKDAGSYLGSXVYQ

SEQ ID NO: 11255 - DNA, 841 bp, Zea mays
  misc_feature: Ceres CLONE 1357424-F
  misc_feature (44)..(44): n is a, c, t, g, unknown, or other
  misc_feature (45)..(45): n is a, c, t, g, unknown, or other
  misc_feature (841)..(841): n is a, c, t, g, unknown, or other
gggggcccgccgggtccaccactgcgcccagccacattctctcnntcctcaaggtggtgctccccgcggtggcggccgctctataatagtggatcccccgggctgcaggatttcgcacgagaccattacctagaacatcctaatcgaaaaacaactcgaagtactatttactccggagtccggatggctgctgcgatggacgtcgacgaaggcggaggagagaagaggagaccggcagagaaggagcctcttcagcgccgctgagtccggcgacgccgccgagttcggctccaacgcccccgccgacctctccctgcgcaacgaggacgtccgctccctcctcgacgtggccgccgcttgccggggatccccaggtgatgctcgcagcttgcccagtgacgcggtaaacttctgcgcctagcggtgatgactgcccaggcaaaaggaggcgtggtctgcctattccactccgccggggagctcaaggcatacccgtaaaaatcgccggacatcccgggttgattcgacggtgctgaatgtaaaacactggattagccgaagggttggctggacacggggcctttcattcaaccccacgcgaagcaaaaccgccgcggctaaacgcgcactttgggagaaatgtctctccggcacaatggggcgcccaagaggaccccccacggaaaagaatagagcgtgatgatatgccgaagcgaatgtggcgttcagaagcttgcgcaagccaaaatgggaaaagccgcggcgaacctggacgccggaatgcctggcctgttctacggagaaaggagccctctaaggactgcgatttccagaggagccn

SEQ ID NO: 11256 - DNA, 757 bp, Zea mays
  misc_feature: Ceres CLONE 1357427-F
  misc_feature (757)..(757): n is a, c, t, g, unknown, or other
aagctggagctccccgcggtggcggccgctctatttcagtggatcccccgggctgcaggaattttcacgagaccattacctagaacatcctaatcgaaaagtgcgttcatctgcagtgtacgaacaatcgagccagcaacataaacgatcgaggcgcggtggccgtagcaaccgcagcaagcatgaataactcgcgcgctctagtgttggtgctcctgctgctggccatcgccatggcgagctgcaggctctcgctcggcgcccacgagagcagcaccagcctcggggacaccctccggccgcgacctgcgggggttccatcgccaggggccgccggcaacttcttcaaaccggaacggtgggtggttctcccccaaacgtccccggcgacgcccaaggcaaaaaaccttgaggggcgtgggcgtccccgaagcgggcggccccccacccaggaagccctccgggggggggggcgggcttgcctaaacgcccccggggtggcccgaaaaagggggtccttccgcgggaagaaggtttttaaaaagggggcccttgtcggcggccgccccacaaatctaaaacaagtgcccggcgggggggggctcctacaaaggggagaaaaggcgccggccccccccggtataaaagccctaaaaaaaaaaaaaaacaaccctcttttttttgtttcgcggggagggggggattaccccctccccctctcttgtcttaaagagagtgagagaggatctcgccccgn

SEQ ID NO: 11257 - DNA, 695 bp, Zea mays
  misc_feature: Ceres CLONE 1357437-F
  misc_feature (209)..(209): n is a, c, t, g, unknown, or other
  misc_feature (274)..(274): n is a, c, t, g, unknown, or other
  misc_feature (321)..(321): n is a, c, t, g, unknown, or other
  misc_feature (346)..(346): n is a, c, t, g, unknown, or other
  misc_feature (384)..(384): n is a, c, t, g, unknown, or other
  misc_feature (421)..(421): n is a, c, t, g, unknown, or other
  misc_feature (550)..(550): n is a, c, t, g, unknown, or other
  misc_feature (585)..(585): n is a, c, t, g, unknown, or other
tctttttctcgtggatcccccgggctgcaggaagtcccacgagaccattacctagaacatcctaatcaaaaaaagaaacggagagagcggttctacgcccgagtcgtcgcatcaggtcccctcgattcgccggcggcggcgccgccaaccaagctcatacatctgaattgactagtccaactcagggatttctttggggaccatcaaantcaagaagtaagtttcatgtctgatgtcgacgcccgcttccctctcgtctttgatccgctccggnggcccgctgccccgcccccccgtccccgtggggggggggcagccgtntgggcgccgcctttttttttttttntagcgccgggggcgggttgccgggcggcccctgctttnctccccccccccgggcccccaggacgccccgatcggncccgcccgcccccgcccgccgccccccgggccttggttaaggccggcccctcccccccccgggcggcgtccgcgattgtggccccacgcccgaacgcgacctccacctataagccgcgcgtccctcgcntacgggggacggggccgcccccgttgccccgcgcnacccctcgcggtgcgggtgcccgatacgagccgcccgcgtactagtgcgcgccgccccccgccgccccacgcccacccgcgcgcgccgaccccggcccccgccccgcccg

SEQ ID NO: 11258 - DNA, 697 bp, Zea mays
  misc_feature: Ceres CLONE 1357441-F
  misc_feature: Encodes the peptide sequence at SEQ ID NO. 11259
  misc_feature (563)..(563): n is a, c, t, g, unknown, or other
  misc_feature (616)..(616): n is a, c, t, g, unknown, or other
  misc_feature (617)..(617): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaaacaacaacaacaaccatctccaacgcagcaagcagacacagggacaggcaggcagcgagtgcaaccgcgagagcgatcagcgatgggctccttcttctcgaccttagtgacgccccctccgcccgccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggccttcaaggagctggcctcccgcttcaccgatgccatcttcatcaaggtcgacgtcgacgagctcgcggaggtcgcaaggacatggaaggtagaggcgatgcccacgttcgtgctggtcaaggatgggaaaggagtaggccgtgtgattggggctaagaaagacgagcttgagaagaagatcaggatgntcgtcacgtcatcttcctcgtctaaacttagcagtgcatacactcccaccttnnctactggttctcgactccagtggttcacctgggacggggntgctgaaatggttcccctctctgaatactgaaaatcaaaa

SEQ ID NO: 11259 - protein, 167 aa, Zea mays
  misc_feature: Ceres CLONE 1357441-F
  misc_feature (23)..(127): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (127)..(127): Xaa is any aa, unknown, or other
  misc_feature (144)..(144): Xaa is any aa, unknown, or other
  misc_feature (145)..(145): Xaa is any aa, unknown, or other
  misc_feature (158)..(158): Xaa is any aa, unknown, or other
MGSFFSTLVTPPPPAADDPNCAVVAAHSKATYDEQWAAHKSSSKLMVIDFSASWCGPCRFIEPAFKELASRFTDAIFIKVDVDELAEVARTWKVEAMPTFVLVKDGKGVGRVIGAKKDELEKKIRMXVTSSSSSKLSSAYTPTXXTGSRLQWFTWDGXAEMVPLSEY

SEQ ID NO: 11260 - DNA, 590 bp, Zea mays
  misc_feature: Ceres CLONE 1357444-F
  misc_feature: Encodes the peptide sequence at SEQ ID NO. 11261
  misc_feature (232)..(232): n is a, c, t, g, unknown, or other
aaagctggagctccccgcggtggcggccgctctagaactagtggatcccccgggctgcaggaattcgcacgagaccattacctagaacatcctaatcaaaaaatcagccatccccttttgctgcaaatctttctctgaattgtgggtctccgacaatggcggcgctagctccatccaagattctgggcacccagctcaacttcgcgggctcctcccgctacgccaccgcagngcccaccgcggggctcagagatgtctccctttcagcagaagcagagacttcgcagtacaggctacgactgatcatgcaaatgggcatgctcgtgccgctgggctgcattccaaggctgcaaaggtcgggctactgggcctgaggtggttggtaaaaccggggcttgtctggaaggaaaccctaaaaatttggaaaaaatccccttaaccggggggggccggataccgaagggtatccccggggggggcccaaaataccgggtcccaaggggggggcctaaagaaaaaatggccccccggggggcctcttacccccggggggggggggagaccccccaaaaagggccgcccttttgggg

SEQ ID NO: 11261 - protein, 72 aa, Zea mays
  misc_feature: Ceres CLONE 1357444-F
  misc_feature (26)..(26): Xaa is any aa, unknown, or other
MAALAPSKILGTQLNFAGSSRYATAXPTAGLRDVSLSAEAETSQYRLRLIMQMGMLVPLGCIPRLQRSGYWA

SEQ ID NO: 11262 - DNA, 701 bp, Zea mays
  misc_feature: Ceres CLONE 1357450-F
  misc_feature: Encodes the peptide sequence at SEQ ID NO. 11263
aaagctggagctcaccgcggtggcggccgctctagaactagtggatcccccgggctgcaggaattcgcacgagaccattacctagaacatcctaatcgaaaaactcagggcccaaatacgaaagggacttttaaatccgtggctctaatccgtaaccctaaacccccaccaaaacccctcctcgcctccctcccctccatccaatcctcgaaacgagcgcgcgggcgaggaggtccccctctccgagatggctagggtttttcgcgggtccctcctcctgatgtccccggcggcggcggcggcggcggcggcggcggcaggggccaagaaggcggcctccacgaagccgagggcgccggccgggatcacgaagcccgatgccgtctccgaaagcgtccgcaggttcgccggcggcgcgcgcgaggtcgcacgctccgaaggcatcaagctcgtctggacccacatcaaggcccacggcctccagaacccgtccaacaaaacagagatcaactgtgacgcgacgctcaagagcttgtttggggggaggaacaagatcggaatgatggagggctccaagctactgaaccctcccttcctgaaaaactaaaaggcgggggatggagcccgggggaagcctttccggttgattttggaaaaggttaatctggtaaagggaaaattcaagcccgggtgtatcccag

SEQ ID NO: 11263 - protein, 119 aa, Zea mays
  misc_feature: Ceres CLONE 1357450-F
  misc_feature (40)..(117): Pfam Name: SWIB Pfam Description: SWIB/MDM2 domain
MARVFRGSLLLMSPAAAAAAAAAAGAKKAASTKPRAPAGITKPDAVSESVRRFAGGAREVARSEGIKLVWTHIKAHGLQNPSNKTEINCDATLKSLFGGRNKIGMMEGSKLLNPPFLKN

SEQ ID NO: 11264 - DNA, 680 bp, Zea mays
  misc_feature: Ceres CLONE 1357466-F
  misc_feature: Encodes the peptide sequence at SEQ ID NO. 11265
  misc_feature (355)..(355): n is a, c, t, g, unknown, or other
  misc_feature (383)..(383): n is a, c, t, g, unknown, or other
  misc_feature (388)..(388): n is a, c, t, g, unknown, or other
  misc_feature (433)..(433): n is a, c, t, g, unknown, or other
  misc_feature (474)..(474): n is a, c, t, g, unknown, or other
  misc_feature (583)..(583): n is a, c, t, g, unknown, or other
  misc_feature (650)..(650): n is a, c, t, g, unknown, or other
  misc_feature (680)..(680): n is a, c, t, g, unknown, or other
tggagctccccgcggtggcggccgctctagaactagtggatcccccgggctgcaggaattcgcacgagaccattacctagaacatcctaatcgaaaaagctgaaagcagccaaaacgcagaagctgcactgcatacatcgagctaactatctgcagcgatgtctcgctcctgctgcgtcgccgtgtcggtgcttctcgctgtcgccgcgacagccagcgccaccgcgccggcatggctgcacgaggaggccatggccacggccccgctggtcgcagagggtgcaagggtggcgccctccgcgtccacctgggctgccgacaaggcgtcgccggcgaggccgagcggcggcatggncacgcagggcgacgaccagagctcgtcnggcgncagtggcagcagcgttgagcacggcaaggaggagggcgagaagcnaggcaaagagctgcctcaacaagggaggagtgccacagaanaagatgatctgcggcaagggctgcacgctctcggcgcacaggaagtgcgccgccagtgcaccaggtcctggtgccccacctgctaggagccgaggccggagcttgccgncggcgaaacctccaacgatcgagtgcttcccttcacttctttgtaataattcttggggggtccccgntgcggtgcgtttgctaaaacaaagggatan

SEQ ID NO: 11265 - protein, 133 aa, Zea mays
  misc_feature: Ceres CLONE 1357466-F
  misc_feature (66)..(66): Xaa is any aa, unknown, or other
  misc_feature (77)..(77): Xaa is any aa, unknown, or other
  misc_feature (92)..(92): Xaa is any aa, unknown, or other
  misc_feature (106)..(106): Xaa is any aa, unknown, or other
MSRSCCVAVSVLLAVAATASATAPAWLHEEAMATAPLVAEGARVAPSASTWAADKASPARPSGGMXTQGDDQSSSGXSGSSVEHGKEEGEKXGKELPQQGRSATEXDDLRQGLHALGAQEVRRQCTRSWCPTC

SEQ ID NO: 11266 - DNA, 741 bp, Zea mays
  misc_feature: Ceres CLONE 1357470-F
  misc_feature: Translation starting site: 243
  misc_feature: SWISSPROT Homolog: EC 6.3.2.19 Ubiquitin--protein ligase
  misc_feature (391)..(391): n is a, c, t, g, unknown, or other
  misc_feature (392)..(392): n is a, c, t, g, unknown, or other
aaagctggagctccccgcggtggcggccgctctagaactagtggatcccccgggctgcaggaattcgcacgagaccattacctagaacatcctaatcaaaaaatattcagttatcggttcacgacgcaccaaccgaggccacaggccaccaccattccttccttgttccttccccagctccgcaggctgctcatcgccctccctccgcgcccccgatccagatccagatccaggggcttgtcatggcatccaaacgtatcctcaaggaattaaaggacttgcaaaaggaccctccaacatcatgcagtgcaggtcctgctggtgaggatatgttccactggcaggcaaccatcatgggtcctcctgatagtccatatgctggagggtgttnntctggtgaacattcatttccggccagactaccccttcaagcctccaaagtatcttttaaagacaaaggccttccatccaaacatcataggaatgggaagatatgtccttgaaatccctaagaaacaggggaacccctgctttgaaaaaccccaaggggtttggttttcaaacgggcccccggtttaatgaaccccaacccaaaaaaacccctctttggccccaaaaaatggtccacatgaaaaaaaaggaatcggccctaagaacaagggaaaacccccccacgtgggccccaaaaaaaaccccctgggaaaaaaaaaggttccggcgttatatcggtaatagagaaaa

SEQ ID NO: 11267 - DNA, 693 bp, Zea mays
  misc_feature: Ceres CLONE 1357472-F
agagctggagctccccgcggtggcggccgctctagaactagtggatcccccgggctgcaggaattcgcacgagaccattacctagaacatcctaatcgaaaaatccacttctacttccagattccatcgaactcctgagtattttctcctcgaaccagacaagtaaatcgaatgcagagatacgaccatggactccaccgggaccgaagcagcggataagcttaagaacgtagcggccaacaacaaggcctcggcgcaaaactagaagtccgtgctgaagtccgtgaacggcggcgtcgagtgccacgtcatgcagatcggtcgcgtactagatgaagggccggtacgctcacgagatctctgccggcgccctggagtacctcggcgctgacctctaatacctcgccggtgacgtcctgggggacacctagaatggtgcatggtaccgcaagaagtcctgcatcattatcgcgaaagagaattcagtcggtacggtactgcaaggagtttgcatagctgatggtggggctctccacccaatccggagggggagcccccactataaagcctgctctgatgcccaaaggaccccaaaaaagccgtcatgtcccgctagaaaggaaggatagatctccaatatggacagcagagtctctctgcaggtaatacactgtttgccctggcggggcctgg

SEQ ID NO: 11268 - DNA, 801 bp, Zea mays
  misc_feature: Ceres CLONE 1357474-F
  misc_feature: Encodes the peptide sequence at SEQ ID NO. 11269
  misc_feature (270)..(270): n is a, c, t, g, unknown, or other
  misc_feature (774)..(774): n is a, c, t, g, unknown, or other
  misc_feature (777)..(777): n is a, c, t, g, unknown, or other
aagctggagctccccgcggtggcggccgctctagaactagtggatcccccgggctgcaggaattcgcacgagaccattacctagaacatcctaatcgaaaaatccatcgagctgcccgcgcgcggcagttaagctcacacatcagctagctcaccttggacggccgaccaggtacgttgcgagcgatggcgggatacaaagcgtcgggcggcacggcgctcggcgtcgtcctggctggtgccgcgctcctcgccgcggcggcgatggcgntggacgacgagcacatgtaccactggaagtgcttcaactcgtgcacggggaagtgccgcgacgaggacgcctttgacgacggccaccgttcgggggattccaccgtttcttcgggcggctctgggggaaagggcaacaccaggtgcctcaaggaagggctttaagagacttggcgggcctatttgttaccccccagtggggtgtaaaaaaagggggctttggttttcccaccccttttaaaaaaaaaaaaaaaacatgtgccttaaaaaaacttgtttaaaaaaaagggttttccaaccacaggcccccccaaggttggggtctttggcccccaaaaacaaagaggccccaaatgtgttggtgtcctcacaaaaaccgccctggcccaacaaaaaaaaaaaaaaagggggggcgcgggggccaaaaaacccccccaagcgccccagggggggcccccccccccccaaaaaaaaaaaaggtttcccctccccccccccccggggnggnagaagaaaaaaagcgcgcaccaaa

SEQ ID NO: 11269 - protein, 82 aa, Zea mays
  misc_feature: Ceres CLONE 1357474-F
  misc_feature (29)..(29): Xaa is any aa, unknown, or other
MAGYKASGGTALGVVLAGAALLAAAAMAXDDEHMYHWKCFNSCTGKCRDEDAFDDGHRSGDSTVSSGGSGGKGNTRCLKEGL

SEQ ID NO: 11270 - DNA, 710 bp, Zea mays
  misc_feature: Ceres CLONE 1357475-F
  misc_feature: Translation starting site: 187
  misc_feature: Pfam Name: HLH Pfam Description: Helix-loop-helix DNA-binding domain
  misc_feature (433)..(433): n is a, c, t, g, unknown, or other
  misc_feature (710)..(710): n is a, c, t, g, unknown, or other
agagctggagctccccgcggtggcggccgctctagaactagtggatcccccgggctgcaggaattcgcacgagaccattacctagaacatcctaatcgaaaaatagctctagggctgaaaccagcaaagccaacagaactgcacagtgtagtagttgcacataggcgtccgcgcgtcgtcctagctatggatccatatcactaccaaaccatgtatgacccacgcggcttccccatcatccacccgcagccttacctccagcacccggtggccggcgccctcggtgacagcagggtgcgcgacggcgccagtgacgcgcggcggcgtcctggcgccaagctctccacggacccgcagagcgttgcgccgcgcgagcgggggcaccgcatcagcgaacgctttccgcgtgctccgaagcctcgtcccccggggnaagcaaaatgaaactggtgtcatggtcaaacaggccctccactacgttaaggtccctcaagaccaaaatcatccttgataaggcccgccttaatgcaccacaagaaaggatcccttgttgaactccccccccatttcccgcggggggggggggtttggaaaaaaccaaggggacccccccgcccccaggggtcaaaacggggctttggcaacaatatagtccgcccctccagggggggcgcgaagaaaattttataaaaatagggggttaaaccccn

SEQ ID NO: 11271 - DNA, 702 bp, Zea mays
  misc_feature: Ceres CLONE 1357479-F
  misc_feature: Encodes the peptide sequence at SEQ ID NO. 11272
  misc_feature (702)..(702): n is a, c, t, g, unknown, or other
aagctggagctccccgcggtggcggccgctctagaactagtggatcccccgggctgcaggaattcgcacgagaccattacctagaacatcctaatcgaaaaaccaaaggtatcttgcaatcacaacgaacaaaagctctcgatctcaccgacaccgaggaagaagagatcaatggcgtccgagcagggagtcgtgatcgcgtgccacagcaaggctgagtttgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgaccttccactttcgtcagaacggcaagacggtcgcgaccatcgtgggtgccaggaaggacgagctcctggccctgatcgagaagcatgccgcgcctgcgcctgcgactgcgtctgcctaaatgagatcagatcagtcgtcgccgtcaatagggccagcacgtatggctgtaaatgttgcgttatcaggtctggctttgtcgtttgggggcgatttgggactagtagtatgtttgttctatccgagccggagcgatacttaccatggatacttggtggagtcn

SEQ ID NO: 11272 - protein, 122 aa, Zea mays
  misc_feature: Ceres CLONE 1357479-F
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASEQGVVIACHSKAEFDAHMTKAQEAGKLVVIDFTAAWCGPCRAIAPLFVEHAKKFTQVVFLKVDVDEVKEVTAAYEVEAMPTFHFRQNGKTVATIVGARKDELLALIEKHAAPAPATASA

SEQ ID NO: 11273 - DNA, 669 bp, Zea mays
  misc_feature: Ceres CLONE 1357481-F
  misc_feature: Translation starting site: 186
  misc_feature (318)..(318): n is a, c, t, g, unknown, or other
  misc_feature (498)..(498): n is a, c, t, g, unknown, or other
  misc_feature (566)..(566): n is a, c, t, g, unknown, or other
aagctggagctccccgcggtggcggccgctctagaactagtggatcccccgggctgcaggaattcgcacgagaccattacctagaacatcctaatcgaaaaatcaactcgcaattccgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcnggcgctacttgaagaaggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgnagagcttgggaaagctgttgggcgcgtgaccatcgctcacggcggtgtgctcccaaatatcaccctgntctgctgcccaagagacggcggagaaggcgtccagtggcgggagcaagagggcaagtcgcccaggaggccgccagtcccctaagaagcataactgactgtccg

SEQ ID NO: 11274 - DNA, 689 bp, Zea mays
  misc_feature: Ceres CLONE 1357482-F
  misc_feature: Translation starting site: 195
  misc_feature (409)..(409): n is a, c, t, g, unknown, or other
  misc_feature (472)..(472): n is a, c, t, g, unknown, or other
  misc_feature (473)..(473): n is a, c, t, g, unknown, or other
aaagctggagctccccgcggtggcggccgctctagaactagtggatcccccgggctgcaggaattcgcacgagaccattacctagaacatcctaatcgaaaaattcgtgtcctggcatccgcagagagtttgttccgtccaggcaaccaaaaagcgttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggntgcgcgagatcgcgcaggacttcaagacagacctccggttccagagccacgccgtgctgcggnnttccaggagggccgcgagggctacccttcgtcggcctcttccaaggaaaccaacctctgggcatccacggccaaggggttcccattatgcccaaggaaattcccgttcgcccggcggattcggtggggagcgcgcgagccatcattcttcgaggattttggtggatgtctagttaccaacaataggccgaatttaaacgtcgttgttctggattcc

SEQ ID NO: 11275 - DNA, 754 bp, Zea mays
  misc_feature: Ceres CLONE 1357487-F
  misc_feature: Encodes the peptide sequence at SEQ ID NO. 11276
  misc_feature (241)..(241): n is a, c, t, g, unknown, or other
  misc_feature (257)..(257): n is a, c, t, g, unknown, or other
  misc_feature (317)..(317): n is a, c, t, g, unknown, or other
  misc_feature (345)..(345): n is a, c, t, g, unknown, or other
  misc_feature (360)..(360): n is a, c, t, g, unknown, or other
  misc_feature (474)..(474): n is a, c, t, g, unknown, or other
aaagctggagctccccgcggtggcggccgctctagaactagtggatcccccgggctgcaggaattcgcacgagaccattacctagaacatcctaatcaaaaaatagcgaacaaacatcgagtacagtcggctaggtaatctggtggtacgacgactgacgacgacatggcggccaccagcagcaagtcgtcgtcgtcctcgagctcggcgcagcgggcagcagctgccgccctgctcgtgncggtgtccgtcctggntggtgggcgcggcgcggtgtgcgacatgagcaacgagcagttcatgtcgtgccagccccngcgcggcaaagacgacggacccgccggncgcgccgtcgcaggngtgctgcgacgcgctggcggggggcggacctcaagtgcctgtgcggctaacaaaacttcgccggggatgggcgtttaaaaaattcaaccccaagggggccatggaactttccgncaagggggggccctcccccccccccccgatttggtaaaagggggtttacccaacccagcccaagggggaagccccccggaatttttaactttaaagggtttgggggggccctcccaaagggggggagggggggcccccaaaaaaaaggggctttttctcctccccctgggggcgcggaaaatttaggagggggggggggcccccaaaaaaaaaaagtttttttcgcccccccctttggggggagtaacacaaaggcccgaggttgttttttaaggggggg

SEQ ID NO: 11276 - protein, 90 aa, Zea mays
  misc_feature: Ceres CLONE 1357487-F
  misc_feature (26)..(26): Xaa is any aa, unknown, or other
  misc_feature (31)..(31): Xaa is any aa, unknown, or other
  misc_feature (51)..(51): Xaa is any aa, unknown, or other
MAATSSKSSSSSSSAQRAAAAALLVXVSVLXGGRGAVCDMSNEQFMSCQPXRGKDDGPAGRAVAGVLRRAGGGRTSSACAANKTSPGMGV

SEQ ID NO: 11277 - DNA, 702 bp, Zea mays
  misc_feature: Ceres CLONE 1357495-F
  misc_feature: Encodes the peptide sequence at SEQ ID NO. 11278
  misc_feature (448)..(448): n is a, c, t, g, unknown, or other
aaagctggagctccccgcggtggcggccgctctagaactagtggatcccccgggctgcaggaattcgcacgagaccattacctagaacatcctaatcgaaaaaccctagaagcctccaccctcctgcgcctccaccctcctcgccgcctcactccctctgcagaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaaggtcgagtcctactggccggcgctcttcgctaagctcctggagaagcgcagtgttgaggatctaatcctctccgttggatctggtggtggcgctgctccaggtgctgctgccgccccagctggaggtggtgcanctgctgctgccccttgctgaaaagaaaaaaagggaaaccccaagagggagctgaatgccacttgggtttcccctggtccaatgaggaggccctccctaaccaaccattaaaaaattcccttagggggggcaaaattttatttaacgtttgggtggggcccttttgtttaaacaaaaccccaggtttgaggtttttagaaggggggcttaacaagggggggaaaaaacccccaccccctgtttaaagggggaact

SEQ ID NO: 11278 - protein, 87 aa, Zea mays
  misc_feature: Ceres CLONE 1357495-F
  misc_feature (21)..(86): Pfam Name: Ribosomal_60s Pfam Description: 60s Acidic ribosomal protein
  misc_feature (82)..(82): Xaa is any aa, unknown, or other
MASGELACTYAALILSDDGIAITAEKIATIVKAANIKVESYWPALFAKLLEKRSVEDLILSVGSGGGAAPGAAAAPAGGGAXAAAPC

SEQ ID NO: 11279 - DNA, 710 bp, Zea mays
  misc_feature: Ceres CLONE 1357499-F
  misc_feature: Encodes the peptide sequence at SEQ ID NO. 11280
  misc_feature (331)..(331): n is a, c, t, g, unknown, or other
  misc_feature (346)..(346): n is a, c, t, g, unknown, or other
  misc_feature (365)..(365): n is a, c, t, g, unknown, or other
  misc_feature (368)..(368): n is a, c, t, g, unknown, or other
  misc_feature (382)..(382): n is a, c, t, g, unknown, or other
  misc_feature (384)..(384): n is a, c, t, g, unknown, or other
  misc_feature (393)..(393): n is a, c, t, g, unknown, or other
  misc_feature (394)..(394): n is a, c, t, g, unknown, or other
  misc_feature (417)..(417): n is a, c, t, g, unknown, or other
  misc_feature (419)..(419): n is a, c, t, g, unknown, or other
  misc_feature (432)..(432): n is a, c, t, g, unknown, or other
  misc_feature (443)..(443): n is a, c, t, g, unknown, or other
aagctggagctccccgcggtggcggccgctctagaactagtggatcccccgggctgcaggaattcgcacgagaccattacctagaacatcctaatcaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtcccagtcccgactgccgctcccgtcgaggaggctgcccagctggcccgcgcctccgccgtcgagaccccgaacgangagaccgctgctccngcggtggagaccgaggtcntcntcgctaaggaaccngnagccggtgnnagccgaaactgaaactgagaccnanggaggccgagccngttgctgaccngaccgaggcaaaccccaagaaacaaaaccggaggccgccgccccggaacaaaaaacgaggtcaggaacccaaaaacgggggcccccccgcccgcaaaaaaaacaaggttgcttttcccccgtcaaagttttgtaacccgaaaacgccccccaaaccaaaaggggggggtggagactttaaaaagaggagggagagggggcccccctttgtttttccccccttgggcaaaaaaacgaaaaagaaacggcgctccttttcccaaaagcc

SEQ ID NO: 11280 - protein, 55 aa, Zea mays
  misc_feature: Ceres CLONE 1357499-F
  misc_feature (31)..(31): Xaa is any aa, unknown, or other
  misc_feature (43)..(43): Xaa is any aa, unknown, or other
  misc_feature (44)..(44): Xaa is any aa, unknown, or other
  misc_feature (49)..(49): Xaa is any aa, unknown, or other
  misc_feature (52)..(52): Xaa is any aa, unknown, or other
MAAVEVPVPTAAPVEEAAQLARASAVETPNXETAAPAVETEVXXAKEPXAGXSRN

SEQ ID NO: 11281 - DNA, 701 bp, Zea mays
  misc_feature: Ceres CLONE 1357502-F
  misc_feature: Encodes the peptide sequence at SEQ ID NO. 11282
  misc_feature (419)..(419): n is a, c, t, g, unknown, or other
  misc_feature (449)..(449): n is a, c, t, g, unknown, or other
  misc_feature (450)..(450): n is a, c, t, g, unknown, or other
  misc_feature (479)..(479): n is a, c, t, g, unknown, or other
  misc_feature (480)..(480): n is a, c, t, g, unknown, or other
  misc_feature (485)..(485): n is a, c, t, g, unknown, or other
aaagctggagctccccgcggtggcggccgctctagaactagtggatcccccgggctgcaggaattcgcacgagaccattacctagaacatcctaatcgaaaaaaaactcgctctcactttactcctatccactgcggcctggacgcgtgcgagagacttgacaaagcagcagcagggatggcgcctctgaagctgtacgggatgccgctgtcccccaacgtggtgcgcgtggccaccgtgctcaacgagaagggcctcgacttcgagatcgtccccgtcgacctcaccaccggcgcccacaagcagcccgacttcctcaccctcaaccctttcggccagatcccggctctcgtcgacggagacgaagtcctcttcgagtcccgcgcgatcaccgggtacatcgccagcaagtacgcgtncgagggcacggacctgctccccgcgacggnncgtcgcgcgaaactggagggtgtgctggnnagtgnatcccaccactccacccgaacgcgtcgccgctggtggtccagctgctcgtgaggcccgtcctggggcgcggcccccgacgcgggggtggtggagaaccacgcggaacaacttcgcaagggggctgaccgggaccaggggcacctggccccaaaaaagaactccgccgggaaaaaattacgttcgccaaagccaaccagggtcttacttggttaact

SEQ ID NO: 11282 - protein, 119 aa, Zea mays
  misc_feature: Ceres CLONE 1357502-F
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
  misc_feature (81)..(81): Xaa is any aa, unknown, or other
  misc_feature (91)..(91): Xaa is any aa, unknown, or other
  misc_feature (101)..(101): Xaa is any aa, unknown, or other
  misc_feature (103)..(103): Xaa is any aa, unknown, or other
MAPLKLYGMPLSPNVVRVATVLNEKGLDFEIVPVDLTTGAHKQPDFLTLNPFGQIPALVDGDEVLFESRAITGYIASKYAXEGTDLLPATXRRAKLEGVLXSXSHHSTRTRRRWWSSCS

SEQ ID NO: 11283 - DNA, 751 bp, Zea mays
  misc_feature: Ceres CLONE 1357505-F
  misc_feature: Encodes the peptide sequence at SEQ ID NO. 11284
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
aaagctggagctccccgcggtggcggccgctctagaactagtggatcccccgggctgcaggaattcgcacgagaccattacctagaacatcctaatcgaaaaaaggaaactcgctcccactttactcctatccactgcggcctggacgcgtgcgagaggcttgaccaagcaggatgagcagcagcagcgatggcgcctctgaagctgtacggcatgccgctgtcccccaacgcggagcgcgtggccaccgtgctcaacgagaatggcctcgattgcgagatcgtccccgtcgacctctacagcggcgtccacaagcagcccgacttcctcgccatcaacccttgcagccagataccgactctcgtcgacggagaacgacgtcctactcgagtcccgcggcgatcaaccggaacatgcaccagccaggtactcgagagagggtacgggacctgctccccgcaacgggggtctgcggccaaacctgaaagtctggcttggagggggagtnnnnncccatttaaaccccaaacgcatcgcccgtggggggtaccccctgggccgggaggcccttcccgggggcgggccccccccaacccgggggtggggggaaaaaaccgccccctaacaattccccagggggcccccaagggttaaaaggggcccccgtggccccccaaaaaaaaccctcccccggggggagaaatccacccgttcgccccccctcaccccccccgttgtttatttgtgtttg

SEQ ID NO: 11284 - protein, 154 aa, Zea mays
  misc_feature: Ceres CLONE 1357505-F
  misc_feature (2)..(63): Pfam Name: GST_N Pfam Description: Glutathione S-transferase, N-terminal domain
  misc_feature: SWISSPROT Homolog: EC 2.5.1.18 Glutathione transferase
  misc_feature (107)..(107): Xaa is any aa, unknown, or other
  misc_feature (108)..(108): Xaa is any aa, unknown, or other
MAPLKLYGMPLSPNAERVATVLNENGLDCEIVPVDLYSGVHKQPDFLAINPCSQIPTLVDGERRPTRVPRRSTGTCTSQVLERGYGTCSPQRGSAAKPESLAWRGSXXPFKPQTHRPWGVPPGPGGPSRGRAPPNPGVGGKNRPLTIPQGAPKG

SEQ ID NO: 11285 - DNA, 699 bp, Zea mays
  misc_feature: Ceres CLONE 1357509-F
  misc_feature: Encodes the peptide sequence at SEQ ID NO. 11286
  misc_feature (322)..(322): n is a, c, t, g, unknown, or other
  misc_feature (323)..(323): n is a, c, t, g, unknown, or other
  misc_feature (446)..(446): n is a, c, t, g, unknown, or other
  misc_feature (447)..(447): n is a, c, t, g, unknown, or other
  misc_feature (451)..(451): n is a, c, t, g, unknown, or other
  misc_feature (453)..(453): n is a, c, t, g, unknown, or other
  misc_feature (454)..(454): n is a, c, t, g, unknown, or other
  misc_feature (456)..(456): n is a, c, t, g, unknown, or other
  misc_feature (460)..(460): n is a, c, t, g, unknown, or other
  misc_feature (483)..(483): n is a, c, t, g, unknown, or other
  misc_feature (486)..(486): n is a, c, t, g, unknown, or other
aaagctggagctccccgcggtggcggccgctctagaactagtggatcccccgggctgcaggaattcgcacgagaccattacctagaacatcctaatcaaaaaaactcgctctcactttactcctatccactgcggcctggacgcgtgcgagagacttgacaaagcagcagcagggatggcgcctctgaagctgtacgggatgccgctgtcccccaacgtggtgcgcgtggccaccgtgctcaacgagaagggcctcgacttcgagatcgtccccgtcgacctcaccaccggcgcccacaagcagcccgacttcctcaccctnncaccctttcgccagatcccggctctcgtcgacggagacgaagtcctcttcgagtcccgcgcgatcaaccggtacatcgccagcaagtacgcgtcggagggcacggacctgctccccgcgacgnngtcngnngnaaanctggagggtggctggaggtgganccnaccacttccacccgaaggggtcccccctggggtcccacttgtccgggaggccgttcctggggggcccccccaaccggggggggtggaaaaacacccggaaccaccccccaaggggctccaaggggaaaagggccccctgggccccaaaaaaacccccccgggaaagagagtaaattttcgggaaacaaaacacgggtgtttattttttttttt

SEQ ID NO: 11286 - protein, 174 aa, Zea mays
  misc_feature: Ceres CLONE 1357509-F
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
  misc_feature (50)..(50): Xaa is any aa, unknown, or other
  misc_feature (91)..(91): Xaa is any aa, unknown, or other
  misc_feature (93)..(93): Xaa is any aa, unknown, or other
  misc_feature (94)..(94): Xaa is any aa, unknown, or other
  misc_feature (95)..(95): Xaa is any aa, unknown, or other
  misc_feature (103)..(103): Xaa is any aa, unknown, or other
  misc_feature (104)..(104): Xaa is any aa, unknown, or other
MAPLKLYGMPLSPNVVRVATVLNEKGLDFEIVPVDLTTGAHKQPDFLTLXPFRQIPALVDGDEVLFESRAINRYIASKYASEGTDLLPATXSXXXLEGGWRWXXPLPPEGVPPGVPLVREAVPGGPPQPGGVEKHPEPPPKGLQGEKGPLGPKKTPPGKRVNFRETKHGCLFFF

SEQ ID NO: 11287 - DNA, 682 bp, Zea mays
  misc_feature: Ceres CLONE 1357512-F
  misc_feature: Encodes the peptide sequence at SEQ ID NO. 11288
  misc_feature (270)..(270): n is a, c, t, g, unknown, or other
  misc_feature (273)..(273): n is a, c, t, g, unknown, or other
  misc_feature (283)..(283): n is a, c, t, g, unknown, or other
  misc_feature (286)..(286): n is a, c, t, g, unknown, or other
  misc_feature (374)..(374): n is a, c, t, g, unknown, or other
aagctggagctccccgcggtggcggccgctctagaatagtggatcccccgggctgcaggaattcgcacgagaccattacctagaacatcctaatcgaaaaatttcgcacgaatcgtccccgtccagagccgagcaacccacgccgccccgctgtctccgccggtccgcccccgtccctcccctcccccgaatcgcgtcgtcccgtctcctgctgccgcggaacccctcgcatggcggaggcgcccgagaccgccgcccccacccagccgnccntccgcgcggnggnttcgtccccgcctcccaagtcggggatcccgccgcggtacgacctggacggccagtgggacgcgtggctcgacctctccattccgcgngtcggctactcctccctcgggggcgcctttgcgggcctcctcctcttccgtagccctactactcgctgggcatcagttgcccttggagctggtggtgggataggggctgcataccctgaatgctcatacttatttcatgggggttccaagacggtcaccaaaagctcaactattacctctgcaccctctggaggggggaaataggaaaaccctggctgtgggattggcccatcccgggggagtttttggatgtggggaagaacccggtggtttcatggctggaaattgcgctacttgggggccataaa

SEQ ID NO: 11288 - protein, 115 aa, Zea mays
  misc_feature: Ceres CLONE 1357512-F
  misc_feature (19)..(94): Pfam Name: DUF543 Pfam Description: Domain of unknown function (DUF543)
  misc_feature (14)..(14): Xaa is any aa, unknown, or other
  misc_feature (15)..(15): Xaa is any aa, unknown, or other
  misc_feature (18)..(18): Xaa is any aa, unknown, or other
  misc_feature (19)..(19): Xaa is any aa, unknown, or other
MAEAPETAAPTQPXXRAXXSSPPPKSGIPPRYDLDGQWDAWLDLSIPRVGYSSLGGAFAGLLLFRSPTTRWASVALGAGGGIGAAYPECSYLFHGGSKTVTKSSTITSAPSGGGK

SEQ ID NO: 11289 - DNA, 703 bp, Zea mays
  misc_feature: Ceres CLONE 1358806-F
  misc_feature: Encodes the peptide sequence at SEQ ID NO. 11290
  misc_feature (498)..(498): n is a, c, t, g, unknown, or other
aaagctggagctccccgcggtggcggccgctctagaactagtggatcccccgggctgcaggaattcgcacgagaccattacctagaacatcctaatcgaaaaaaccatttcttcttcctttttctatatcgcgttacgtccctccctacccagcgatctaggccgccgcctctcctactgcatctccctcgctctcgtcgcctcgttcgcttcgcctcctccccgccccgccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatcaaattgggtggaggctcggctggtcaggtcacaaggaacatgcttgcaaatgagggtggtcggttctttctancagggtttgtctggccggattgctggagaaaggacgaacacaactggccggcttggaatcctttagggtccaactaacaagggatttgaaagaagggaggaaaccctttgccctcaattccaaaaagttttaattgggccggagggcgggaaaaatgggggggttgttttggaaaccccggggaatttgggccctcttaaaaagg

SEQ ID NO: 11290 - protein, 101 aa, Zea mays
  misc_feature: Ceres CLONE 1358806-F
  misc_feature (77)..(77): Xaa is any aa, unknown, or other
MADAKQQQQQPQQAAAAATGVWKTVKPFVNGGASGMLATCVIQPIDMVKVRIKLGGGSAGQVTRNMLANEGGRFFLXGFVWPDCWRKDEHNWPAWNPLGSN

SEQ ID NO: 11291 - DNA, 706 bp, Zea mays
  misc_feature: Ceres CLONE 1358829-F
  misc_feature: Encodes the peptide sequence at SEQ ID NO. 11292
  misc_feature (388)..(388): n is a, c, t, g, unknown, or other
  misc_feature (417)..(417): n is a, c, t, g, unknown, or other
  misc_feature (550)..(550): n is a, c, t, g, unknown, or other
aaagctggagctccccgcggtggcggccgctctagaactagtggatcccccgggctgcaggaattcgcacgagaccattacctagaacatcctaatcgaaaagacaggtaatggcttccgccgcggtgctccggaacgccggatctcgccgcctcttctcctaccccaccctccgtgctgctgcaatctcgggacccgccgtgctaccagatgcgcccgtggcggcgtcggtggcggcccagccgcccccgctggcctggacactctgggcgatgtccatggccaccttcacacgcacgaagccccatgtgaacgtcggcacccttgggcacgtcgatcacggcaaaaccagtctcactgccgctattaccagggaaatatcactacnaggaatttgcttgcagatgatgctatggngcctatctcctctcctttgactcctccactaggtgacagtgaagaaactgaccaaaagggggctgtggtaaaaacgctaaaggtccaagcataaaaaagaatcaaacggagtccccagagggggaatctatancaaagttggtccagggatggcgggaaaaaaaggcccactgtcatttcaagggactgtaaaaagggttccaaaacggttaacgggggttccttttggttgggccaggggttcctcaacccggggtggggcccgaaaaccttttggggagggcgcttt

SEQ ID NO: 11292 - protein, 108 aa, Zea mays
  misc_feature: Ceres CLONE 1358829-F
  misc_feature (93)..(93): Xaa is any aa, unknown, or other
  misc_feature (103)..(103): Xaa is any aa, unknown, or other
MASAAVLRNAGSRRLFSYPTLRAAAISGPAVLPDAPVAASVAAQPPPLAWTLWAMSMATFTRTKPHVNVGTLGHVDHGKTSLTAAITREISLXGICLQMMLWXLSPLL

SEQ ID NO: 11293 - DNA, 687 bp, Zea mays
  misc_feature: Ceres CLONE 1358852-F
tggagctccccgcggtggcggccgctctagaactagtggatcccccgggctgcaggaattcgcacgagaccattacctagaacatcctaatcgaaaaatccattggtgtggacgtgtcacgtgtggtggttgcgttgcggggccccgatttcgagcgggtgttcaattttggtgccggatttttaaggaggatccaatttaggaagaattttggttttggggacaatggttttggactgcctgatattcgattcataggttggtcaaacgctttggagtagagaatttttttcccggaaaagaagagccatttttctagttgtgctactcgtcaatcaatccagtgaagctgaactctggaagaagaaactttcctaattagacccggtatttcgtggttggccgttggcgtctaaagtctaatttatttgtcgcgttttagtttaaaaatgaacatatttttctgtttactccgcccaaaatctttccgctggatctacttgtgaatcgggtttgtttgttttttatctgagctattcttgttgatttaggatttcgattcggcagatccaagggaacgccgaattttgcctgatttcttcgcaatttttggtccgatcaagaggctccaagccttttttttttcactcgcgagaagcaagggggctcccttttcttctttcgcct

SEQ ID NO: 11294 - DNA, 640 bp, Zea mays
  misc_feature: Ceres CLONE 1358861-F
  misc_feature: Encodes the peptide sequence at SEQ ID NO. 11295
  misc_feature (363)..(363): n is a, c, t, g, unknown, or other
aaagctggagctccccgcggtggcggccgctctagaactagtggatcccccgggctgcaggaattcgcacgagaccattacctagaacatcctaatcgaaaaaggacctgcttgtttgattgtttcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacnaaaaatggccggaattggcaggaacatggtggcgccgctcctggtgctcaacctcatcatgtacatcatcgtcatcggcttcgcgagctggaacctgaaccacttcatcaacgggcagaccaactaccccggggtggacgggaacgggcgcgacgttctacttcctggggttccccctcctggcccgcgttgggggcccccccccccaacttggggggggggacccctggggggcctggggccccaaaggcctgggcccccaaggcggggtttttct

SEQ ID NO: 11295 - protein, 91 aa, Zea mays
  misc_feature: Ceres CLONE 1358861-F
MAGIGRNMVAPLLVLNLIMYIIVIGFASWNLNHFINGQTNYPGVDGNGRDVLLPGVPPPGPRWGPPPPTWGGGPLGGLGPQRPGPPRRGFS

SEQ ID NO: 11296 - DNA, 757 bp, Zea mays
  misc_feature: Ceres CLONE 1358871-F
  misc_feature: Encodes the peptide sequence at SEQ ID NO. 11297
tggagctccccgcggtggcggccgctctagaactagtggatcccccgggctgcaggaattcgcacgagaccattacctagaacatcctaatcgaaaactagctcgtgcatgccgccctgagcgccactgcacagacgcgcagagacagacattgcgactttgcgagagacaaaacctcccagataacgcccgcgcgctccccgatggcgtcgtcgtgccagaacgtggagattcccggcaagccgacggagacggggacggcgctgctggagacggcgacgggcaccatccaggggttcacgccgctgagccagatccaccagcacctgtgcgcgttccacttctacgcggacgacatggggcggcaggtggaggcgcaccacttctgcgcgcacctgaacgaggacgtgcggcagtgcctcatcttcgacggggcccggggccggggcgcgcctcatcggggtggagtacatcgtctcccgagacggggttcctgaccctgcccccgaccccgagaagccgctggggcaccaccccccgagttcccaggggaaaaggcggggttgcctgttcatggcccggggggggccccgggtgggttggaaccccccggaaccttggaaaaaaggtgtgccaaaaacctacggggaaaaaaccctcccccttctgggggaaggtggaacccgcgggggaaaaacggtttccccgctttgggcctcccccggaagaaatatgggggaggggcgtcccccccccg

SEQ ID NO: 11297 - protein, 97 aa, Zea mays
  misc_feature: Ceres CLONE 1358871-F
  misc_feature (11)..(98): Pfam Name: DUF1264 Pfam Description: Protein of unknown function (DUF1264)
MASSCQNVEIPGKPTETGTALLETATGTIQGFTPLSQIHQHLCAFHFYADDMGRQVEAHHFCAHLNEDVRQCLIFDGARGRGAPHRGGVHRLPRRGS

SEQ ID NO: 11298 - DNA, 622 bp, Zea mays
  misc_feature: Ceres CLONE 1358882-F
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (325)..(325): n is a, c, t, g, unknown, or other
  misc_feature (378)..(378): n is a, c, t, g, unknown, or other
  misc_feature (380)..(380): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (387)..(387): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (478)..(478): n is a, c, t, g, unknown, or other
  misc_feature (479)..(479): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (545)..(545): n is a, c, t, g, unknown, or other
  misc_feature (549)..(549): n is a, c, t, g, unknown, or other
  misc_feature (597)..(597): n is a, c, t, g, unknown, or other
  misc_feature (598)..(598): n is a, c, t, g, unknown, or other
ggagctccccgcggtggcggccgctctagaactagtggatcccccgggctgcaggaattcgcacgagaccattacctagaacatcctaatcgaaaaaatcaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggagtgcgggcgcccccaaatggggggggggggnnnnnnggggggngggaggggggggtgtttccccccccccacaaaaaagggggggcccccccgccncnctnnngngagggggnnnagggggggggggggggggcccccccccccccccccgcggggggggggggggttgttgttttttgtgtgggggggggggggnnaccgcaccccccccccccccccggggggggggggggggaaacccaacacccccccccccnnnactntttnttttttttataatcatcgcccccctcccccccccccccccccccccgnntggttgtttgggggggaggggggg

SEQ ID NO: 11299 - DNA, 604 bp, Zea mays
  misc_feature: Ceres CLONE 1358889-F
  misc_feature: Encodes the peptide sequence at SEQ ID NO. 11300
  misc_feature (578)..(578): n is a, c, t, g, unknown, or other
  misc_feature (591)..(591): n is a, c, t, g, unknown, or other
  misc_feature (592)..(592): n is a, c, t, g, unknown, or other
tccccgcggtggcggccgctctagaactagtggatcccccgggctgcaggaattcgcacgagaccattacctagaacatcctaatcgaaaaaaccgagacaccgcgtgcgaaccaagcagaccccagcagaagaagcgaagtcgtagccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaactttcccgagttaaagcctgaggaggttgctgggatgataaaggactttgatgaacctggaactcttgcaccaactggtctttttgttggaggtacgaagtacatggtgattcaaggtgaaccccggagttgtcattccagggaaaaaaaggggaccgggggggcttttactttcaaaaaaaaaggggggggggcccctttttttttcggggttctcattgggggggcccccctgggtcccccccggggggaagaaaaaaatatattggagggggggggggggagaaanccacgcccccccnnctttcctttccc

SEQ ID NO: 11300 - protein, 142 aa, Zea mays
  misc_feature: Ceres CLONE 1358889-F
  misc_feature (2)..(134): Pfam Name: Profilin Pfam Description: Profilin
  misc_feature (134)..(134): Xaa is any aa, unknown, or other
  misc_feature (139)..(139): Xaa is any aa, unknown, or other
MSWQAYVDDHLLCDIEGQHLSAAAIVGHDGSVWAQSENFPELKPEEVAGMIKDFDEPGTLAPTGLFVGGTKYMVIQGEPRSCHSREKKGTGGAFTFKKKGGGAPFFFGVLIGGAPLGPPRGEEKNILEGGGGRXPRPPXFPF

SEQ ID NO: 11301 - DNA, 690 bp, Zea mays
  misc_feature: Ceres CLONE 1358894-F
  misc_feature: Encodes the peptide sequence at SEQ ID NO. 11302
  misc_feature (384)..(384): n is a, c, t, g, unknown, or other
  misc_feature (423)..(423): n is a, c, t, g, unknown, or other
ggagctccccgcggtggcggccgctctagaactagtggatcccccgggctgcaggaattcgcacgagaccattacctagaacatcctaatcgaaaaaaactccagaggcatccaacagcaggcgaggaaagcaagacacgcccacccacccgctccggcagccagcggctatgcagcagcagatgcccatgccgccggcgcccgctgccgccgcggcggcggcgcccccggcggccggcatcactaccgagcagatccagaagtatttggacgaaaataagcaacttattttggccatcctggaaaatcagaacttagggaagttggctgaatgtgctcagtatcaagctcaacttcaaaagaaccctctgtacctggctgcgnatgctgatgcccaaccccagccctcgcaaaaccctgcangtcgccctcagatgatgcagcctggaatagtggcctggtgcgggcattaaattgtcccaaggacaaatggttcccctcagaacccccattaccccccaggcaatgccggagccgcagcaacaacaacggtttccccaaaaacaacaagaaaggggaggtttttaattttcttggaacaatgggcttggaaccagggccccttccccgtttggggcaaaaacaaccctattgggggttccccccccccggaaaaaaggggactttcaa

SEQ ID NO: 11302 - protein, 100 aa, Zea mays
  misc_feature: Ceres CLONE 1358894-F
  misc_feature (21)..(85): Pfam Name: SSXT Pfam Description: SSXT protein (N-terminal region)
  misc_feature (72)..(72): Xaa is any aa, unknown, or other
  misc_feature (85)..(85): Xaa is any aa, unknown, or other
MQQQMPMPPAPAAAAAAAPPAAGITTEQIQKYLDENKQLILAILENQNLGKLAECAQYQAQLQKNPLYLAAXADAQPQPSQNPAXRPQMMQPGIVAWCGH

SEQ ID NO: 11303 - DNA, 925 bp, Zea mays
  misc_feature: Ceres CLONE 1358898
  misc_feature: Encodes the peptide sequence at SEQ ID NO. 11304
ctctattgcgattaccgtttcctcactgccctttcctttttcggtcggcagcaatcaccggggcaagcgaaccctcgatttgcgtccccgctctctgctagcgcccctaaaagaggagcgaagcgatgtctatgccggagacgggtcaggccgcggagagggatgagcagcagcagtcccgagggatagcactgatgcagggcatctgcgccgtggtgtaccgcaaggccgataacacgccctgccccatcaagcagggtctctacttgggatctgttggagcagcattcaataaggacgctctcaagagcttgaacatcacccatatcttgatcgttgcaaagtcactggatccagtatttccagctgaatttaattacaagaagatcgaagtacttgatatcccagacactgatctgttaaagcattctgatgaatgctttggtttcatagatgaagctataagctctggaggcaatgttttggtccattgctttgctgggcggtcaaggagtgtgacaatcgttgttgcatatctcatgaagaagcatcaaatgagcctcgaaagtgccttgtcactagttagaagtaaacgacctcaagtggctcctaatggggggtttatttcccagctggagaagtttcagaaatccttgcaagtggagcaggaacggagaatgcaacctgtgcagcactgataattatactagtgttataataggtgcagaaggcctcatatgttgtgaaggcgtatgcgttgtaagagcgtcttgaccgcgtattatggcatctggataacaagcgaggccttggcaaactttatgatgtaaacagcaagcaacgttgttcatccattgggatgcagtttacatgttgaataatattcactgcaatctcttcaaatgaaccaaaaaaaaaaaaaaaa

SEQ ID NO: 11304 - protein, 190 aa, Zea mays
  misc_feature: Ceres CLONE 1358898
  misc_feature (38)..(175): Pfam Name: DSPc Pfam Description: Dual specificity phosphatase, catalytic domain
  misc_feature: SWISSPROT Homolog: EC 3.1.3.48 Protein-tyrosine-phosphatase
MSMPETGQAAERDEQQQSRGIALMQGICAVVYRKADNTPCPIKQGLYLGSVGAAFNKDALKSLNITHILIVAKSLDPVFPAEFNYKKIEVLDIPDTDLLKHSDECFGFIDEAISSGGNVLVHCFAGRSRSVTIVVAYLMKKHQMSLESALSLVRSKRPQVAPNGGFISQLEKFQKSLQVEQERRMQPVQH

SEQ ID NO: 11305 - DNA, 678 bp, Zea mays
  misc_feature: Ceres CLONE 1358901-F
  misc_feature: Translation starting site: 193
  misc_feature (434)..(434): n is a, c, t, g, unknown, or other
  misc_feature (514)..(514): n is a, c, t, g, unknown, or other
tggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagccgggnttggggggggccggccgccatcgcgctggcgctcatgggcggccgggttcgtcacctccggcggcctcggcgtcgctgcngctgtccgtgttctcctggatgtacaagtacctgacgggcaagcacccgccgggcgccgaccagctggaccacgccaaggcgaggctggcgtccaaggcccgcgacatcaaggatgcagcacagcaccgcatcgacaggcggcaggggtccttgagagaagaac

SEQ ID NO: 11306 - DNA, 714 bp, Zea mays
  misc_feature: Ceres CLONE 1358922-F
  misc_feature: Encodes the peptide sequence at SEQ ID NO. 11307
tggagctccccgcggtggcggccgctctataactagtggatcccccgggctgcaggaattcgcacgagaccattacctagaacatcctaatagaaaaagtgatagtgagcgacgccacgggacaggcatggcgagccgcgagcggcagcacacccgcagctacgactacgactacgagcacctcgtgctcgacccggcgtctctgggcgtgccgtgggccgacccggccgccgtggagatcccgccgcagctcctcgccgcgctcggggagtacctctccggctccgcggcccgcggagacgtccaggcggaggtggacgacgagttcatgatgcacgacttcaaggtgcggcagtgcgcgcgcgcacgcagccacgactggacggcggtgcccataccggcacccgggagagggcgtgcggagcccgggacccttgccgaagtcgcctaggcggggggaaccgagccccggaacttccggggccctcacgggggccgaccaccgcctggggcccccccccgggttcccttgcccaattcccctcggagacctttggggtggggctttccccccttcccgaatcggggcccaacctttttggggggggtccccctccccgcgggggaaaatatatttttttaaaggagcctgggatgtgcccccaccggcgcgcgaaatccccagggggggggtgttttctttttttctttttt

SEQ ID NO: 11307 - protein, 107 aa, Zea mays
  misc_feature: Ceres CLONE 1358922-F
MASRERQHTRSYDYDYEHLVLDPASLGVPWADPAAVEIPPQLLAALGEYLSGSAARGDVQAEVDDEFMMHDFKVRQCARARSHDWTAVPIPAPGRGRAEPGTLAEVA

SEQ ID NO: 11308 - DNA, 640 bp, Zea mays
  misc_feature: Ceres CLONE 1358928-F
  misc_feature: Encodes the peptide sequence at SEQ ID NO. 11309
  misc_feature (338)..(338): n is a, c, t, g, unknown, or other
  misc_feature (339)..(339): n is a, c, t, g, unknown, or other
  misc_feature (398)..(398): n is a, c, t, g, unknown, or other
  misc_feature (399)..(399): n is a, c, t, g, unknown, or other
  misc_feature (417)..(417): n is a, c, t, g, unknown, or other
  misc_feature (443)..(443): n is a, c, t, g, unknown, or other
  misc_feature (593)..(593): n is a, c, t, g, unknown, or other
aaagctggagctccccgcggtggcggccgctctagaactagtggatcccccgggctgcaggaattcgcacgagaccattacctagaacatcctaataaaaaaagtaatcagtgctcagtgctcactagcccaagtcgccctaaacctagcccgggcacccgccagaccagccagcccaacaacgcaaaacgcgacgcggccaccgccttgtccatgggctcctcggcgcagctcaggcggctgaagcctctgtaccagctggtggtgaacaacatcctgaccatcgtggccgtgccgtcgggccgccgcggtcctgctcaagcggggcggagctgggnncccgaggagatcctggcccgggcccgcgcgctccggccgggcaatgcttccctgggcgnngtcctggcggccgtggcngacggtgctgtacctgacgctccggncgcgcgcggtgtacctggtggactacgcgtgcttccgcaccaaccccaaatggcggggcccggttcggggaggttcgggagcacttccgggggggggggcggggttcaaggaggggaagggccgggttctggagcgcctgggtggggggnccgggggctggggaaaagaaaaattcccttccgaaaggggaaaatat

SEQ ID NO: 11309 - protein, 142 aa, Zea mays
  misc_feature: Ceres CLONE 1358928-F
  misc_feature (42)..(42): Xaa is any aa, unknown, or other
  misc_feature (62)..(62): Xaa is any aa, unknown, or other
  misc_feature (77)..(77): Xaa is any aa, unknown, or other
  misc_feature (127)..(127): Xaa is any aa, unknown, or other
MGSSAQLRRLKPLYQLVVNNILTIVAVPSGRRGPAQAGRSWXPEEILARARALRPGNASLGXVLAAVADGAVPDAPXARGVPGGLRVLPHQPQMAGPGSGRFGSTSGGGGGVQGGEGPGSGAPGWGXRGLGKRKIPFRKGKI

SEQ ID NO: 11310 - DNA, 656 bp, Zea mays
  misc_feature: Ceres CLONE 1358936-F
  misc_feature: Encodes the peptide sequence at SEQ ID NO. 11311
  misc_feature (383)..(383): n is a, c, t, g, unknown, or other
  misc_feature (478)..(478): n is a, c, t, g, unknown, or other
aaagctggagctccccgcggtggcggccgctctagaactagtggatcccccgggctgcaggaattcgcacgagaccattacctagaacatcctaatccaaaaatatcccatcctgatctctcctcccttcttcagtgcagcagcaggccagcagcacgccacccgccccactcctgcctccgatccgctgcttactcgccacccggagatggccaccgccgccgccttctccgtctcctcgccggcggcctccgccgtcgccgcgcgatccaaggtgtttggaggaggagttaaccaggcgagaactagaactggctgccgcgtcggcatcacgcggaagaactttggccgtgtcatgatggcccttggcagtggatgtttcntcgttttgaaggagtgccaatggctcctccagacccaatttcttgggggtttctgaggcctttaaagcagataaaagcgagctgaagtcaatccnttgggtgttggtgcctataggacagaagagctgcagccatacgtgctcaatgtagtcaagaaggctgaaaatcttatggttggagaaaggagaaaacaaagagtatctcccccattgaagggttagccgcgtttaaaaagcacagcagagctatggcttggagctgataaccctgttt

SEQ ID NO: 11311 - protein, 76 aa, Zea mays
  misc_feature: Ceres CLONE 1358936-F
  misc_feature (59)..(59): Xaa is any aa, unknown, or other
MATAAAFSVSSPAASAVAARSKVFGGGVNQARTRTGCRVGITRKNFGRVMMALGSGCFXVLKECQWLLQTQFLGGF

SEQ ID NO: 11312 - DNA, 774 bp, Zea mays
  misc_feature: Ceres CLONE 1358946-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (300)..(300): n is a, c, t, g, unknown, or other
  misc_feature (392)..(392): n is a, c, t, g, unknown, or other
  misc_feature (417)..(417): n is a, c, t, g, unknown, or other
  misc_feature (456)..(456): n is a, c, t, g, unknown, or other
  misc_feature (466)..(466): n is a, c, t, g, unknown, or other
  misc_feature (476)..(476): n is a, c, t, g, unknown, or other
  misc_feature (549)..(549): n is a, c, t, g, unknown, or other
  misc_feature (550)..(550): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctggggctccaccggcggtggcggccggctctagaactagtggatcccccgggctgcaggaattcgcacgagaccattacctagaacatcctaatcgaanaaacccttgtgtcgtaccctccggatcgaatcctagacgacgcgaccggcacggcggcggcgcacagccccgacgacgaccctccccgctgnctttctcccgatctctacgacaccnattatagatgggggaaggtgaacctccctcctcctgggnatcggcaccnactcccaaangtctacactcaaatgagacaggccaaggttaaggttcgaccacttccaagggacatggcaagaaactatcagnnaacatgggggggtatatttccccgggccttatgggggaagcaaaaggattgggaaaaaaaacgggttttaagtggaggagcccccccaaaaagtttggggttatggcccccctccaggcttatatatggggggggggggggtccccctttgataaagcaagagggccccgggaggagttttttttgtttttttggggggggacccaaaggggggggcccggggt

SEQ ID NO: 11313 - DNA, 642 bp, Zea mays
  misc_feature: Ceres CLONE 1358948-F
  misc_feature: Encodes the peptide sequence at SEQ ID NO. 11314
  misc_feature (446)..(446): n is a, c, t, g, unknown, or other
  misc_feature (458)..(458): n is a, c, t, g, unknown, or other
  misc_feature (470)..(470): n is a, c, t, g, unknown, or other
  misc_feature (533)..(533): n is a, c, t, g, unknown, or other
aaagctggagctccccgcggtggcggccgctctagaactagtggatcccccgggctgcaggaattcgcacgagaccattacctagaacatcctaatcgaaaaaaaaccccccctgccccagacgtcgcgcgcatgaaatgaaaccctagtgagtagtgaccctgtccggatcactgcgtggcgccgccatggcaccctccgctctggcctccctcccggcgccgctccggtcactgcggctcaagacgaagcagcaggagctactgctccgcgtctcggcgctggcgctcatctacgttctcgccttcgccgtccgcctcttctccgtcctccgctacgagtctatgatccacgagttcgacccctacttcaattaccgcaccacgctcttcctcaccgagaacggctttagcgagttctggaactggttcgattccgagagtgtnacccgctcgggncgcgtcgtcggngggactctcttcccgggtctcatggtgaccgccgcgctgctccaccgcctcctccgcgcgtcntccctcgctgtcacaattccgcgaggtctgcgtcctcaccgcgcctttcttcgccgccaacaccactctcgtcgcctacgccttttggccgcgagactggaattccccg

SEQ ID NO: 11314 - protein, 151 aa, Zea mays
  misc_feature: Ceres CLONE 1358948-F
  misc_feature: SWISSPROT Homolog: EC 2.4.1.119 Dolichyl-diphosphooligosaccharide--protein glycotransferase
MAPSALASLPAPLRSLRLKTKQQELLLRVSALALIYVLAFAVRLFSVLRYESMIHEFDPYFNYRTTLFLTENGFSEFWNWFDSESVTRSGRVVGGTLFPGLMVTAALLHRLLRASSLAVTIPRGLRPHRAFLRRQHHSRRLRLLAARLEFP

SEQ ID NO: 11315 - DNA, 639 bp, Zea mays
  misc_feature: Ceres CLONE 1358951-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (182)..(182): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnggggggggnnnnnnnnnnnnnnnnnnnnnnnnnnnnnnnnnnnnnnnnnnnnnnnnnnnnnnnnnnnnnnnnnnnnnnnnnnnccaaagctggagctccccncggtggcggccgctctagaatagtggatcccccgggctgcaggaattcgcacgagaccattacctagaacatcctaatcgaaaaaccgatttcgattcgatttgccggcggtgcccgcggcggagaggatggcgagctccttctccttcccgctgatgaatcccggcgggacatttggcgggagggcgcttgcacagcttactggcatcgggggcccagcccccgggccttcccgcggccggaggaaacatttcgtccacccccggcagccccggggcctccggtccggcccgaggggtccttccggccctttctttccttcggcccaaatttttcggtccggggggaccaaacgaagccccgaacaaagcaatttaaaagtttcaggggccctggaaggggaaatcaacaaccccgggaaaccccccaaggggggcgcccaaaaggggctcccccc

SEQ ID NO: 11316 - DNA, 626 bp, Zea mays
  misc_feature: Ceres CLONE 1358957-F
  misc_feature: Encodes the peptide sequence at SEQ ID NO. 11317
  misc_feature (271)..(271): n is a, c, t, g, unknown, or other
  misc_feature (297)..(297): n is a, c, t, g, unknown, or other
  misc_feature (349)..(349): n is a, c, t, g, unknown, or other
  misc_feature (361)..(361): n is a, c, t, g, unknown, or other
  misc_feature (440)..(440): n is a, c, t, g, unknown, or other
cgctctagaactagtggatcccccgggctgcaggaattcgcacgagaccattacctagaacatcctaatcgaaaaagcggcgaggacgaagtggcccgcccaggaaatggcgtcgatgcagagctggcgcaaggcctacggcgccatcaaggacaccacaaccgttagcctcgccaacctcaactcggacttcaaggatctggatgtggcgatcgtgaaggcgactaatcacgtggagtgcccacccaaggagcgacacctgcgaaagggntgttgcggcgacatccatcgccaggnctaggggcggatgtcgcctactgcatccacgcgcttgggccgcgtctttgcnagacccgcaacntggattgtggctctgaaagcacttgtagtaatccatagacttcttcgggagggggatctaacatttcgagaagagcttnctaactttacacaaagggggggaattcggcaacttcaaactttaaggatgactcccgcccattggtttggaaattgtctgccggggggcaaaaaagggtttggttttggaaaaaggggggaggggttcaaaattcaaaaataagggttaaaaggaaggttttcccaaaaggggaagggccctaaaa

SEQ ID NO: 11317 - protein, 63 aa, Zea mays
  misc_feature: Ceres CLONE 1358957-F
MASMQSWRKAYGAIKDTTTVSLANLNSDFKDLDVAIVKATNHVECPPKERHLRKGCCGDIHRQ

SEQ ID NO: 11318 - DNA, 658 bp, Zea mays
  misc_feature: Ceres CLONE 1358963-F
  misc_feature (229)..(229): n is a, c, t, g, unknown, or other
  misc_feature (334)..(334): n is a, c, t, g, unknown, or other
  misc_feature (417)..(417): n is a, c, t, g, unknown, or other
  misc_feature (465)..(465): n is a, c, t, g, unknown, or other
tccccgcggtggcggccgctctagaactagtggatcccccgggctgcaggaattcgcacgagaccattacctagaacatcctaatcgaaaagacaaccccagcgcacgaactccaaaatagcgagccgaagggggccacgagtcctccacctccctctccgccgcgtcgctcgcgcttgacgcgcgccgagagccgaatcggagccacgaggcagccgccccgggcggnatcgatcctagggccagggcatgggcggaggggacgccgacgccggcggcgagcccgcggacgcgcaggccacgctccacatccggtgcaccaacgcctcctagntcaccgtgcgggccgacctgggcgccaccgtcggggcgtttaaggcgatcgtcgccgacagctgcgacgtgccggcgccgcancagcggctgatctacagggcccggatctggaggacgagcaaccctagncgggtacgggggggaaaacgaccataacatcccaatgggaacggggggttggggcatccccaattttaagggcctgggggccaaacaaaaactaccgggggtggccctgggaatttcccggaaacggaatgggggggtttttttaaaaagtggggaataaaagggcgtttttaaaaaaaggggggggtttttt

SEQ ID NO: 11319 - DNA, 667 bp, Zea mays
  misc_feature: Ceres CLONE 1358967-F
  misc_feature: Encodes the peptide sequence at SEQ ID NO. 11320
  misc_feature (422)..(422): n is a, c, t, g, unknown, or other
aaagctggagctccccgcggtggcggccgctctataactagtggatcccccgggctgcaggaattcgcacgagaccattacctagaacatcctaatcgaaaaatacctcctcaaggcacgttcaccacagtcctctctttccccggcaccaccaccaccacccaggctaacaggactggaccgagtgttgaacaacactgcagtgagcgacggcaggcatggtgagccgtgaaaatttgcacctggtgctggacccggcgtctctgggcgcgccttgggccgacccgtccgccgcagagatcccgccgcagctcctcgccgcgctgggagagtacctctcctccgcccgcggcgacgtcgagacggaggcggacgacgagttcatgatgcacgagttcaaggtgcggcggtgcgcgcgcgcncgaacccacgactggacggcgtgcccctacgcgcacccgggggaggccgcgcggccgcgggaccccccccccggtggcctaagccgggggagcccgtgcccggattttccgggggccgccggggcccgggcgcccgcgtggcccgcgcgggggccgcctggcccgtttggggaagggaaactttcgaggtgggggttccaacccggacccggtacccggacgggccccctggcgggcgggggtgt

SEQ ID NO: 11320 - protein, 149 aa, Zea mays
  misc_feature: Ceres CLONE 1358967-F
MVSRENLHLVLDPASLGAPWADPSAAEIPPQLLAALGEYLSSARGDVETEADDEFMMHEFKVRRCARARTHDWTACPYAHPGEAARPRDPPPGGLSRGSPCPDFPGAAGARAPAWPARGPPGPFGEGKLSRWGFQPGPGTRTGPLAGGG

SEQ ID NO: 11321 - DNA, 659 bp, Zea mays
  misc_feature: Ceres CLONE 1358970-F
  misc_feature: Translation starting site: 255
  misc_feature: Pfam Name: Serinc Pfam Description: Serine incorporator (Serinc)
  misc_feature (484)..(484): n is a, c, t, g, unknown, or other
  misc_feature (599)..(599): n is a, c, t, g, unknown, or other
  misc_feature (613)..(613): n is a, c, t, g, unknown, or other
aaagctggagctccccgcggtggcggccgctctagaactagtggatcccccgggctgcaggaattcgcacgagaccattacctagaacatcctaatcgaaaaatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtgctgcgcggcgtgcgcgtgcgaggcgtgccggacggcggtcggcagcatcggccgccgctccgcccgcatcgcctactgcggcctcttcgcgctctccctcttcgcatcctggggcgctccgcgaggtcgccgcgcccctcctccagtcgatcccatggattaaccacttccacaagacccccgaaccgcgagtggttcagnacccgacgcggtgctcagggtcagcctcggcaacttcctcttcttccccatcctcgccgtcatcatggcccgggataaaggaccagaaggacccccgtgacagatccaccacggncggatggatggccnagatctttctgctgggtcatcatcgtcttcctcatggtctcggggc

SEQ ID NO: 11322 - DNA, 677 bp, Zea mays
  misc_feature: Ceres CLONE 1358973-F
  misc_feature: Encodes the peptide sequence at SEQ ID NO. 11323
  misc_feature (576)..(576): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
aaagctggagctccccgcggtggcggccgctctagaactagtggatcccccgggctgcaggaattcgcacgagaccattacctagaacatcctaatcgaaaaaacgccagcggcgagtcgagctcgagccccagccaccgcagccatggtcctcacgaaaccctacctctccaactcgctccttccagtcccatccccgccgccgtcgagccctactctcagctccaaccatgcaagccccgttgccgcccctacttgccgtcgcagccgcctccgcatctccgccacatccacggctgcgccggctccttcgtcggctgccgctgccaccgcgtcgctgagtcgagtggacgtgctctcggaggcgctcccttttattcagcgattcaaaggcaagacggtggtggtcaagtacggcggtgcggcgatgaagtccccggagctgcaggcgtccgtgatccgcgatctcgtgctgctctcctgcgtcggcctccgccccgtgctcgttcacggcggcggtccggagattaattcctggctgctggcgcgtcggcgtcgagccgaggttccgcgacnggcctccgtgtcacgacggttctacccacatgaagtcccgtcgagatggtgctaaaactcgggaaaggtcaacaagaaacctcgtctccctattcannnat

SEQ ID NO: 11323 - protein, 161 aa, Zea mays
  misc_feature: Ceres CLONE 1358973-F
  misc_feature: SWISSPROT Homolog: EC 2.7.2.8 Acetylglutamate kinase
  misc_feature (144)..(144): Xaa is any aa, unknown, or other
MVLTKPYLSNSLLPVPSPPPSSPTLSSNHASPVAAPTCRRSRLRISATSTAAPAPSSAAAATASLSRVDVLSEALPFIQRFKGKTVVVKYGGAAMKSPELQASVIRDLVLLSCVGLRPVLVHGGGPEINSWLLARRRRAEVPRXASVSRRFYPHEVPSRWC

SEQ ID NO: 11324 - DNA, 663 bp, Zea mays
  misc_feature: Ceres CLONE 1358976-F
  misc_feature: Translation starting site: 167
  misc_feature: Pfam Name: NTF2 Pfam Description: Nuclear transport factor 2 (NTF2) domain
  misc_feature (600)..(600): n is a, c, t, g, unknown, or other
aagctggagctccccgcggtggcggccgctctagaactagtggatcccccgggctgcaggaattcgcacgagaccattacctagaacatcctaatcgaaaaagatctaggggtctctcgtgctctgttctcatcttctgctcgctggggtcccctccctctcacccatggcttcggcggcggtggcaactcaagtggagacttacttcctgcggaactactacgacctgctgcaacaaacccccgatgacgaccaccagttctacagtgaagccagtaccatggtccgtgtcgacgacctcaccggaacgaccgcggctgccaactacatgatggacatacactcactcatcatgtctttgaacttcacccaaattgagatcaagactgccaattttgtgaactcatgacgcgatggggtgctagttatggcctctgttctagtgcagaccaaggagtacagccaccagaggcaatttaatccagatgttcttccttgacctcaagagaaaagggttactttgtcctcaacgattacttttcacttcgttgaccaagaacatgtgcagcctgccgccagtgattgctcaggaaacttacnagagcattttgcaccccaaacacagttgttgagaccgctttctgagtacgtttcacgaggaaa

SEQ ID NO: 11325 - DNA, 724 bp, Zea mays
  misc_feature: Ceres CLONE 1359050-R
  misc_feature: SWISSPROT Homolog: EC 3.2.1.39 Glucan endo-1,3-beta-D-glucosidase
ccgattgggtaccgggccccccctcgaggtcgacggtatcgataagcttttttttttttttttttagaaattaaaccacactctcattatattatagaaacagatggagtaaaacatagattaaggctcattattcctttatcattacaacatgttccctctttttaataccaatacagaaaagaccatcaaataatagatataaagcattttattgtatcactagcccttgcttagtatcttcaaggattttagctgaaattaacatcatacttaggctgttgactaggaagaaacatcccccaaaacttctcaagctcaggaggacccttctgattctcatcgaacatagcgaatatataagtctctataggtttctctcgctttctcggagttccacccttcacatgttgtatcaaattattaacataagtcattgcattctccacgctagtccctgctcctccctccgttggccaaccgctctcagacaccacgatttccaacgaccctccgcctgatttctccagtgctgcgtagaccgcgtcaagattggcgtcgaagaggtttgtgtaagagtatgggtcgtcattgactacaggggtcggtttgaacaaagcgtactcaagagggatggagttcatgttgtccttgtagctgaagtaagggtagttattcaaaagcagaggagattgcttgcttaccaagaatctatcaccggctg

SEQ ID NO: 11326 - DNA, 654 bp, Zea mays
  misc_feature: Ceres CLONE 1359061-F
  misc_feature: Encodes the peptide sequence at SEQ ID NO. 11327
  misc_feature (306)..(306): n is a, c, t, g, unknown, or other
  misc_feature (315)..(315): n is a, c, t, g, unknown, or other
aaagctggagctccccgcggtggcggccgctctagaactagtggatcccccgggctgcaggaattcgcacgagaccattacctagaacatcctaatcgaaaatttgcacttctcgccttctctaatctctttgcctctttggctccctccaccaccagtccaccaccactgctacccaacccttgcttccccaaaccctagccaagggacacggtggccgacgatggacggcgacggaggaagcgctggtgcgctgcaccaccacacgcgctcacccgaagacgtcttccgcgatttccgcgcgcngcgagccgncatcgtcaaggcgctcaccacggatgtgggagaaagtctatcagcagtgccatccaaagaaaagaaacttgtgcctttataggtttgccaatgagaccttgggaagtcaatcttccagctgagggaagtactccctgagctttcaaacccagaactggggataaactttgccccgggatgggatggtcaaaaaaaatgggttgtctctaagttgcaattcataaggatgcatgggtcccccggctgtggcaatctactatggagaaccggcttttgggttttaacaaaaatgccccaagaaaaggtcttttccccatgaataaacacctggccactgtt

SEQ ID NO: 11327 - protein, 57 aa, Zea mays
  misc_feature: Ceres CLONE 1359061-F
  misc_feature (28)..(28): Xaa is any aa, unknown, or other
  misc_feature (31)..(31): Xaa is any aa, unknown, or other
MDGDGGSAGALHHHTRSPEDVFRDFRAXRAXIVKALTTDVGESLSAVPSKEKKLVPL

SEQ ID NO: 11328 - DNA, 680 bp, Zea mays
  misc_feature: Ceres CLONE 1359075-F
  misc_feature: Encodes the peptide sequence at SEQ ID NO. 11329
  misc_feature (300)..(300): n is a, c, t, g, unknown, or other
  misc_feature (387)..(387): n is a, c, t, g, unknown, or other
  misc_feature (399)..(399): n is a, c, t, g, unknown, or other
  misc_feature (400)..(400): n is a, c, t, g, unknown, or other
  misc_feature (611)..(611): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagngacggagtggtcgaacgggaccgcaaggaggacctgcggtggtgcaagcaggcgtgcgagtggcagtacggaaaggacaccccgcgnaagagggatgcnnagagcgagtgccgcgagcggcaccagcaagctgacgcggggcgaggacggcgaccagtcggcgtgggacgcctacgtctcccgctcggaaaagggggccgagtggccgacgcccagtgcctgcgcccgccacgaggggccaggccgtgggaagacccaggagtgccatggaggcggtgccgccgccgcgggactggccgtcgacatggagnccaagagtacgggtcgcggcagcgagagcgcgggcaagtggccccgggaagaggtgcgagcgccaacac

SEQ ID NO: 11329 - protein, 148 aa, Zea mays
  misc_feature: Ceres CLONE 1359075-F
  misc_feature (22)..(22): Xaa is any aa, unknown, or other
  misc_feature (51)..(51): Xaa is any aa, unknown, or other
  misc_feature (55)..(55): Xaa is any aa, unknown, or other
  misc_feature (126)..(126): Xaa is any aa, unknown, or other
MVGVPPARRRAAGRSSHGRGGXTEWSNGTARRTCGGASRRASGSTERTPRXRGMXRASAASGTSKLTRGEDGDQSAWDAYVSRSEKGAEWPTPSACARHEGPGRGKTQECHGGGAAAAGLAVDMEXKSTGRGSESAGKWPREEVRAPT

SEQ ID NO: 11330 - DNA, 645 bp, Zea mays
  misc_feature: Ceres CLONE 1359088-F
  misc_feature: Encodes the peptide sequence at SEQ ID NO. 11331
  misc_feature (229)..(229): n is a, c, t, g, unknown, or other
  misc_feature (254)..(254): n is a, c, t, g, unknown, or other
  misc_feature (260)..(260): n is a, c, t, g, unknown, or other
  misc_feature (272)..(272): n is a, c, t, g, unknown, or other
  misc_feature (297)..(297): n is a, c, t, g, unknown, or other
  misc_feature (319)..(319): n is a, c, t, g, unknown, or other
aagctggagctccccgcggtggcggccgctctagaactagtggatcccccgggctgcaggaattcgcacgagaccattacctagaacatcctaatcgaaaaaccaccaccactggacgtcagcctagcaattagctcatcgactccagattggagaactcgacaccatgaaggtgctgatcgttgcccttgctctcctggcgctcgctgcgagcgccgcctccagtacnagcggcggctgtggctggcagacanccacgnttcatcttacgnctccgttctataatggccgcttcgntctaatctgccgccgcaacacnaagcgcaagcattggggatacccccaatccacccccgcaatttaacccgtgtccacaaaattcgattcctggggggggtctgaaaggtcggcaaccccgttcctggggccaagggggcaaggttctgtaggagccaatgggaagcccgcggggggaaccccttaaaggtttccccaaagggcaaggggggttgtagaaaaaatggttgtcaaccaaaaataagaggggggggggccccctgttcccgggtaccagggaaaaaaaaggggggggggccggcggaaaccttcctctgaggaaaaaaacccccaggggtgggtttcccc

SEQ ID NO: 11331 - protein, 65 aa, Zea mays
  misc_feature: Ceres CLONE 1359088-F
  misc_feature (30)..(30): Xaa is any aa, unknown, or other
  misc_feature (32)..(32): Xaa is any aa, unknown, or other
  misc_feature (36)..(36): Xaa is any aa, unknown, or other
  misc_feature (44)..(44): Xaa is any aa, unknown, or other
MKVLIVALALLALAASAASSTSGGCGWQTXTXHLTXPFYNGRFXLICRRNTKRKHWGYPQSTPAI

SEQ ID NO: 11332 - DNA, 669 bp, Zea mays
  misc_feature: Ceres CLONE 1359126-F
  misc_feature: Encodes the peptide sequence at SEQ ID NO. 11333
  misc_feature (492)..(492): n is a, c, t, g, unknown, or other
  misc_feature (493)..(493): n is a, c, t, g, unknown, or other
aaagctggagctccccgcggtggcggccgctctagaactagtggatcccccgggctgcaggaattcgcacgagaccattacctagaacatcctaatcgaaaaaacgtctacttctgtgatttcccccggcggcgttgggcgctggtttaggagaagaaaaggcggcgcgcggcggaaaaccctagcttagctcctctccggcgtcaagtgctctccggtttgagggcgcgatgagggtgaaggtgatttcgcgttccaccgacgactacacgcgcgagcgcagccaggacctgcagaaagtattccgcaactatgatccagcgcttcgtagtcaagagaaagctgttgagtatactcgggcactcaatgctgccaagttagagaagatatttgctaagccatttatcggagctatggatgggcatattgacgcggtatcgtgcatggccaaaaaccccaatcatttgaaagcaatattttctggttcagggnnatggagatgttcgcctttgggatattgctgcgaggaagaccagtttgtcagttccgggggcaccagggtgcttgtaagaggtttaacacatccaccagatggtgatcttcttgtatcaatgtggcggttgactgcacggtcgaactctggaaaagtccgatgctttaaatggtgga

SEQ ID NO: 11333 - protein, 146 aa, Zea mays
  misc_feature: Ceres CLONE 1359126-F
  misc_feature (88)..(88): Xaa is any aa, unknown, or other
MRVKVISRSTDDYTRERSQDLQKVFRNYDPALRSQEKAVEYTRALNAAKLEKIFAKPFIGAMDGHIDAVSCMAKNPNHLKAIFSGSGXWRCSPLGYCCEEDQFVSSGGTRVLVRGLTHPPDGDLLVSMWRLTARSNSGKVRCFKWW

SEQ ID NO: 11334 - DNA, 607 bp, Zea mays
  misc_feature: Ceres CLONE 1359127-R
  misc_feature (196)..(196): n is a, c, t, g, unknown, or other
tcgaggtcgacggtatcgataagcttttttttttttttttttggatcgaagttcccgagaaacttcaacacataaacacaatacagcacatttccttcttttagtttcagcagttagaacaacttacagggaagctggaaacataacaaaattggcgatgcggaataaaaggccacacaaggcacaacacaccacngcattacacaacagaaatatgaatcacaacccaaatctagctgcatgatatcgtttgggaatgttacgttatgggcaacctggagaagcacactttaggatggcttgccgacgtcaaattggaggaatgtgttatcaggcctctaactcatcaccctggttaggagagtccgcccgtgcttttggagcagacctgttaagcgaattcctgcgggttggtcccttccctgattctctgccaacattatttgggagggataaccgcttcttggctggtccattcacttgcacaagcttatcttttgaattgtgcacatccttagaacctatatctgttggctgggagctgacttcctcaaaaacttcacccacagcctttgccttctgtttggatgatcctaaagatgtggat

SEQ ID NO: 11335 - DNA, 744 bp, Zea mays
  misc_feature: Ceres CLONE 1359131-R
  misc_feature (1)..(1): n is a, c, t, g, unknown, or other
  misc_feature (605)..(605): n is a, c, t, g, unknown, or other
ncgattgggtaccgggccccccctcgaggtcgacggtatcgataagcttttttttttttttttttatttttttttttttttttttttttttttttttttttttaccgcatgctgtgccagcggctaatttgctgcttggatgggcaaaaaaaacgagacaagtctgatacatacattttattcatcggtgagatgtaacatgcaagaaaaactatggaacaagaggccggaatgaaagtttgtgtaagcgcctcaactcattctaaaacactcttcaaaatttatgtgatgacggtggggattgcagcgacttccatctaagagcagttcagaatggtatatctaaaagtttcttcctctgtattgttgcatctcaggcgcataataataaacaggacgagtctgccccccaatcgtcatttgttgcccatactgtggaccagcaggatgcatgtaaccgtgcggtgatgctccaggttgagtattgtacatgacaggctgggcgccatatgccggtgggaaccccatgcccacaggcaaaccgggtccaagtggcaccgccggcatgttattaggatagtaatatgatgcatcaaatgatgtanggtggtggtggcctcaaagatgctgacggagtgaaactcttggcattaggatttagcttgaattcttagcataggggtcaaagccaattttcagcggtaagagatcctattgagagcttggtgacaagccaggagcacc

SEQ ID NO: 11336 - DNA, 670 bp, Zea mays
  misc_feature: Ceres CLONE 1359149-F
  misc_feature: Encodes the peptide sequence at SEQ ID NO. 11337
  misc_feature (493)..(493): n is a, c, t, g, unknown, or other
  misc_feature (557)..(557): n is a, c, t, g, unknown, or other
  misc_feature (564)..(564): n is a, c, t, g, unknown, or other
  misc_feature (576)..(576): n is a, c, t, g, unknown, or other
  misc_feature (583)..(583): n is a, c, t, g, unknown, or other
  misc_feature (585)..(585): n is a, c, t, g, unknown, or other
  misc_feature (595)..(595): n is a, c, t, g, unknown, or other
  misc_feature (596)..(596): n is a, c, t, g, unknown, or other
  misc_feature (637)..(637): n is a, c, t, g, unknown, or other
  misc_feature (648)..(648): n is a, c, t, g, unknown, or other
  misc_feature (669)..(669): n is a, c, t, g, unknown, or other
aagctggagctccccgcggtggcggccgctctagaactagtggatcccccgggctgcaggaattcgcacgagaccattacctagaacatcctaatcgaaaaaaccgcgccgctctctctctctctctcgcacgagccgcgccggcgccgccaccacgcgcgcgggagacagagaccacagccgcagccaccggcgggcggaataggaatggtggcgccggggggaggagcaggaggaggtccgtcgcggtggccggcggcggaggaggaaggatgcgtgcatattagtttccgatgaccccacctgatcatgtacctagctgaacaaatgggactggaactgatcttgtcaaagttgcatgatctcaaatgggaaaccccatcttgacactgtacggaagaaggtggtggagattagtggaagggatgaacaagaggttatggttgctgcttgcccctacagaatttgccctttgggggctcatattgatcantcagggtggagtagtcacagctatgacataaattatggagtactcccttggtttcgtcccctcntatgggnttctgaggtttnacttcantnctgggccagnnttggaaggtgctataagaatccagaagttgatggacttgcnaaagcctattnggataacctgagactaaaaanc

SEQ ID NO: 11337 - protein, 103 aa, Zea mays
  misc_feature: Ceres CLONE 1359149-F
  misc_feature (45)..(45): Xaa is any aa, unknown, or other
  misc_feature (67)..(67): Xaa is any aa, unknown, or other
  misc_feature (69)..(69): Xaa is any aa, unknown, or other
  misc_feature (73)..(73): Xaa is any aa, unknown, or other
  misc_feature (75)..(75): Xaa is any aa, unknown, or other
  misc_feature (76)..(76): Xaa is any aa, unknown, or other
  misc_feature (79)..(79): Xaa is any aa, unknown, or other
  misc_feature (80)..(80): Xaa is any aa, unknown, or other
  misc_feature (97)..(97): Xaa is any aa, unknown, or other
MISNGKPHLDTVRKKVVEISGRDEQEVMVAACPYRICPLGAHIDXSGWSSHSYDINYGVLPWFRPLXWXSEVXLXXWAXXGRCYKNPEVDGLAKAYXDNLRLK

SEQ ID NO: 11338 - DNA, 621 bp, Zea mays
  misc_feature: Ceres CLONE 1359154-F
  misc_feature (221)..(221): n is a, c, t, g, unknown, or other
aagctggagctccccgcggtggcggccgctctagaatagtggatcccccgggctgcaggaattcgcacgagaccattacctagaacatcctaatcgaaaatcattgcaaaagcgaagcaaagcaatcgggattctctgcgatttctctagatctcgactaccccccactagttttggttcctccttttcgtcgagagagcgatctggtggcaatggcgaanagcgagggtccggggatcggaattgaactcggaacaactaatcgtggggcggggggtgggaaaacaaacggtgggagattattggccacagccaggggaaccgaccccccgctccatgtgggtttttccaaaacgagggggtcattggggggggtggggagaaaacaggggccccttgaccccccccaaaaccgggttttttaggcaaagggttgtacggaaggagggttttttttttccccccgggggaaagggaaagaaaatattgtgggggctaagggagacccccgggggcggtgggggaaaacccccgtgttgggtggggaaaaaaaaggggggggggaaaaaaaaattttttgggggggagaaaatctccccccggggggcccatcaaaaagag

SEQ ID NO: 11339 - DNA, 689 bp, Zea mays
  misc_feature: Ceres CLONE 1359156-F
aaagctggagctccccgcggtggcggccgctctagaactagtggatcccccgggctgcaggaattcgcacgagaccattacctagaacatcctaatcgaaaaatccaaaatgctactatgcattactaggtgtgcttctcttatgaagaaattttgatgctctgaaatattgaaggaaaccaaaacacctgtcaatccacctatcttgtcatggtagagctgtgggagatggatatccctcagatccacacaagggcgaaaacttcgctcggggccacgtggcagtttcccctctgaagcgtcccatcatgggccagacgaacaaagacaatgaaagcaggccgatctagaggcgaaagaggctcacgtccaagctaaccgcgacatagacgtggatatgtcaggtctgtttgttcccgcgcccgacatcctaactaaaacgacggggatagctcgacatgaaaacgccggattctactcgagatagtaaaagatgtttgctactaattaggagataagtaggaagactgcgatcgatacttgtgcgggaagacgcccatgtttgtgtatataaggctaaggaggaccccatctatttttatctcattagcatcccctcaggtcagtagtcaccgactgtaatctcatccgtatacaaagtcatcctaggaagtagtgtattacgctcc

SEQ ID NO: 11340 - DNA, 704 bp, Zea mays
  misc_feature: Ceres CLONE 1359163-F
  misc_feature: Encodes the peptide sequence at SEQ ID NO. 11341
  misc_feature (363)..(363): n is a, c, t, g, unknown, or other
aagctggagctccccgcggtggcggccgctctagaactagtggatcccccgggctgcaggaattcgcacgagaccattacctagaacatcctaatcgaaaaattcgcggtttgcctctctgccttccctacctcagatcctccctcagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatgggcatggaacatcgacttccctgagtttctncacctgatggcacgcaggatgaggacacagactctgaggaggagcctcagggagccttccgcggtgtcgacagggacagaacggcttcatctctgctgggtgactccgacatgcatgagccaacctaggggaaaactgaccgacaaggagggggttaaaatatccctgaaacccaactgggaccggggatgcccaaatcactaccaggggtttccgagaaggtatatatggccaatgagaaaaatggccccggtttaaaacaatctccccctcttgggggaaaaaacaacccaagggggggaaaaggaggggtttttggcccccttgttcccccctcggga

SEQ ID NO: 11341 - protein, 71 aa, Zea mays
  misc_feature: Ceres CLONE 1359163-F
  misc_feature (12)..(40): Pfam Name: efhand Pfam Description: EF hand
  misc_feature: SWISSPROT Homolog: EC 2.7.11.1 Non-specific serine/threonine protein kinase
  misc_feature (70)..(70): Xaa is any aa, unknown, or other
MADQLTDDQIAEFKEAFSLFDKDGDGCITTKELGTVMRSLGQNPTEAELQDMINEVDADGHGTSTSLSFXT

SEQ ID NO: 11342 - DNA, 678 bp, Zea mays
  misc_feature: Ceres CLONE 1359165-F
  misc_feature: Encodes the peptide sequence at SEQ ID NO. 11343
  misc_feature (502)..(502): n is a, c, t, g, unknown, or other
agagctggagctccccgcggtggcggccgctctagaactagtggatcccccgggctgcaggaattcgcacgagaccattacctacaacatcctaatcgaaaaatcgcacaaatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccaggggccgcaccctctacggtttcggcggttaggtcgcccctctccgggtncgaattacgtgggggcggtggcggccgtgttgtgttcttggcctagttagtctgtgttgtctttaacggggctggtttctgggggggttgaactgcatcgttctagtttcctagccatgggctgtaatatctccctgctggaaacaatggaatggcctcgtttcaagccaaaaaaa

SEQ ID NO: 11343 - protein, 126 aa, Zea mays
  misc_feature: Ceres CLONE 1359165-F
  misc_feature (25)..(94): Pfam Name: Histone Pfam Description: Core histone H2A/H2B/H3/H4
  misc_feature (111)..(111): Xaa is any aa, unknown, or other
MSGRGKGGKGLGKGGAKRHRKVLRDNIQGITKPAIRRLARRGGVKRISGLIYEETRGVLKIFLENVIRDAVTYTEHARRKTVTAMDVVYALKRQGPHPLRFRRLGRPSPGXNYVGAVAAVLCSWPS

SEQ ID NO: 11344 - DNA, 685 bp, Zea mays
  misc_feature: Ceres CLONE 1359172-F
  misc_feature: Encodes the peptide sequence at SEQ ID NO. 11345
  misc_feature (392)..(392): n is a, c, t, g, unknown, or other
  misc_feature (525)..(525): n is a, c, t, g, unknown, or other
  misc_feature (570)..(570): n is a, c, t, g, unknown, or other
  misc_feature (602)..(602): n is a, c, t, g, unknown, or other
  misc_feature (655)..(655): n is a, c, t, g, unknown, or other
aagctggagctccccgcggtggcggccgctctagaactagtggatcccccgggctgcaggaattcgcacgagaccattacctagaacatcctaatcgaaaaactacacacaaacacacaatggcaccagaaaggatgctcctcggcgtctgtgccgtgctgatggtggtcggcgtcacgaacgcggcggagggccaggtggcgtcggtcgtcgtgggcctggcgaggtgcgccgacagcacgaggaagaacatgaaggctgaggccggtttcaagggtcttcaggtggcgatcaagtgcaagaacagcaacggcgagtacgagacaaaggccgtgagtgagatccaaagctccggagccttcagcgtcccactcgccgccgacctccacggngccgactgccacgcgcagctccacagcgccgccaataacgcgccttgccctggggcagagccgtccaggatcgcgcccatgtcaggcggcaccttcgtcgccgtgcctggcaagatgcactacccgtccgcgnagtgcgcgtccgcgtttctctgctccccgatcaggaagcacttgntagatcacttcaacaagcacccctggcggtgncggaataccacccggtgcctgaccacagcaagccggccgtggcggaagtacancccggtggctgagcacaagaagacggggcc

SEQ ID NO: 11345 - protein, 188 aa, Zea mays
  misc_feature: Ceres CLONE 1359172-F
  misc_feature (31)..(188): Pfam Name: DUF1210 Pfam Description: Protein of unknown function (DUF1210)
  misc_feature (136)..(136): Xaa is any aa, unknown, or other
  misc_feature (151)..(151): Xaa is any aa, unknown, or other
  misc_feature (161)..(161): Xaa is any aa, unknown, or other
  misc_feature (179)..(179): Xaa is any aa, unknown, or other
MAPERMLLGVCAVLMVVGVTNAAEGQVASVVVGLARCADSTRKNMKAEAGFKGLQVAIKCKNSNGEYETKAVSEIQSSGAFSVPLAADLHGADCHAQLHSAANNAPCPGAEPSRIAPMSGGTFVAVPGKMHYPSAXCASAFLCSPIRKHLXDHFNKHPWRXRNTTRCLTTASRPWRKYXPVAEHKKTG

SEQ ID NO: 11346 - DNA, 672 bp, Zea mays
  misc_feature: Ceres CLONE 1359174-F
  misc_feature: Encodes the peptide sequence at SEQ ID NO. 11347
  misc_feature (576)..(576): n is a, c, t, g, unknown, or other
aagctggagctccccgcggtggcggccgctctagaactagtggatcccccgggctgcaggaattcgcacgagaccattacctagaacatcctaatcgaaaacttccgcttccaacttccgttccgcaaattgaaagctcggcgttgccctgcgcccctgcctcgagctcgaaggactttgtccctatacgtcgttgtccagctcctcgcatattgtggcctggtgcagattggagatccgcccggacttggatcgagtcctcctgtctttggacattcattggagtgctccattcattgagacagcatgcctaagataaagacaagccgtgtcaagtatcctgaaggatgggagcttattgaaccaacaatccgtgagttggatgccaaaatgagagaagctgaaaatgatccacatgatggaaagagaaagtgtaaagctctctggcctattttccgcatttctcatcacaggagccgctacatatacgatctttattacagaaggaaggagatatcacaggagctttatgagttctgcctacaccagggttatgcagaccgtaacctgattgcnaagtggaaaaagttacgagcgcctttgctgcctccgggcatacagacacgtgatcacaacttcgcaacgacatgcgtctgtcgcgtccccagcatc

SEQ ID NO: 11347 - protein, 122 aa, Zea mays
  misc_feature: Ceres CLONE 1359174-F
  misc_feature (1)..(121): Pfam Name: G10 Pfam Description: G10 protein
MPKIKTSRVKYPEGWELIEPTIRELDAKMREAENDPHDGKRKCKALWPIFRISHHRSRYIYDLYYRRKEISQELYEFCLHQGYADRNLIAKWKKLRAPLLPPGIQTRDHNFATTCVCRVPSI

SEQ ID NO: 11348 - DNA, 780 bp, Zea mays
  misc_feature: Ceres CLONE 1359176-F
  misc_feature: Encodes the peptide sequence at SEQ ID NO. 11349
ctataactagtggatcccccgggctgcaggaattcgcacgagaccattacctagaacatcctaatcgaaaattactttctcccttagaatctcctctcccctcgttctcctccgcctcctcctcccacctccccacacgggcacacctgccctccccgtcgccgcggacccactcccatgggaaagctcccgcgtctaccctgctcgattgccgttctcgcgctcatgtgcatcatcccgctcacagcgccgcggcctgaactgtcctcacgcgcggccccaaggaaaggggtctccttcgccggcgcagacaacacaatacatcagcttcttaaaaatcaccgcccttcgcggaagtactgcttcccgcgcggccgtgggaagccataacaccctagaacgaaatcaacccgtcattccttggagcttcccgattgccaaacaaccttcttacctcccccgaaccacacaacgggggaaacgggccctaattagaacaacgctggtgagccggctacaccatcaacaaaaggaccgcgccttcccaagagcggggaaaggtcccccccccccaaggggggaggatctgtgattttgggttcccccggccaaagggcatatccttccgttccgaggagcacaagaaaccgcgggaatctgcttcctttttcacacacacgcggagttataacccaccaaaaaaacacgcgccacagcgctacctaaagcttaatgggcgaaccccctcgtcctcgcgacatattccatccgacactccgg

SEQ ID NO: 11349 - protein, 70 aa, Zea mays
  misc_feature: Ceres CLONE 1359176-F
MGKLPRLPCSIAVLALMCIIPLTAPRPELSSRAAPRKGVSFAGADNTIHQLLKNHRPSRKYCFPRGRGKP

SEQ ID NO: 11350 - DNA, 707 bp, Zea mays
  misc_feature: Ceres CLONE 1359183-F
  misc_feature: Encodes the peptide sequence at SEQ ID NO. 11351
  misc_feature (352)..(352): n is a, c, t, g, unknown, or other
  misc_feature (388)..(388): n is a, c, t, g, unknown, or other
  misc_feature (392)..(392): n is a, c, t, g, unknown, or other
  misc_feature (398)..(398): n is a, c, t, g, unknown, or other
aagctggagctccccgcggtggcggccgctctagaatagtggatcccccgggctgcaggaattcgcacgagaccattacctagaacatcctaatcgaaaagccatccatttttcatatcctcactcgccgccgccgccgctcgtccctcgccccatcgcgatggcccggatcaaggtgcacgagctgcgggggaagagcaaggcggatctgcaagcgcagcttaaggagtttaagtcggagctctccctgctacgcgtagccaaggtcaccggcggggctcccaacaagctctccaagatcaaggttgtgcgcacctccatcgcgcgcgtgctgaccgtcatctcccaaaancaaaaaatcgcgctgcgtgaggggtacaagaagaanaagntggttnccgctcgacctccgccccaaggggacccgcggccatccggagggggctcaccaagcaccagcttctccttgagaacgaaagaaaaagaagcgggaaaagtatttcccatgagggaagtcgttatcagggcctaaatccgggaaaaaacttttttcctggcaggttttgctccaaaagttctttgaatttgaaaaaatctatttccctcccaagacctttggaactggaccccttggatggagaaaaaagaggtacttttttggttttttaaacgggtttttaattttttaggttcccaaaaaaaaaaaa

SEQ ID NO: 11351 - protein, 123 aa, Zea mays
  misc_feature: Ceres CLONE 1359183-F
  misc_feature (6)..(64): Pfam Name: Ribosomal_L29 Pfam Description: Ribosomal L29 protein
  misc_feature (64)..(64): Xaa is any aa, unknown, or other
  misc_feature (76)..(76): Xaa is any aa, unknown, or other
  misc_feature (78)..(78): Xaa is any aa, unknown, or other
  misc_feature (80)..(80): Xaa is any aa, unknown, or other
MARIKVHELRGKSKADLQAQLKEFKSELSLLRVAKVTGGAPNKLSKIKVVRTSIARVLTVISQXQKIALREGYKKXKXVXARPPPQGDPRPSGGGSPSTSFSLRTKEKEAGKVFPMREVVIRA

SEQ ID NO: 11352 - DNA, 719 bp, Zea mays
  misc_feature: Ceres CLONE 1359184-F
  misc_feature: Encodes the peptide sequence at SEQ ID NO. 11353
  misc_feature (320)..(320): n is a, c, t, g, unknown, or other
  misc_feature (351)..(351): n is a, c, t, g, unknown, or other
aaagctggagctccccgcggtggcggccgctctagaactagtggatcccccgggctgcaggaattcgcacgagaccattacctagaacatcctaatcgaaaaatccatcgagctgcccgcgcgcggcagttaagctcacacatcagctagctcaccttggacggccgaccaggtacgttgcgagcgatggcgggatacaaagcgtcgggcggcacggcgctcggcgtcgtcctggctgttgccgcgctcctcgccgcggcggcgatggcggtggacgacgagcacatgtaccactggaagtgcttcaactcgtgcacggngaagtgccgcgacgaggacgcctttgacgancgccaccgttccggggattcgaacgtctcttccgtcgtctctggcgggaagtgcaacaacaggtgcctcagcgagtgcttcgagaacctgccggccatctgctaccaccaggggcgtctcaggaagtgcccttcgctttcccacctcttaacaaaaaaaaaaccattggcatgaaaaacctgttgaaaaaagggttcccccccagggccccccaggccttggcctggccccaaacccaagcccccaaagggctgggccccccaaaccccctgcccccaaaaccaaaacaagaggccccgggccaaaaccccccgcccccagggggccccccccccaaaaaaaacggttcccctccccccccaaaaaaa

SEQ ID NO: 11353 - protein, 112 aa, Zea mays
  misc_feature: Ceres CLONE 1359184-F
  misc_feature (45)..(45): Xaa is any aa, unknown, or other
  misc_feature (55)..(55): Xaa is any aa, unknown, or other
MAGYKASGGTALGVVLAVAALLAAAAMAVDDEHMYHWKCFNSCTXKCRDEDAFDXRHRSGDSNVSSVVSGGKCNNRCLSECFENLPAICYHQGRLRKCPSLSHLLTKKKPLA

SEQ ID NO: 11354 - DNA, 677 bp, Zea mays
  misc_feature: Ceres CLONE 1359189-F
  misc_feature (415)..(415): n is a, c, t, g, unknown, or other
aaagctggagctccccgcggtggcggccgctctagaactagtggatcccccgggctgcaggaattcgcacgagaccattacctagaacatcctaatcgaaaaatcagacactcgactctcctctgtcgaatcaggagtctctctagctctactccatcccctcgatctccaagtgcagcaacatcagccaggcggccatggacgccataggaatcggagccggcggataacgaaagaaggccgcggccgggcgcaaggcctgtccaccgaagaaaaactcggtaacgaggtccgtgcaaggccgcgctgcactttcacgtcgaccgcatcgacctgccactgaagaaggtgctgtacgtgcacggcgtcagcacggacgcccgcgtctgactgttcgtcgtcctcgagtacctgntcgacgagtagtatgtacctgacagggactctgacggtgacagatgaatgagccgatcatcccgcgcacgagctgcttgcatccgtacgacgatgatttcgctagctgctgtcagggtcacatcagccaatgcggtgtcctccccacatcaacccgatggtctggcctagacgacgatgataagggggggccagggagtgcagtcctctagaagtcggctagtccccaacaagcatgagggggggcgctttacagtaggagt

SEQ ID NO: 11355 - DNA, 715 bp, Zea mays
  misc_feature: Ceres CLONE 1359191-F
  misc_feature: Encodes the peptide sequence at SEQ ID NO. 11356
  misc_feature (559)..(559): n is a, c, t, g, unknown, or other
  misc_feature (560)..(560): n is a, c, t, g, unknown, or other
aagctggagctccccgcggtggcggccgctctagaatagtggatcccccgggctgcaggaattcgcacgagaccattacctagaacatcctaatcgaaaaacaacacaacaacaacaaccatctccaacgcagcaagcagacagaaggacaggcaggcagcgagtgcaaccgcgagagcgatcagcgatgggctccttcttctcgaccttagtgacgccccctccggccgcgacgacccgaactgcgccgtggtggccgcgcactccaggccacctacgacgagcagtgggcggcccacaagagcagcagcaagctgatggtgatcgacttctcggcgtcctggtgcgggccctgcccgctcatcgagccggccttcagggactgggcctccgcttcaccgatggcatcttcgtaaggttggacgtccacgaccttccggagtcccaaggacatggaagtaaagggcaatgcaacgttcgggctgtccaaggatggaaagaaggaacccctgggattgggcttaaaaagaccaacttggaaaagaaaaacgggtgtttnnaacgaaattttccccggcaaaaataagaggggaaaacccccccccctttttaatgggttcccaaccccggggggcccccgggaacgggggttgggaaaaagtccccccctccccgggggcggggaaaaccaaaaagagagtttttgaaaagggga

SEQ ID NO: 11356 - protein, 32 aa, Zea mays
  misc_feature: Ceres CLONE 1359191-F
MVIDFSASWCGPCPLIEPAFRDWASASPMASS

SEQ ID NO: 11357 - DNA, 752 bp, Zea mays
  misc_feature: Ceres CLONE 1359195-F
  misc_feature: Translation starting site: 210
  misc_feature (366)..(366): n is a, c, t, g, unknown, or other
  misc_feature (374)..(374): n is a, c, t, g, unknown, or other
  misc_feature (383)..(383): n is a, c, t, g, unknown, or other
  misc_feature (390)..(390): n is a, c, t, g, unknown, or other
  misc_feature (393)..(393): n is a, c, t, g, unknown, or other
  misc_feature (431)..(431): n is a, c, t, g, unknown, or other
  misc_feature (465)..(465): n is a, c, t, g, unknown, or other
aaagctggagctccccgcggtggcggccgctctagaactagtggatcccccgggctgcaggaattcgcacgagaccattacctagaacatcctaatcaaaagagaaagtcagatccgtgttccgtgtccgcgtccagtgtgtccgctactccgctccccctcagtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgagggaggccacagcgccaagaagctggtggtgattgacttcactggcacatggntgtctccngtgccgcgncatggcntcnattttggctgatatggcccaagaagtccccaaatggtngtttccctggaagtttgatgtcaatggaatgaangaccttggctgagcaatttcagggtaaagggcatgcaaaactttcttggtcttggagggagggcgaacctcaagggacaaggttcctttggcccacacaaaggaaaaaacttaccaggggaagtttggaactaccatggggcccccaaaaaaaggggagggccgcaaaggaaatattcccccaaaaaaaaagggggcccccccccccccctctaaaaaaaaaaaggggtttgtggggggggaaatttaaaaaaaaaaagcccccccttttggggggaatttttctta

SEQ ID NO: 11358 - DNA, 653 bp, Zea mays
  misc_feature: Ceres CLONE 1359197-F
  misc_feature: Encodes the peptide sequence at SEQ ID NO. 11359
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcaaaaattcccagccaatcgcctctcgcttttaaatcctgcgccctaccgccgcctccactcccaccgctctcaatcctcccgcctcttcctaatccgcctcctcccgctcagtcgccgccgtggaggaaggagcaactcgatcgccagtcatgacccggggagagaaccaggagtcgcagaccgggaacgtctccgccgcatctgcggctgcgccgggaccgaagccggcatcggcgggggccgggaagggcgcggagggccagtcggtggtgcggcggctgcagtcggagctgatggcgctgatgatgggcggcgaccccggcgtgtcggcgttccccgagggggacaacatgctccactggggtggcaccatcgcgggatccgccccggacggctacgagggcacctcctaccgcctcgcgctggncttcacccgcgagtacccgtacaagccgcccaaggtgcggttcgacaccccctgcttccacccaaacgtcgacgtgcacggcaacatctggctggaacatctcccaggacagtggtcctccgcctaca

SEQ ID NO: 11359 - protein, 135 aa, Zea mays
  misc_feature: Ceres CLONE 1359197-F
  misc_feature (43)..(135): Pfam Name: UQ_con Pfam Description: Ubiquitin-conjugating enzyme
  misc_feature: SWISSPROT Homolog: EC 6.3.2.19 Ubiquitin--protein ligase
  misc_feature (93)..(93): Xaa is any aa, unknown, or other
MTRGENQESQTGNVSAASAAAPGPKPASAGAGKGAEGQSVVRRLQSELMALMMGGDPGVSAFPEGDNMLHWGGTIAGSAPDGYEGTSYRLALXFTREYPYKPPKVRFDTPCFHPNVDVHGNIWLEHLPGQWSSAY

SEQ ID NO: 11360 - DNA, 679 bp, Zea mays
  misc_feature: Ceres CLONE 1359206-F
  misc_feature: Encodes the peptide sequence at SEQ ID NO. 11361
  misc_feature (566)..(566): n is a, c, t, g, unknown, or other
  misc_feature (583)..(583): n is a, c, t, g, unknown, or other
aaagctggagctccccgcggtggcggccgctctagaactagtggatcccccgggctgcaggaattcgcacgagaccattacctagaacatcctaatcgaaaaatatacgccgccatattcgcaagccaccgcaaccgaagcgcgccttcgccgccgcccccgcccccgccgcctctgcgatccccgcaaggtcgcaaacatgtctaccgtgctccagcgcccgacccccggcacggtccagtgcttcggccgcaagaagacggctgtggccgtcgcctacaccaagccggagcgcgagctgatcaaggtgaacggcgtcccgattgagctcatcaggccggagatgctccgcctcaaggccttccagcccatcctgctggcggtgcgctcccagttcaaggacatcgacatgaggatccgcgtccgaggcggcggtaagacgtcgcatatctacgccatccggcaggccgtcgccaaggggctcgtcgcctactaccagaagtacgtcaacgaggccgcccagaaagaggtcaaggacattcttcacccggtacgacggcaccttnctcgtcgccgaccccangtgctgcgagccgaaaaagttcggtgggtcctggcgcccgcgcaggttccagaagtcctaccgttgagcgctcggctgccagctctttgcggaaag

SEQ ID NO: 11361 - protein, 160 aa, Zea mays
  misc_feature: Ceres CLONE 1359206-F
  misc_feature (17)..(131): Pfam Name: Ribosomal_S9 Pfam Description: Ribosomal protein S9/S16
  misc_feature (123)..(123): Xaa is any aa, unknown, or other
  misc_feature (128)..(128): Xaa is any aa, unknown, or other
MSTVLQRPTPGTVQCFGRKKTAVAVAYTKPERELIKVNGVPIELIRPEMLRLKAFQPILLAVRSQFKDIDMRIRVRGGGKTSHIYAIRQAVAKGLVAYYQKYVNEAAQKEVKDILHPVRRHLXRRRPXVLRAEKVRWVLAPAQVPEVLPLSARLPALCGK

SEQ ID NO: 11362 - DNA, 697 bp, Zea mays
  misc_feature: Ceres CLONE 1359211-F
  misc_feature: Encodes the peptide sequence at SEQ ID NO. 11363
  misc_feature (568)..(568): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (697)..(697): n is a, c, t, g, unknown, or other
aaagctggagctccccgcggtggcggccgctctagaactagtggatcccccgggctgcaggaattcgcacgagaccattacctagaacatcctaatcgaaaaagaagccaccctgccgcctcaccgcctctctcactctgagaccgcagatccgttgtccggtgagtggaagccgcacgaacccatggcctccggcgagcttgcctgcacctacgccgctctcatcctcagcgacgatggcatcgccatcaccgccgagaagatcgccacgatcgtgaaggcggccaacatcaaggtcgagtcctactggccggcactcttcgccaagctcctggagaagcgcaacgtcgagggcctcatcctctccgttggatctggtggcggagctgctccagttgctgctgccgcacctgctggtggtgctgcggctgctgctgccccggctgtcgaggagacgaagcagaggccaagggagagtctgatgacgacatgggcttcagcctgttcgactgaggagaccccctcacccagccattagcaaattgtactggtgctgtcaaagactatnctgnnnctatgtatgcctctaggcttttgttacacctacccaagttttgagtttttgagatgtggctatggcatgaactcaaaccatcttatggagggtgaacctgggttctaatttccatattgctgn

SEQ ID NO: 11363 - protein, 117 aa, Zea mays
  misc_feature: Ceres CLONE 1359211-F
  misc_feature (21)..(92): Pfam Name: Ribosomal_60s Pfam Description: 60s Acidic ribosomal protein
MASGELACTYAALILSDDGIAITAEKIATIVKAANIKVESYWPALFAKLLEKRNVEGLILSVGSGGGAAPVAAAAPAGGAAAAAAPAVEETKQRPRESLMTTWASACSTEETPSPSH

SEQ ID NO: 11364 - DNA, 684 bp, Zea mays
  misc_feature: Ceres CLONE 1359214-F
  misc_feature: Encodes the peptide sequence at SEQ ID NO. 11365
  misc_feature (412)..(412): n is a, c, t, g, unknown, or other
  misc_feature (413)..(413): n is a, c, t, g, unknown, or other
  misc_feature (481)..(481): n is a, c, t, g, unknown, or other
  misc_feature (482)..(482): n is a, c, t, g, unknown, or other
  misc_feature (565)..(565): n is a, c, t, g, unknown, or other
aaagctggagctccccgcggtggcggccgctctagaactagtggatcccccgggctgcaggaattcgcacgagaccattacctagaacatcctaatcgaaaaatcgcgatttcccctcgcagtctctcgcacgcgccggcatggcgacgctcgcgcggtggcatctacaacctcctactgcccgccccctcgctcaccggcggaggatcccgcgtcgggctgcgaccgtggtttccccgcgcgcgttcagccgcgcggacttcgatggcttcgtgcggcgcgcgtggcagggcgccaacgcgggggccgagcgcttcgccttcgagggcacgcaggccgcgcagcggctggacagcaggttctcgatctcccggaggctcgcggacgcttcccgtgccgcccgcgcccgcgnncgtgagatcgacgccgagtttcgcatcgggcggaggtggcgctccttctctgtcgacttctcccgcanntggcccagtatcggagggacattcatgacttcatgggaactcccatcgggagagcatttagctacatatttttcctgtggatncactgtcggggtgggttgtcagaactttcatttttggaacgtttgagctggcatttgctgcccctcttctccctgggacctttgctaacagggttgccatggagggacatgcccagcag

SEQ ID NO: 11365 - protein, 156 aa, Zea mays
  misc_feature: Ceres CLONE 1359214-F
  misc_feature (91)..(91): Xaa is any aa, unknown, or other
  misc_feature (114)..(114): Xaa is any aa, unknown, or other
  misc_feature (142)..(142): Xaa is any aa, unknown, or other
MATLARWHLQPPTARPLAHRRRIPRRAATVVSPRAFSRADFDGFVRRAWQGANAGAERFAFEGTQAAQRLDSRFSISRRLADASRAARARXREIDAEFRIGRRWRSFSVDFSRXWPSIGGTFMTSWELPSGEHLATYFSCGXTVGVGCQNFHFWNV

SEQ ID NO: 11366 - DNA, 684 bp, Zea mays
  misc_feature: Ceres CLONE 1359216-F
  misc_feature: Translation starting site: 210
  misc_feature: Pfam Name: Ribosomal_S15 Pfam Description: Ribosomal protein S15
  misc_feature: Pfam Name: Ribosomal_S13_N Pfam Description: Ribosomal S13/S15 N-terminal domain
  misc_feature (309)..(309): n is a, c, t, g, unknown, or other
  misc_feature (454)..(454): n is a, c, t, g, unknown, or other
  misc_feature (455)..(455): n is a, c, t, g, unknown, or other
  misc_feature (465)..(465): n is a, c, t, g, unknown, or other
  misc_feature (492)..(492): n is a, c, t, g, unknown, or other
  misc_feature (493)..(493): n is a, c, t, g, unknown, or other
  misc_feature (504)..(504): n is a, c, t, g, unknown, or other
  misc_feature (594)..(594): n is a, c, t, g, unknown, or other
  misc_feature (624)..(624): n is a, c, t, g, unknown, or other
cagagctggagctccccgcggtggcggccgctctagaactagtggatcccccgggctgcaggaattcgcacgagaccattacctagaacatcctaatcgaaaactctgctaacgccgctcgcgcatcctattgccctcgcgccaccgtcgccgccgctgcagcgagccaccgccctgccgtcgcctgaggtagacaccaagccaccgccatggggcgtatgcacagccgcgggaagggtatctcttcatcggcgctgccgtacaagaggactcctccgatctggctcaagacagctaccaccgaggtgnaggagatgattaccaaggctgcgaagaagggccagatgccgtcgcagattggtgttctgctccgcgaccagcacgcatcccgcttgtcaagagcgtgactggtaacaagatcctccgcatccctcaggcccatggggtggcgccnngagatcccgnagatctctacttcctcattaagaaggnncgtgcgattangaagcatctggagaggaacagaaagacaaggactccaaattcagactcattctttgtgagagcaggatccaccgccttgcccgctactancagcgtaccaagaagctcccacccacctgnaagtacgagtcaaccacggcgagcactctgggtggcctaagtgatatcctctgatggctt

SEQ ID NO: 11367 - DNA, 727 bp, Zea mays
  misc_feature: Ceres CLONE 1359217-F
  misc_feature: Encodes the peptide sequence at SEQ ID NO. 11368
  misc_feature (361)..(361): n is a, c, t, g, unknown, or other
  misc_feature (605)..(605): n is a, c, t, g, unknown, or other
  misc_feature (692)..(692): n is a, c, t, g, unknown, or other
tggagctccccgcggtggcggccgctctagaactagtggatcccccgggctgcaggaattcgcacgagaccattacctagaacatcctaatcgaaaaacttctccgccgcccactccatggaggacgacgccatctcgacgctcatggacatcgacgactcgccgctcagcgctgcgggggccgggttcctcgacgaggaggacggggaaggcgagatgttcttcgccccgcaccgcgcggcccgcggcggcgctggcgatgcccgcgggcccctccccttttccgggttcttcaacagcttcgacggcgccgattttgacgacgacgacctcgcctgagggaactcccacccggttcggnaacggatgttgttcgtggatcgcgaatcgtgttatgtcgataccgggatggggtctcttaattagcgcatcgattcagactcgtttgggcaatctgaagatgtttagggatcaacattacctttgggtacctttgtggcctatggtccgcgaatgaacaggggatcatataaggaccctttgtgcccccagaaaaaaaaaaaaaaaagcttattcaataccggtccaccctccaaggagggggncccgggcaacccaatttcccccccaatagggggagtcgaaattaaccccccccactccccatgggccgtgcaggttgtaacaaaccncccgcgaacctggggaaaataaccctggggggttt

SEQ ID NO: 11368 - protein, 73 aa, Zea mays
  misc_feature: Ceres CLONE 1359217-F
MEDDAISTLMDIDDSPLSAAGAGFLDEEDGEGEMFFAPHRAARGGAGDARGPLPFSGFFNSFDGADFDDDDLA

SEQ ID NO: 11369 - DNA, 679 bp, Zea mays
  misc_feature: Ceres CLONE 1359221-F
  misc_feature: Translation starting site: 181
  misc_feature (591)..(591): n is a, c, t, g, unknown, or other
caaagctggagctccccgcggtggcggccgctctagaactagtggatcccccgggctgcaggaattcgcacgagaccattacctagaacatcctaatccaaaaactagccaccgcatcgtcgccctcaaattcgttccgtccaggcaaggaagaaatcgagcagccaaggagaggagaagatggctcgtacgaagcagaccgcccgcaagtccaccggaggcaaggccccgcgcaagcagctcgccaccaaggcggcgaggaagtctgcgccgacgaccggcggcgtgaacaagccccacaggtacagggcccgggacggtggctctgcgcgatatccgcaagtaccagaagagcacggagctgctgatccggaagttgcccttccagcgcctggtccgtgagatcgctcaggacttcaagacggatctgcggattcagagacacgccgtcctggccctccaggaaagctgcgagggctacctcgtcggactgttcgaggacactagctctgcgccatccacgccaagcgcgtcatcatcatgccctaagacatccagctcgtccgacgaatgcgcggcgagcgcgcgtangcgtatctcgcgcccggacccattgacgtcgcaggaatggaagaggtcactagcaccttgatgctgattgtcgcttttagacggcggg

SEQ ID NO: 11370 - DNA, 700 bp, Zea mays
  misc_feature: Ceres CLONE 1359224-F
  misc_feature: Translation starting site: 202
aaagctggagctccccgcggtggcggccgctctagaactagtggatcccccgggctgcaggaattcgcacgagaccattacctagaacatcctaatcgaaaaagaagcatcacacactaatcaacaagcaggaccagctagctagctcctctcactgctatcacccgcccagccatctcgctgaaagagaaaagcgcagccatgaagactactagctcgggcattgcagtcgtcctactggtggccatgctggcagtccattccgcgttgcacgacatctcgtgctccgacgagctcaacgacctgtcgccgagcctgcccttcctgcagggcaaggcagccaaacccagcgagagcaacaaccagtgctgcgacggcgtgagggccctgtacgcggtggtggacatcagtgcccgacaggcaggccacgtggcgttgcctcatgtcgggctacgttcaggtccacgctgtgctctccgcggcacaagagctgcccggagactggcgcctctcggtgtcctacacatcacccccgctcagtacctcgaaattgcctggaggcttggccctgcaaggaggcaccctggcttgacatcaagccggacagggaaggggcatggcaatcccaaggaaattggaagcctttgttttcaggccagtcccatggaccccttgaggatttgttggaaacctttttaag

SEQ ID NO: 11371 - DNA, 696 bp, Zea mays
  misc_feature: Ceres CLONE 1359232-F
  misc_feature: Encodes the peptide sequence at SEQ ID NO. 11372
  misc_feature (369)..(369): n is a, c, t, g, unknown, or other
  misc_feature (395)..(395): n is a, c, t, g, unknown, or other
  misc_feature (404)..(404): n is a, c, t, g, unknown, or other
  misc_feature (485)..(485): n is a, c, t, g, unknown, or other
  misc_feature (545)..(545): n is a, c, t, g, unknown, or other
aaagctggagctccccgcggtggcggccgctctagaactagtggatcccccgggctgcaggaattcgcacgagaccattacctagaacatcctaatcgaaaaccgcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccagntttgaccgtcgagggagtctgattgnatacatggncacgccgagttgaactacccaagcttctttatcagtagcagagcatgctactctatgtacttttggaacctaggctattanacctgtcaggtgttggatgtctggatctggcatttttggaaaaataccattttacctcgntccaggatgcaggatttttcctggttaactggccaataccttaaattttatgcctggttccaaaaaaaaaaaaaaaaagttatcgataccgcccaactcgggggggggcgcggaaccccattcccccataaaggggggcaatattccgggt

SEQ ID NO: 11372 - protein, 69 aa, Zea mays
  misc_feature: Ceres CLONE 1359232-F
  misc_feature (2)..(69): Pfam Name: Ribosomal_L38e Pfam Description: Ribosomal L38e protein family
  misc_feature (63)..(63): Xaa is any aa, unknown, or other
MPKQIHEIKDFLLTARRKDARSVKIKRSKDVVKFKVRCSKYLYTLCVFDAEKANKLKQSLPPXLTVEGV

SEQ ID NO: 11373 - DNA, 693 bp, Zea mays
  misc_feature: Ceres CLONE 1359233-F
  misc_feature: Encodes the peptide sequence at SEQ ID NO. 11374
  misc_feature (553)..(553): n is a, c, t, g, unknown, or other
aaagctggagctccccgcggtggcggccgctctagaactagtggatcccccgggctgcaggaattcgcacgagaccattacctagaacatcctaatcgaaaacttgctaacgaggtgagagagtgttggggccgccgctcttgagggatagaagaagaggatacagcaagcgggggttgcgaggaggcggcggacgctatgggcaacgccgggagtgcgccggaccagcccaagaactcggcggatggggccggcgctgccgacgcggagtctcgccgcgggccgccgtctacggtgcgtttcttccccgatggggagcgccacaaggcacggcagccgccgccaataaagctcgaggaggaggagcgcgtcccgccgccgcccgccaccgaggaggagatggccccgcgcaacctctggcaggtgtatgcgcttggggcgttcattggtgtgagatggggcctgggctaagagggaagagaaccaggacagaaaaggactcacctgatgctggggatgggaatgcaccggacagatcgacttaatctccggnggctgctgcgtggactaggctacccgcgaggatgaatgccgtttcccgataagccaacgatgatggatcattctagctaatgcatcatataatgggcatcaaggtggctgtggatttatgtattttcctggacattttca

SEQ ID NO: 11374 - protein, 90 aa, Zea mays
  misc_feature: Ceres CLONE 1359233-F
MGNAGSAPDQPKNSADGAGAADAESRRGPPSTVRFFPDGERHKARQPPPIKLEEEERVPPPPATEEEMAPRNLWQVYALGAFIGVRWGLG

SEQ ID NO: 11375 - DNA, 727 bp, Zea mays
  misc_feature: Ceres CLONE 1359235-F
  misc_feature: Encodes the peptide sequence at SEQ ID NO. 11376
  misc_feature (293)..(293): n is a, c, t, g, unknown, or other
  misc_feature (344)..(344): n is a, c, t, g, unknown, or other
  misc_feature (350)..(350): n is a, c, t, g, unknown, or other
  misc_feature (351)..(351): n is a, c, t, g, unknown, or other
  misc_feature (405)..(405): n is a, c, t, g, unknown, or other
  misc_feature (433)..(433): n is a, c, t, g, unknown, or other
  misc_feature (434)..(434): n is a, c, t, g, unknown, or other
  misc_feature (440)..(440): n is a, c, t, g, unknown, or other
  misc_feature (443)..(443): n is a, c, t, g, unknown, or other
  misc_feature (444)..(444): n is a, c, t, g, unknown, or other
aaagctggagctccccgcggtggcggccgctctagaactagtggatcccccgggctgcaggaattcgcacgagaccattacctagaacatcctaatcgaaaaatcacccaaaacacaagtagggttaggaaggcggcggccagcggcgagagcgcgagaggaggaggggtcggccatgacggggaaggcgaagccgaagaacacacagcgaaggagatcgccgcgaagatcgacgcggcgacgacgaaccggggcggcggcaaggccgggcaggcggaccggctggggcaggnacagggcgggcacgcgaagctggcgtgccccctctggcgcaccccggcccngacatnncagtcatgcagatccaccacgaggcgcgccaccccagctccccttcgaggcggnagaggctcttcaacctggcactcctcgnnccccgntgnntgctgccgcgcccccgccactggccagggccccacctcaagcccaaggccggggtccggggagccctaaaaaaaaactttgctgggttgggtggcctcccccccccggatgggggccaaattcccttgtggttttaaccccctccgcggggcccggatttaaaataaaaaaatcccccccttccccggccgggggggggcccaaaacgccccgggggggaaatgtgaacggtgtggaatttccccgggttaaacgcggcgaaacagggggggggggaaaaaaa

SEQ ID NO: 11376 - protein, 170 aa, Zea mays
  misc_feature: Ceres CLONE 1359235-F
  misc_feature (98)..(98): Xaa is any aa, unknown, or other
  misc_feature (115)..(115): Xaa is any aa, unknown, or other
  misc_feature (117)..(117): Xaa is any aa, unknown, or other
  misc_feature (145)..(145): Xaa is any aa, unknown, or other
  misc_feature (147)..(147): Xaa is any aa, unknown, or other
  misc_feature (148)..(148): Xaa is any aa, unknown, or other
KAGAPRGGGRSRTSGSPGLQEFARDHYLEHPNRKITQNTSRVRKAAASGESARGGGVGHDGEGEAEEHTAKEIAAKIDAATTNRGGGKAGQADRLGQXQGGHAKLACPLWRTPAXTXQSCRSTTRRATPAPLRGGRGSSTWHSSXPXXCCRAPATGQGPTSSPRPGSGEP

SEQ ID NO: 11377 - DNA, 716 bp, Zea mays
  misc_feature: Ceres CLONE 1359239-F
  misc_feature (347)..(347): n is a, c, t, g, unknown, or other
aaagctggagctccccgcggtggcggccgctctagaactagtggatcccccgggctgcaggaattcgcacgagaccattacctagaacatcctaatcgaaaaaacacagaactaccaaaccgaccgagccgcgaacttcacccctgccttctctcccttctccgtccaggccctagtgcccgcgaatctcgtgcagcaagtgagcgccgccgccagactacgccaagtgtccagttcctcgtcgggtataccctttctcttcccttttctgctgtgtggacctagcaccatcggaaccctaacttgagctatctggctatttgcatccggatctaatctatttaccnagcatgtacatacatactaacttcgattgtttgggaaaaatattggaacatctgtgtccctttactgggttctccccctataggaaatttgagtataaaactctacatgtcaagaagtattggcgccaaaagcaagggcaaagcggaaagcaatactaggggctgccgcatgggatgttcaagggcccccaatctggttggaatcctccggggccaacaagcctttaagggcgaacctggggtttagttttggagaggaagtggcaaaaatttttttcccaaagggggagagaggggtggattccaaagcccccttttttttttggaaaaaaggggaaacattattgggggaaaaaaaaaactttgtgt

SEQ ID NO: 11378 - DNA, 714 bp, Zea mays
  misc_feature: Ceres CLONE 1359241-F
  misc_feature: Translation starting site: 175
aaagctggagctccccgcggtggcggccgctctagaactagtggatcccccgggctgcaggaattcgcacgagaccattacctagaacatcctaatcaaaaagtgtgtctggaaaccctagccgccatatctcacgatccactcgagcaccaagccgagggaaggggaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaaagtcctgcaggagcgcatcagggtcgccggcggcaaggctggcaacctcggggactccgtcaccatctctcgcgagaggaccaagtcaccgtcacctctgacggacccttctccaagaggtacctgaagtacttggacaggaagtactttgagaacgcacacgtgcggggattgcctacccgttgcctgccaacagggaccgaaacggttatgacctccgctacttcaacttgcttaaaacgaggggggagaaaaaaaataaaatggccctacccctaaattttagattggaacccccgggcttttagacccgggaccccaatttttccaaagggccccagggtttgggggggggtgggtaatttgaaaaaaccttttggggccgaaccccggaaaaaaatttgttggggga

SEQ ID NO: 11379 - DNA, 677 bp, Zea mays
  misc_feature: Ceres CLONE 1359245-F
  misc_feature: Encodes the peptide sequence at SEQ ID NO. 11380
  misc_feature (553)..(553): n is a, c, t, g, unknown, or other
  misc_feature (582)..(582): n is a, c, t, g, unknown, or other
  misc_feature (583)..(583): n is a, c, t, g, unknown, or other
  misc_feature (625)..(625): n is a, c, t, g, unknown, or other
tggagctccccgcggtggcggccgctctagaactagtggatcccccgggctgcaggaattcgcacgagaccattacctagaacatcctaatcgaaaaaacgagaagagcggcggcgcgggcggacaaggagcaggcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaaaaaaaccctgctgcnaagaaggataatgctgagggacaagaggnntgagcagcagctgaggaaacgaaaaagagcaccatgtcacgnagagcttgagaaggcaaggaggacgtacccttgacccacacattgagagcat

SEQ ID NO: 11380 - protein, 165 aa, Zea mays
  misc_feature: Ceres CLONE 1359245-F
  misc_feature (1)..(164): Pfam Name: Ribosomal_S8e Pfam Description: Ribosomal protein S8e
  misc_feature (131)..(131): Xaa is any aa, unknown, or other
  misc_feature (141)..(141): Xaa is any aa, unknown, or other
  misc_feature (155)..(155): Xaa is any aa, unknown, or other
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKTLLXRRIMLRDKRXEQQLRKRKRAPCHXELEKARRTYP

SEQ ID NO: 11381 - DNA, 714 bp, Zea mays
  misc_feature: Ceres CLONE 1359256-F
  misc_feature: Encodes the peptide sequence at SEQ ID NO. 11382
  misc_feature (286)..(286): n is a, c, t, g, unknown, or other
  misc_feature (287)..(287): n is a, c, t, g, unknown, or other
  misc_feature (326)..(326): n is a, c, t, g, unknown, or other
aagctggagctccccgcggtggcggccgctctagaactagtggatcccccgggctgcaggaattcgcacgagaccattacctagaacatcctaatcaaaactctatcttcgcatctggcacgagcagccaagcaaataaaagtagagcggcgagcgacgaccggcctgggccactctttcggccgagcgtagccagcaggtcgtcgtcgtcgtcgtcgtcgcagcacccggccggctagcatggccacgaggaggcagtggtggtggtggtgcctgctgctgctgnncgcgtggtgctgcgccgcccgcgcgcagtcgcccgcggncgcggacccgctgcagagcaagtgcccagggggacttcgggaagctgacggactgcatggactacgcgacggggcacgcggcgtcgcccctcgtcacctgctggggggacccccgggaaaacgaaaagggggcgccccggaggcttctggttacattcttcagaaaaacgcacccgggggcaaaccaggggaagcccttgggattgggcttcaaccgattcagggggttcccggcgcgcgggaacccccccaaatccaaaagttttcgttttgaaatcccctggggaaactgaaaccgcggtcctggggaaaaaacccttttttcgaaaagccttaaaaaaaacggcgggggccggggggaaacccttaaaaaaaaaacgcccgggaa

SEQ ID NO: 11382 - protein, 78 aa, Zea mays
  misc_feature: Ceres CLONE 1359256-F
MDYATGHAASPLVTCWGDPRENEKGAPRRLLVTFFRKTHPGANQGKPLGLGFNRFRGFPARGNPPKSKSFRFEIPWGN

SEQ ID NO: 11383 - DNA, 663 bp, Zea mays
  misc_feature: Ceres CLONE 1359257-F
  misc_feature: Encodes the peptide sequence at SEQ ID NO. 11384
  misc_feature (295)..(295): n is a, c, t, g, unknown, or other
  misc_feature (391)..(391): n is a, c, t, g, unknown, or other
  misc_feature (421)..(421): n is a, c, t, g, unknown, or other
  misc_feature (422)..(422): n is a, c, t, g, unknown, or other
  misc_feature (438)..(438): n is a, c, t, g, unknown, or other
  misc_feature (439)..(439): n is a, c, t, g, unknown, or other
aaagctggagctccccgcggtggcggccgctctagaactagtggatcccccgggctgcaggaattcgcacgagaccattacctagaacatcctaatcgaaaagaaaaacatctcacgccacgcctgctgcagcacctcgctctccgctccgttggccccatggagtccgtcgcgtccgccgcgatcgccaccacctcccgctctctcccgctccccttctcttctaccccggtccaccgccggcgccgtgccgccttcctccccgttgccgcctccaagcgtcacgacgacgacnaggaggccgcgaaagggtccggctcggaaccacggcgcgagcctaccagcctcgcgccgtacggactctccatctcgccactctccaaggacgcgnccatggggctggtggtgagcgctgccacgnngagcggctggacgacnnggatcgggatggagagcccgccgacggcgaccaaagccggtgggctggccaggcgaaggtgtcaaccctgccttggtccctcttcacgaatcaccggggggggggcagggggttggcctcacctgcaacgggggcgggaagggaaagacaaggccattcatccctatggctacccccaagaaactgggtttgttcaagggtggggggtgcaacgggtccccaaa

SEQ ID NO: 11384 - protein, 168 aa, Zea mays
  misc_feature: Ceres CLONE 1359257-F
  misc_feature (46)..(46): Xaa is any aa, unknown, or other
  misc_feature (78)..(78): Xaa is any aa, unknown, or other
  misc_feature (88)..(88): Xaa is any aa, unknown, or other
  misc_feature (94)..(94): Xaa is any aa, unknown, or other
MESVASAAIATTSRSLPLPFSSTPVHRRRRAAFLPVAASKRHDDDXEAAKGSGSEPRREPTSLAPYGLSISPLSKDAXMGLVVSAATXSGWTTXIGMESPPTATKAGGLARRRCQPCLGPSSRITGGGAGGWPHLQRGREGKDKAIHPYGYPQETGFVQGWGVQRVPK

SEQ ID NO: 11385 - DNA, 736 bp, Zea mays
  misc_feature: Ceres CLONE 1359264-F
  misc_feature: Encodes the peptide sequence at SEQ ID NO. 11386
  misc_feature (357)..(357): n is a, c, t, g, unknown, or other
aaagctggagctccccgcggtggcggccgctctagaactagtggatcccccgggctgcaggaattcgcacgagaccattacctagaacatcctaatcaaaaatcccaaaacgcaaaacacgagcgagcacaaaaaaaaaatcccaatatccgcaacggcaatgtctccgctgccccgcatcgtgctcctcgccgtcgccgccgccgccgccgcagcggtcacggcgtcagccacgtcgctcagcggcgcggcgaacgacctactccccaagtacggcctcccgaaggggctcatcccggactccgtcgcctcctacagcttcgacgaggccacgggcgccttcgagatccacctcgncgggacctgctacggtcacttcggctcccacctcgtctactacgagaggaccataacgggcaagcttctcaagggcggcatctcggacctcttcgggggcaaggcaagaagctctttccccggggccaacgcacggggaagggcccgccccccaaccaaggaaccatggagtttcccgggcggttttttttcggagtccttatccgcccctcagtgttgaagagggggcccccctgggtttcccagggttgggcccaaattccccccccccctttggggataaccagaaatttttggtttcctccccccttaaaagggctaaaaagggggttttaaaaaaccccaataatcccccaaaaaagacggggggttctttttt

SEQ ID NO: 11386 - protein, 138 aa, Zea mays
  misc_feature: Ceres CLONE 1359264-F
  misc_feature (9)..(124): Pfam Name: DUF538 Pfam Description: Protein of unknown function, DUF538
  misc_feature (66)..(66): Xaa is any aa, unknown, or other
MSPLPRIVLLAVAAAAAAAVTASATSLSGAANDLLPKYGLPKGLIPDSVASYSFDEATGAFEIHLXGTCYGHFGSHLVYYERTITGKLLKGGISDLFGGKARSSFPGANARGRARPPTKEPWSFPGGFFSESLSAPQC

SEQ ID NO: 11387 - DNA, 691 bp, Zea mays
  misc_feature: Ceres CLONE 1359265-F
  misc_feature: Encodes the peptide sequence at SEQ ID NO. 11388
  misc_feature (516)..(516): n is a, c, t, g, unknown, or other
  misc_feature (581)..(581): n is a, c, t, g, unknown, or other
  misc_feature (680)..(680): n is a, c, t, g, unknown, or other
aagctggagctccccgcggtggcggccgctctagaactagtggatcccccgggctgcaggaattcgcacgagaccattacctagaacatcctaatcgaaaaaccatttcgctagctccctaccacttgatccagctagctaggagagagagctttgtttaggcggcggcaactatgaacaggaagccaggacactgggactgcagggcgtgccagcacctcaccttcagccgtcgtcatgcatgccagcgctgcagtgaaccacgtggagttggtgatcgtatcggcgccggtggcgacttgggtgttcgtgcccgctcctccttcggtggtgggtttggagctggctctgatgtccgccctggtgactggtactgctcgtgcggcgtacacaacttcgccagccgctccaactgcttcaggtgctctgcctacaaggaggaggctgccggcgcctttgatagtgacatgtcacgctcacgcgtctactccggcttcgacagcgacgctgccgcanagtacaaccgccccgcttgtatgtcagcagactgaatctgcaccaggtccggttgcaacgagcancacttcgctagcatgatggaatgtttcaggtgcaacgcgcacgagactcggatagcgctgccacgacgacctacgataactacttgcactgatgtgtangtacagcaagc

SEQ ID NO: 11388 - protein, 125 aa, Zea mays
  misc_feature: Ceres CLONE 1359265-F
  misc_feature (62)..(90): Pfam Name: zf-RanBP Pfam Description: Zn-finger in Ran binding protein and others
  misc_feature (115)..(115): Xaa is any aa, unknown, or other
MNRKPGHWDCRACQHLTFSRRHACQRCSEPRGVGDRIGAGGDLGVRARSSFGGGFGAGSDVRPGDWYCSCGVHNFASRSNCFRCSAYKEEAAGAFDSDMSRSRVYSGFDSDAAAXYNRPACMSAD

SEQ ID NO: 11389 - DNA, 631 bp, Zea mays
  misc_feature: Ceres CLONE 1359266-F
  misc_feature: Encodes the peptide sequence at SEQ ID NO. 11390
aagctggagctccccgcggtggcggccgctctagaactagtggatcccccgggctgcaggaattcgcacgagaccattacctagaacatcctaatcgaaaaaaattctccacgcgttccttccttccctccatctcctctctgttcatagcctcccaagaaacaagagccaaacagcgcttgcgaagctcaagcgccgcagcaatgtctctggccccgtccatcccttccatcaaggtgaaggtgggggccgtctcggtcgctcctccacaccgcgcatgccgatccttcgcggtgatcaggagctccaaggcagaggaccccatccggagacctgcggtgcctccgatgtcgccaccgccgccgatgccacccaagacgccggctctgtccactcctcccaccctgtcgcagactccgacgcccgtgaagcccgctgctccacccacgtcgtcgcagccgatgccaccttctcctgagcccaagccagttgacgccacagcccagatgcggaagccaggggctggggccatgacgctgaaccactagaggaaagtggggcaaggaccctgccgaagaactttaaaaaaaaaaaaaacgggggagggggcccaccaaggggccgttttttt

SEQ ID NO: 11390 - protein, 114 aa, Zea mays
  misc_feature: Ceres CLONE 1359266-F
MSLAPSIPSIKVKVGAVSVAPPHRACRSFAVIRSSKAEDPIRRPAVPPMSPPPPMPPKTPALSTPPTLSQTPTPVKPAAPPTSSQPMPPSPEPKPVDATAQMRKPGAGAMTLNH

SEQ ID NO: 11391 - DNA, 682 bp, Zea mays
  misc_feature: Ceres CLONE 1359267-F
  misc_feature: Encodes the peptide sequence at SEQ ID NO. 11392
  misc_feature (490)..(490): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
tggagctccccgcggtggcggccgctctagaactagtggatcccccgggctgcaggaattcgcacgagaccattacctagaacatcctaatcgaaaaatcgccatcgacctcctcgatccagacagcgggcagcagccatgtccaaggtcttcaccctcgacgcggtcgccaagcacaactccaaggaggattgctggctcatcatcggcggcaaggtgtatgatgtgactaagtttttggtagaccacccaggaggtgatgatgttctgttgtcctcaactggcaaggatgcgactgatgatttcgaggatgtcggtcacagcaacactgcccgcgcgatgatggatgaatacttggtgagtgaaatcgacgcgtcgacgatcccttccaggacgaagtatgtccccccgaaacaaccgcactacaaccaggacaagactcccgagtttgtcatcaagatcctccagtttttgttcccctgacatcctngcttgctgtgcgaagcgctgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11392 - protein, 114 aa, Zea mays
  misc_feature: Ceres CLONE 1359267-F
  misc_feature (4)..(78): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MSKVFTLDAVAKHNSKEDCWLIIGGKVYDVTKFLVDHPGGDDVLLSSTGKDATDDFEDVGHSNTARAMMDEYLVSEIDASTIPSRTKYVPPKQPHYNQDKTPEFVIKILQFLFP

SEQ ID NO: 11393 - DNA, 678 bp, Zea mays
  misc_feature: Ceres CLONE 1359270-F
  misc_feature: Translation starting site: 143
aaagctggagctccccgcggtggcggccgctctagaactagtggatcccccgggctgcaggaattcgcacgagaccattacctagaacatcctaatcaaaaagaccgctgtgaagtcagtcagcttcagcaccacgagcacgatggccctcgcgctcgccacgaccccactcgcgcatctcacccttgccccgccctcgatcttcggctcccagtcctcgctgctgctgctcccgcgccgcgcgtcgcccgcccccgtctccctctcccaccgccgcatcatcgcggccgtcgcgaccaaggaacccgagctcggcggcggcggatcgggggccggcgacggtgccggagggagcgtcggcggcacccacccgaggggaggagggcaggaaggagacggggaggaagagaagatggggcagggcctgtccatgtcgcagaaactcaccctcgcctacgccgcgctcgttggagctggtggtgtaatgggatatatgaagaagtggaagccaaaaatccttggctgcaggaggcatatcagccctggccctgtacgtcgtccacattcaactcccagtgagacctgtcctcgcatcatccatcggtttaggtatatcggccgcgctactgtcagggatggggtcgcgcttccaaaaaggccggaaaggtattccctggc

SEQ ID NO: 11394 - DNA, 705 bp, Zea mays
  misc_feature: Ceres CLONE 1360561-F
  misc_feature (366)..(366): n is a, c, t, g, unknown, or other
aagctggagctccccgcggtggcggccgctctagaactagtggatcccccgggctgcaggaattcgcacgagaccattacctagaacatcctaatcgaaaaatttcttagtatcatagcacagtatttcgtgctctcgcttcgctcccttaatttatcaccattcctaatttattctatttcttagtatcatagcacagtatttcgctcgccccgatttcccgactcttcccgtgcctcagacagcatcggattgcttgatctcgattgtcagaataagattcagcgcaggtttggattcaccgaatccaccgattgcttgcgccccgcggtcgcgcgcggcggaatttcggccgccgccaattcnggcctctccggaagggtgtccccgttctgggtcgcctaatatccgctgccctcgtgcgggactcctcgggattttcggctgtgggcctgggctttttcagccccgggtggggggtccgcccttcaaggaatgggcccccccgggttgcccaaggtgggcctcggggggggttccttggggggtggccccggggggaatttttgttaaaaggaaaccccttccccacccaaaaaaaaacccccctgtgtggaaaaccccggggaaaaatcctcccgcaccacaaaaggggggttgtgtgcgacatttttttttttgcaggggggcacaagagggggtgtt

SEQ ID NO: 11395 - DNA, 720 bp, Zea mays
  misc_feature: Ceres CLONE 1360567-F
  misc_feature: Encodes the peptide sequence at SEQ ID NO. 11396
  misc_feature (383)..(383): n is a, c, t, g, unknown, or other
  misc_feature (408)..(408): n is a, c, t, g, unknown, or other
aaagctggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagctaaaatattttgcctccttatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggtaatcgcagctggcatcttacctttatcacccttgatcctccnacatcatcagccctattacagcagntacctttgctgcatttattggcacaagacatcaggggacaaacactaccacaacttgtgctagcaaaccttgctggctaatcccaagaaaagaagttccttccatcaaacaagttaatggattgaatccggcttcttatttggaaaaaaaaaacatacatttcgcccggttttccggtgcccaccccccaaaattttttccattaaaccacgggaaaattttaaacccccccgtttttaaacgggaaaaaactaataccttttcccccttttgtgggggggagcccgttatcttttgaaaacacccagtggt

SEQ ID NO: 11396 - protein, 103 aa, Zea mays
  misc_feature: Ceres CLONE 1360567-F
  misc_feature (75)..(75): Xaa is any aa, unknown, or other
  misc_feature (83)..(83): Xaa is any aa, unknown, or other
MAAKIFCLLMLLGLSASAATATIFPQCSQAPIASLLPPYLSPTVSSVCENPILQPYRIQQVIAAGILPLSPLILXHHQPYYSXYLCCIYWHKTSGDKHYHNLC

SEQ ID NO: 11397 - DNA, 726 bp, Zea mays
  misc_feature: Ceres CLONE 1360573-F
  misc_feature: Encodes the peptide sequence at SEQ ID NO. 11398
  misc_feature (371)..(371): n is a, c, t, g, unknown, or other
  misc_feature (372)..(372): n is a, c, t, g, unknown, or other
  misc_feature (432)..(432): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
aaagctggagctccccgcggtggcggccgctctagaactagtggatcccccgggctgcaggaattcgcacgagaccattacctagaacatcctaatcgaaaaattccccgtttgccttgattaccattcctccccaaaacacatcctgcgatcctcgaagcctccgccgagcatcgatcatgtcggactactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctggtctgctgccctggnnagcctccagtacaatcagcggtgtgatcctcttcgaggagaccctctaccagaagaccanggatggcaagcctttttggcgatgtcctcagggagggagggcgtcttccctggcatccaggtcgacaaggtaccaattgaagttggttggaccggaaaaggagacctcccccaagggccccatgaccctcgggaggctttggcttaaaactacaaggcccggcccctttttccaaggggggggttgttcccaaatgtgcccccaagggcccccaagtttgcatttaaccaagaggccgggtgcggcccccacccctttggggaaaaannnnnngacggggggcaaaatgaaaca

SEQ ID NO: 11398 - protein, 72 aa, Zea mays
  misc_feature: Ceres CLONE 1360573-F
  misc_feature: SWISSPROT Homolog: EC 4.1.2.13 Fructose-bisphosphate aldolase
  misc_feature (65)..(65): Xaa is any aa, unknown, or other
MSDYCGKYADELIKNAAYIGTPGKGILAADESTGTIGKRLSSINVENVEENRRALRELLVCCPGXPPVQSAV

SEQ ID NO: 11399 - DNA, 707 bp, Zea mays
  misc_feature: Ceres CLONE 1360580-F
  misc_feature: Encodes the peptide sequence at SEQ ID NO. 11400
aagctggagctccccgcggtggcggccgctctagaactagtggatcccccgggctgcaggaattcgcacgagaccattacctagaacatcctaatcgaaaactctactccctactggcctcctcccacgagtcggataccgaacctcggcggcgtcggcgccacgcgagcaaaaaccctagtgcgagcaagcgagaggcagagacctcagtgcctcgagcaacgcgcgcccggcccgacggcatggagagcctcatcctcgcctcctcctgctccgcgtccccacggctcccgctactctcctccgccgcccgcttccgcgggctgcccgtttccgtgccgccgccgtcttcggcgtccatcagcggtgccgcgaggaaagggccgatgaggcccaggctcttcgttgcccgcggcggcggctcctcgcggctccggaaacgttttcgaggggatgagagcaaagggcttttgcagcatgtcatcttcgactgccaatgaaatattgctacgtggactggaccctaccttccatgccacccaataatcataatggggtcccctgttttctgggatggaaggtggggaacattttcgtgggggttaaccccgggcccttccttgtaaaagaaatgcccccggcccaggttttagggaggggggccccgttcgccccaaacttttggggcccacccccctttcccttta

SEQ ID NO: 11400 - protein, 85 aa, Zea mays
  misc_feature: Ceres CLONE 1360580-F
MESLILASSCSASPRLPLLSSAARFRGLPVSVPPPSSASISGAARKGPMRPRLFVARGGGSSRLRKRFRGDESKGLLQHVIFDCQ

SEQ ID NO: 11401 - DNA, 698 bp, Zea mays
  misc_feature: Ceres CLONE 1360592-F
  misc_feature: Encodes the peptide sequence at SEQ ID NO. 11402
  misc_feature (384)..(384): n is a, c, t, g, unknown, or other
  misc_feature (474)..(474): n is a, c, t, g, unknown, or other
  misc_feature (546)..(546): n is a, c, t, g, unknown, or other
tccccgcggtggcggccgctctagaactagtggatcccccgggctgcaggaattcgcacgagaccatacctagaacatcctaatcgaaaaaactgccaagcatcaccgcgaaatctaataactcgttgctcttcgtcttcgctccgcgatcgatccaggagggggaagcagaaggagggatggcggagaacccgcagctgtttgggaatgggatgccggtgccgttctacagtgagatgttcgtcctcgcccgggatggcgtcgagttccacgtcgacaagatcccatcagctcctggtggtcatgtgaaaacaaaaggcacaatttacctgtctaatataaggatggtgtttgttgccaacaagcatgttggcaacttctttngctttgatatgccactggtgtttgtgcacggtcagaagtttcatcagccaatattcactggccacacatctctgggatcgttgagccagntggttcaaaaaccaagaacaggaccctgtactccactcccaccctcaagggccttgttcaagaacggcgggntgggggaactttccgtcccttgttcccccaccgggactggattggggggggggtaacacccctttggaaaccccgtctgggtggaaaatgggccccccgggggggcccccctggaaagtgggagaaacccctgttgagaaaagagggcgccc

SEQ ID NO: 11402 - protein, 140 aa, Zea mays
  misc_feature: Ceres CLONE 1360592-F
  misc_feature (69)..(69): Xaa is any aa, unknown, or other
  misc_feature (99)..(99): Xaa is any aa, unknown, or other
  misc_feature (123)..(123): Xaa is any aa, unknown, or other
MAENPQLFGNGMPVPFYSEMFVLARDGVEFHVDKIPSAPGGHVKTKGTIYLSNIRMVFVANKHVGNFFXFDMPLVFVHGQKFHQPIFTGHTSLGSLSQXVQKPRTGPCTPLPPSRALFKNGGXGELSVPCSPTGTGLGGG

SEQ ID NO: 11403 - DNA, 713 bp, Zea mays
  misc_feature: Ceres CLONE 1360641-F
  misc_feature: Encodes the peptide sequence at SEQ ID NO. 11404
tggagctccccgcggtggcggccgctctagaactagtggatcccccgggctgcaggaattcgcacgagaccattacctagaacatcctaatcgaaaagacgacgctgacgcggctgaaaatttccacgaacacatagatccgcatcgtcgatccatccgtcctcctcccgacggtacgccagcctgccagagtccgacgcacgcctagggctcctggacacagcagagcccacgccttgactcgctccgttcgagtggagcgcacaggcaccggccggcgaccagagagggagcggatcgagggggctcggcttgagtggaggagatggaccgcaaggatgtcgggatcctcgccatggacatctacttcccgccctcctgcgtgcagcaggaagcacttgaggcccatgatggggcgagcaaagggaagtacaccattggggcttgggcaagattgcatggccttttgcagcgagggggaggatgtcatctcaatgaagttgacggttgtcaattctctgctgaaaaaatacaggatggaccccaagctaatgggcccctgggagggggaaggggaaacggttatagacaaaagcaaatccctcaaaactttggttgagggaaatttttgaggaaaggggtaatactggaacttgagaggggttgaccccaccaatggatggttttggggggaacggcccccctactgaatt

SEQ ID NO: 11404 - protein, 97 aa, Zea mays
  misc_feature: Ceres CLONE 1360641-F
  misc_feature: SWISSPROT Homolog: EC 2.3.3.10 Hydroxymethylglutaryl-CoA synthase
MSGSSPWTSTSRPPACSRKHLRPMMGRAKGSTPLGLGQDCMAFCSEGEDVISMKLTVVNSLLKKYRMDPKLMGPWEGEGETVIDKSKSLKTLVEGNF

SEQ ID NO: 11405 - DNA, 722 bp, Zea mays
  misc_feature: Ceres CLONE 1360646-F
  misc_feature: Encodes the peptide sequence at SEQ ID NO. 11406
  misc_feature (441)..(441): n is a, c, t, g, unknown, or other
  misc_feature (442)..(442): n is a, c, t, g, unknown, or other
  misc_feature (510)..(510): n is a, c, t, g, unknown, or other
gctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgagaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccgtggctgnnggcgggccggcatcgcgctggcgctccatggcgggccgggtttcgtcaacttccgggggccttcgggnccctggggttgcccgggttctccctgaatggccaaggacctggaggggaaagcacccgccggggggccgaccagttggccccccccaagggggggttgggggcccagggccccagaatctgggggttgggaaagaccccgtttcacaaggggggggggttttttgagaaaaaacccccctcggggggcggggggggggaactccttaaaacc

SEQ ID NO: 11406 - protein, 176 aa, Zea mays
  misc_feature: Ceres CLONE 1360646-F
  misc_feature (36)..(156): Pfam Name: Oleosin Pfam Description: Oleosin
  misc_feature (83)..(83): Xaa is any aa, unknown, or other
  misc_feature (106)..(106): Xaa is any aa, unknown, or other
MADHHRGATRGGGGYGDLQRGGGMHGEAQQQQKQGAMMTALKAATAATFGGSMLVLSGLILAGTVIALTVATPVLVIFSPWLXAGRHRAGAPWRAGFRQLPGAFGXLGLPGFSLNGQGPGGESTRRGADQLAPPKGGLGAQGPRIWGLGKTPFHKGGGFFEKKPPSGGGGGELLKT

SEQ ID NO: 11407 - DNA, 619 bp, Zea mays
  misc_feature: Ceres CLONE 1360649-R
  misc_feature: Encodes the peptide sequence at SEQ ID NO. 11408
cgattgggtaccgggccccccctcgaggtcgacggtatcgataagcttttttttttttttttttgtttttttttttttttttttttttttttttttttttttttttttttttttttttttatttcattggggatttttaccccaaattgcttcgaaggatatgtccgccaacatcaagagcaaaacaagtcattccaagggaaatctctgtttcgtaaatctagagctaggggatagctaaacattttactagggaatcctaaattccttagcggaactgctccatattcccgtctttagagctgaaactatctcaaagtctccttttccagaaaaacaagaaatttttgaaccaaaaacgaaaacttttctccaaaaacatcgacaaattcattgtttctgaatctgatcgggaactgctacatgaaactaaaaagtctcccggtccaaagatgccccgttgtgggcttggttgcattctcaaaatcaccaaaacggcgccccagcatgactagcaaaagcacatcattctgctacacttagttcccgttcaatctcttcaagtgatcgccccttggtctcgaccaccttcccagctatgtagaaaactgccaggacg

SEQ ID NO: 11408 - protein, 78 aa, Zea mays
  misc_feature: Ceres CLONE 1360649-R
RLGTGPPLEVDGIDKLFFFFFCFFFFFFFFFFFFFFFFFFISLGIFTPNCFEGYVRQHQEQNKSFQGKSLFRKSRARG

SEQ ID NO: 11409 - DNA, 656 bp, Zea mays
  misc_feature: Ceres CLONE 1360651-F
  misc_feature: Encodes the peptide sequence at SEQ ID NO. 11410
  misc_feature (387)..(387): n is a, c, t, g, unknown, or other
  misc_feature (392)..(392): n is a, c, t, g, unknown, or other
  misc_feature (393)..(393): n is a, c, t, g, unknown, or other
  misc_feature (454)..(454): n is a, c, t, g, unknown, or other
  misc_feature (464)..(464): n is a, c, t, g, unknown, or other
  misc_feature (465)..(465): n is a, c, t, g, unknown, or other
  misc_feature (495)..(495): n is a, c, t, g, unknown, or other
  misc_feature (496)..(496): n is a, c, t, g, unknown, or other
  misc_feature (507)..(507): n is a, c, t, g, unknown, or other
  misc_feature (517)..(517): n is a, c, t, g, unknown, or other
  misc_feature (531)..(531): n is a, c, t, g, unknown, or other
  misc_feature (556)..(556): n is a, c, t, g, unknown, or other
tggagctccccgcggtggcggccgctctagaactactggatcccccgggctgcaggaattcgcacgagaccattacctagaacatcctaatcaaaaaatgtcgtcgaccacagaagctctggctccgatgatgatcttggcgctcgccgctgtgctgctggccaccgctgcacgtcagccgtcgccggttatgtccacgaccaccaccaacctgaccctccacaacctgtgcccgtacccggtgtggccgctggtgaccgccaacgcgggcaatccgtccatccccaccgacgccgacggcgagccggcggggcggctggacggcaacggcgagggcctggcgacgctagcgttcccgccgggcgcgtggtcgggccgcgtggtggncgcgnnacggctgcactggcggggacgacaacgacgaggcggacgcgtacgacccgctgcttcgacnctcctctcgnntgcacaactgcgacgcgccgccggtgaccnngggggccaaanagaccggggnccggaatggccggnccccgccgccgacaagggtgatggngcacccgatcgcgagggccaaacgagcgggaccccctttcggcggcctggaaccccggaaaaatttctaccgccgccccggggggtgacccaactccgcg

SEQ ID NO: 11410 - protein, 186 aa, Zea mays
  misc_feature: Ceres CLONE 1360651-F
  misc_feature (97)..(97): Xaa is any aa, unknown, or other
  misc_feature (99)..(99): Xaa is any aa, unknown, or other
  misc_feature (123)..(123): Xaa is any aa, unknown, or other
  misc_feature (133)..(133): Xaa is any aa, unknown, or other
  misc_feature (137)..(137): Xaa is any aa, unknown, or other
  misc_feature (145)..(145): Xaa is any aa, unknown, or other
MSSTTEALAPMMILALAAVLLATAARQPSPVMSTTTTNLTLHNLCPYPVWPLVTANAGNPSIPTDADGEPAGRLDGNGEGLATLAFPPGAWSGRVVXAXRLHWRGRQRRGGRVRPAASTLLSXAQLRRAAGDXGGQXDRGPEWPXPAADKGDGAPDREGQTSGTPFRRPGTPEKFLPPPRGVTQLR

SEQ ID NO: 11411 - DNA, 730 bp, Zea mays
  misc_feature: Ceres CLONE 1360653-F
  misc_feature: Encodes the peptide sequence at SEQ ID NO. 11412
  misc_feature (498)..(498): n is a, c, t, g, unknown, or other
aaagctggagctccccgcggtggcggccgctctagaactagtggatcccccgggctgcaggaattcgcacgagaccattacctagaacatcctaatcgaaaatacctagaacatcctaatcgaaaactcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtgggcacccccgtgctggtgatcttcagcccgggccttgggggcgggccgccatcgcgctggggctcatggggggccgggntcgtcacctccgggggccttcgggggtccctgggcttgcccggggtcttccgggatggacaaggaccctgacggggaaagaccccggccggggggccgaccagtgtgagccaggccaggggaggggtggggggccaagggccccggaatttaggggagggggccaaggcccccgtttccacagggggggggggtttttttgaaaaaaaaccccacttggggggggccggggg

SEQ ID NO: 11412 - protein, 119 aa, Zea mays
  misc_feature: Ceres CLONE 1360653-F
  misc_feature (36)..(119): Pfam Name: Oleosin Pfam Description: Oleosin
  misc_feature (97)..(97): Xaa is any aa, unknown, or other
MADHHRGATGGGGGYGDLQRGGGMHGEAQQQQKQGAMMTALKAATAATFGGSMLVLSGLILAGTVIALTVGTPVLVIFSPGLGGGPPSRWGSWGAGXVTSGGLRGSLGLPGVFRDGQGP

SEQ ID NO: 11413 - DNA, 656 bp, Zea mays
  misc_feature: Ceres CLONE 1360661-F
  misc_feature (396)..(396): n is a, c, t, g, unknown, or other
  misc_feature (472)..(472): n is a, c, t, g, unknown, or other
  misc_feature (500)..(500): n is a, c, t, g, unknown, or other
  misc_feature (647)..(647): n is a, c, t, g, unknown, or other
aagctggagctccccgcggtggcggccgctctagaactagtggatcccccgggctgcaggaattcgcacgagaccaacctagaacatcctaatcgaaaagaacacgatccctttctcccctttccctgcgtagtgcggagctccagtgaaggaaccaaacagcgcaacacacgaacacaccaggcggcaggctccaccccgtccttttcctgccttttccccccgtcgagttaatccatccagtcgccaaaagctttgctaaatttcacgtgtctcgcctcgagtcgtccctaatccgacgatgccttgttctactcctaaaaaaacccaaagatcctgactttctcttgctgctagcctcccttttcccttctcccttaatcgcactgttggagnctcttcgctgtcacccccacccacctccggcgctcttttttagcattttccttgggctctggactccaaatcccangccttttgtttgcttctctgtctcttgnctgattgggtgtccccgggtccaggaactcttgattgctccttccggggggggttcggtcccatggcggcagctgcgctggcatgggcagaagcaggtggtggccgagctcccgagtgaggtggaagacgccgccgtcgatgctgcnccgaggtgg

SEQ ID NO: 11414 - DNA, 671 bp, Zea mays
  misc_feature: Ceres CLONE 1360674-F
  misc_feature: Translation starting site: 195
  misc_feature (402)..(402): n is a, c, t, g, unknown, or other
  misc_feature (439)..(439): n is a, c, t, g, unknown, or other
  misc_feature (519)..(519): n is a, c, t, g, unknown, or other
tccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgnacgcctccgtggtggggctggccgtggccacgcccgntgttcctgatcttcagccccgtggtcgtcccggccgcgctgctcatcgggacggccgtcatggggttccctcacgccggnggggctggggctcgagggcttgcctcgctccggggcctcccaaaacggggcgggagggggtccagggacccccgaattacgggaaggaggcaaccccaaaatggcggaaggccccgggcccccgggcccaaaaacccgcagagggggccagc

SEQ ID NO: 11415 - DNA, 727 bp, Zea mays
  misc_feature: Ceres CLONE 1360691-F
  misc_feature: Encodes the peptide sequence at SEQ ID NO. 11416
  misc_feature (396)..(396): n is a, c, t, g, unknown, or other
ggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaaagcgcaggtggagacgcaccactacgtctcccgcctcaaccagnacttccctcagtgcgccgtctatgactccgacaaagcggacgcgcggctcatcggcgtggagtacatcgtgccaaggaaaaatcttccactccctgcccggggaagaacaacggttggggccctcccacgggcaccaaattaagtcaggcctgggggaaaacccccaccgggggggggctttcttggaaaaaggggaatttgaacccattgggcccccactttcggaaaattttttggggcccccggggagggggaaccccggggaacccctttgcgcctgggggccccccccggctttttgggtgccccccaaaggccccccccccccga

SEQ ID NO: 11416 - protein, 129 aa, Zea mays
  misc_feature: Ceres CLONE 1360691-F
  misc_feature (26)..(128): Pfam Name: DUF1264 Pfam Description: Protein of unknown function (DUF1264)
  misc_feature (83)..(83): Xaa is any aa, unknown, or other
MASSDGKPLPTPASVGGGGGSSTAPPGQPTTVASKVLDMGAAAMQSLRPVKQAKQHMCTFALYAHDPKAQVETHHYVSRLNQXFPQCAVYDSDKADARLIGVEYIVPRKNLPLPARGRTTVGALPRAPN

SEQ ID NO: 11417 - DNA, 656 bp, Zea mays
  misc_feature: Ceres CLONE 1360699-F
  misc_feature: Encodes the peptide sequence at SEQ ID NO. 11418
  misc_feature (281)..(281): n is a, c, t, g, unknown, or other
  misc_feature (324)..(324): n is a, c, t, g, unknown, or other
  misc_feature (410)..(410): n is a, c, t, g, unknown, or other
  misc_feature (443)..(443): n is a, c, t, g, unknown, or other
  misc_feature (550)..(550): n is a, c, t, g, unknown, or other
  misc_feature (588)..(588): n is a, c, t, g, unknown, or other
  misc_feature (589)..(589): n is a, c, t, g, unknown, or other
  misc_feature (631)..(631): n is a, c, t, g, unknown, or other
aaagctggagctccccgcggtggcggccgctctagaactagtggatcccccgggctgcaggaattcgcacgagaccattacctagaacatccttatcgaaaagttattctccggagcagatgcctgagcgccggcgccgaggacttcatcgtgaagcccctgcagagcaaggacgtgcagcgcctgcggaactgctccgccgccgcgaggcccagcaagggcgcgacgcagtgcgaggccgccgtcgtggccaagaggaatcataagccgcatcctgccgntggccggcgccggcgcccgcgtcgcccgtctggacggcgagcngagcctcgccggagtcgccatggtggctgcactcgtcgggcttggagtacctgccgctcctgctgcaagctcgtcgtgctggcganccgcggcgctggtgcctgggcgagctcctgcancagggtgggcgttccgtcggacggccgctgctcgctcctccccgtggtgcgcctgagcaagcggtgcgtgtcctgggcaccagcaggagactggtgatgcaaatgcnaagtttttcagttgctgaaccaaaaaaaaaactccacnnggccgggaaggtctagcttagcctttaatttaggcactgtanaagattgatggctttggggattggg

SEQ ID NO: 11418 - protein, 179 aa, Zea mays
  misc_feature: Ceres CLONE 1360699-F
  misc_feature (94)..(94): Xaa is any aa, unknown, or other
  misc_feature (137)..(137): Xaa is any aa, unknown, or other
  misc_feature (148)..(148): Xaa is any aa, unknown, or other
KAGAPRGGGRSRTSGSPGLQEFARDHYLEHPYRKVILRSRCLSAGAEDFIVKPLQSKDVQRLRNCSAAARPSKGATQCEAAVVAKRNHKPHPAXGRRRRPRRPSGRRAEPRRSRHGGCTRRAWSTCRSCCKLVVLAXRGAGAWASSCXRVGVPSDGRCSLLPVVRLSKRCVSWAPAGDW

SEQ ID NO: 11419 - DNA, 667 bp, Zea mays
  misc_feature: Ceres CLONE 1360708-F
  misc_feature: Encodes the peptide sequence at SEQ ID NO. 11420
  misc_feature (390)..(390): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (447)..(447): n is a, c, t, g, unknown, or other
  misc_feature (448)..(448): n is a, c, t, g, unknown, or other
  misc_feature (454)..(454): n is a, c, t, g, unknown, or other
  misc_feature (455)..(455): n is a, c, t, g, unknown, or other
  misc_feature (462)..(462): n is a, c, t, g, unknown, or other
  misc_feature (463)..(463): n is a, c, t, g, unknown, or other
  misc_feature (471)..(471): n is a, c, t, g, unknown, or other
  misc_feature (473)..(473): n is a, c, t, g, unknown, or other
  misc_feature (590)..(590): n is a, c, t, g, unknown, or other
aagctggagctccccgcggtggcggccgctctagaactagtggatcccccgggctgcaggaattcgcacgagaccattacctagaacatcctaatcgaaaagggggtgttaaaccgcatcgcatcgtcttctagggtttcctcctcccgccgccacttgctgccccacgagcccattcccctcagcccttcaccatctccggcggtcgcagtggcatcagcagctccggctcacgcgcagcaaaggaacgacaatatggcgaccatcgtaaacacgacggaggaggagccgatgctggccgtggtccgcttcaccgctgagctcgcctgggccgacgcgggcccggaagtcgccgaccccgaggtcgcccgcctatgtctcgaggcgcangagcatatctcggcgggggcggtggctcgacatggcctcctttatgnnntcgctcgnncgactnnctctcannctcccgtngngggtctcggacaaggacctggagtgcgttctcctcgtcatcttgcagctcgtcaccaaggccggatccgaggacagggggtggaaatcacgaactcatttggggtaagctcacccgnaaaacggggaaaagcaggttggcctccaaggtcttttaagttgagaaatgggcccaaacccgaggcaaaggtttttt

SEQ ID NO: 11420 - protein, 137 aa, Zea mays
  misc_feature: Ceres CLONE 1360708-F
  misc_feature (45)..(45): Xaa is any aa, unknown, or other
  misc_feature (61)..(61): Xaa is any aa, unknown, or other
  misc_feature (62)..(62): Xaa is any aa, unknown, or other
  misc_feature (65)..(65): Xaa is any aa, unknown, or other
  misc_feature (67)..(67): Xaa is any aa, unknown, or other
  misc_feature (69)..(69): Xaa is any aa, unknown, or other
  misc_feature (70)..(70): Xaa is any aa, unknown, or other
  misc_feature (73)..(73): Xaa is any aa, unknown, or other
  misc_feature (112)..(112): Xaa is any aa, unknown, or other
MATIVNTTEEEPMLAVVRFTAELAWADAGPEVADPEVARLCLEAXEHISAGAVARHGLLYXXARXTXSXXPVXGLGQGPGVRSPRHLAARHQGRIRGQGVEITNSFGVSSPXKRGKAGWPPRSFKLRNGPKPEAKVF

SEQ ID NO: 11421 - DNA, 665 bp, Zea mays
  misc_feature: Ceres CLONE 1360709-F
  misc_feature: Encodes the peptide sequence at SEQ ID NO. 11422
  misc_feature (368)..(368): n is a, c, t, g, unknown, or other
aaagctggagctccccgcggtggcggccgctctagaactagtggatcccccgggctgcaggaattcgcacgagaccattacctagaacatcctaatcgaaaaagctaggttcctatgcccaaagtcacacagcttcttctccttctacttctccttcctcctctcctcaccggcaccttgatctaatctcttccatcctagcttgctcgccgctgccagtctctcctccgcctgcaacgactcccatgtctcagtcttctcctctcttctccgtcgcccgagcgcacgccggagcaggagggcgagtcgtgatagtcgctctcctgctccgtcgtcggcccattgcacagctgccgcacagcatccantggcctacgagtgtctctctccagccatgagcgacaccttccaagacgctcctcagcctccccgtcggccacgctagtctccttcgccgaccccggacgttgatcggcggatccagcgcgaagccagcgggatcgtcgtcccaaggccggcgcccccaaggggaggaaaacaggccggagaaatgccaattggtcgaaataggccaaaggaggtccacatctcggcagagggggggcgcaggcccatctcccggggacggatccgtttcccccgacgtcaccgtaggcaggtggcta

SEQ ID NO: 11422 - protein, 50 aa, Zea mays
  misc_feature: Ceres CLONE 1360709-F
  misc_feature (41)..(41): Xaa is any aa, unknown, or other
MSQSSPLFSVARAHAGAGGRVVIVALLLRRRPIAQLPHSIXWPTSVSLQP

SEQ ID NO: 11423 - DNA, 648 bp, Zea mays
  misc_feature: Ceres CLONE 1360719-F
  misc_feature: Encodes the peptide sequence at SEQ ID NO. 11424
aagctggagctccccgcggtggcggccgctctagaactagtggatcccccgggctgcaggaattcgcacgagaccattacctagaacatcctaatcgaaaaatcacgaagagtcatcacgccatacgacacggaggacaccgagccggaggcgaagccggtgcgcagcgcgagagtagcggcgagtcggcgaccatcaagcaactgcatggccgcgttacccgccagcacccccgcccccgcccccgccccctccgaggcggcggagctcgtgccgacgctctcctcgctggagcggcttacggcgcgggcgcgcagctcgacgaggcgcgcctccgcttcgcccgcctcggggaccgcttccacgccgtctacggcgcccgccccgcgctcttcgcccgctccccagggagggtcaatctgatcggggagcacatcgactacgagggctactcggtgttgccgatggccatccgccaggacatgatcgtcgccatccgaagggccacggcgccccagggtgagggtcgccaacgtcgacgacaagtaccccctctgcgtctaccccgccgaccccagacagggaaattgacgtaaaaaatcacaaatgggggcactaatttcatgtgtggattaccaggggagttta

SEQ ID NO: 11424 - protein, 197 aa, Zea mays
  misc_feature: Ceres CLONE 1360719-F
  misc_feature: SWISSPROT Homolog: EC 2.7.1.6 Galactokinase
AGAPRGGGRSRTSGSPGLQEFARDHYLEHPNRKITKSHHAIRHGGHRAGGEAGAQRESSGESATIKQLHGRVTRQHPRPRPRPLRGGGARADALLAGAAYGAGAQLDEARLRFARLGDRFHAVYGARPALFARSPGRVNLIGEHIDYEGYSVLPMAIRQDMIVAIRRATAPQGEGRQRRRQVPPLRLPRRPQTGKLT

SEQ ID NO: 11425 - DNA, 640 bp, Zea mays
  misc_feature: Ceres CLONE 1360732-F
  misc_feature: Encodes the peptide sequence at SEQ ID NO. 11426
  misc_feature (585)..(585): n is a, c, t, g, unknown, or other
tggagctccccgcggtggcggccgctctagaactagtggatcccccgggctgcaggaattcgcacgagaccattacctagaacatcctaatcgaaaaagcagttcctcagacgcaaagaagatcgagtctgcagcccacaccatagtgcgagcagattgcgtccaataggcgcaaagggagatgggggtggccgctggacgagcggcggccatggtggctgcggcggcggcggcggcggcggtgctgctgctgctcgcgggcggcgcgcacgcggactgctacgacgactgcttcaaggactgcatggccaggttcaagtccatgagagactactgcagctacgcgtgcgagaaggtctgcgatccggacgccacgctccagcgccccctcgccgttgtggggccagcagcagcgttggccgaccaccacccgttggacaagaagcatggtgcttgtctggccggcggcgttgcccgaccatcctttccacgagacgcacggcgacgtcgaagccggcaggggagcccggaccagcttagcacgtcgtccgtccaggacgtgtccccgtcctccctggacgccgncggagcgagagcgcgcgatgctagccgctcgggctggcgcccgtatgtaagcact

SEQ ID NO: 11426 - protein, 153 aa, Zea mays
  misc_feature: Ceres CLONE 1360732-F
  misc_feature (135)..(135): Xaa is any aa, unknown, or other
MGVAAGRAAAMVAAAAAAAAVLLLLAGGAHADCYDDCFKDCMARFKSMRDYCSYACEKVCDPDATLQRPLAVVGPAAALADHHPLDKKHGACLAGGVARPSFPRDARRRRSRQGSPDQLSTSSVQDVSPSSLDAXGARARDASRSGWRPYVST

SEQ ID NO: 11427 - DNA, 661 bp, Zea mays
  misc_feature: Ceres CLONE 1360800-F
  misc_feature: Encodes the peptide sequence at SEQ ID NO. 11428
  misc_feature (350)..(350): n is a, c, t, g, unknown, or other
  misc_feature (352)..(352): n is a, c, t, g, unknown, or other
  misc_feature (353)..(353): n is a, c, t, g, unknown, or other
  misc_feature (529)..(529): n is a, c, t, g, unknown, or other
  misc_feature (530)..(530): n is a, c, t, g, unknown, or other
caaagctggagctccccgcggtggcggccgctctagaactagtggatcccccgggctgcaggaattcgcacgagaccattacctagaacatcctaatcgaaaatttttttttttttttttccccacacgcgcccacctcctccggtcctcccctctagtcctctctcccgaccccacctctgccgtccgtgcgtccgtccggcaaccgcgacgcaacaatggcggccgggcgagagctggtggtgagtttcggcgagatgctgatagacttcgtgccgaccgtggcgggggtctcgctggccgaggcgccggccttcctcaaaggcgggcgggggcgcgcccgccaagcngnncatcgcggtctcgcgcctcggtggcggggccgccttcgttggaagctcggcgacgacgagttcggccgcatgctcgccgccatcctccgcgacaacggcgtcgacggcgggcggcgtctcctttcgacggcgggcgcgcgcaccgcgcttgccttcgtcaccctgcgcgccgacgnngagcggcgagttcatgttctaccgcaaccccaggggcgacatgctcctcactgccgacgagctcaacgtcgggcttcatccggaagggttgcggtctttcactacggatcaataaacttggattgctgaac

SEQ ID NO: 11428 - protein, 146 aa, Zea mays
  misc_feature: Ceres CLONE 1360800-F
  misc_feature: SWISSPROT Homolog: EC 2.7.1.4 Fructokinase
  misc_feature (45)..(45): Xaa is any aa, unknown, or other
  misc_feature (104)..(104): Xaa is any aa, unknown, or other
MAAGRELVVSFGEMLIDFVPTVAGVSLAEAPAFLKGGRGRARQAXHRGLAPRWRGRLRWKLGDDEFGRMLAAILRDNGVDGGRRLLSTAGARTALAFVTLRADXERRVHVLPQPQGRHAPHCRRAQRRASSGRVAVFHYGSINLDC

SEQ ID NO: 11429 - DNA, 686 bp, Zea mays
  misc_feature: Ceres CLONE 1360812-F
  misc_feature (297)..(297): n is a, c, t, g, unknown, or other
  misc_feature (314)..(314): n is a, c, t, g, unknown, or other
  misc_feature (349)..(349): n is a, c, t, g, unknown, or other
  misc_feature (357)..(357): n is a, c, t, g, unknown, or other
  misc_feature (358)..(358): n is a, c, t, g, unknown, or other
  misc_feature (373)..(373): n is a, c, t, g, unknown, or other
  misc_feature (386)..(386): n is a, c, t, g, unknown, or other
  misc_feature (531)..(531): n is a, c, t, g, unknown, or other
  misc_feature (532)..(532): n is a, c, t, g, unknown, or other
  misc_feature (547)..(547): n is a, c, t, g, unknown, or other
caaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcangagagagatagcagggnggctagctagctgagctcgtgcgacgaagaatggnccgaattnngcagaaacatggtgncgccgctcctggntgctcaacctcatcatgtacatcatcgtcatcggttttcgcgagttggaacctgaacactttcatcacggggaaaacccactaccccggggtggcccggaaacggggggaagttccacattcgggggggtccccaacgggccccnntgggtgggggccccnttttccaaagttgggggggggggaccacgggggggcccctggggcaccaaaaaagctgggccccaaaagcgcgggggttgcttctttgcggggggcaaatcaggggggttccctttggggttgggcccgagggagaaac

SEQ ID NO: 11430 - DNA, 624 bp, Zea mays
  misc_feature: Ceres CLONE 1360834-F
  misc_feature: Encodes the peptide sequence at SEQ ID NO. 11431
aaagctggagctccccgcggtggcggccgctctagaactagtggatcccccgggctgcaggaattcgcacgagaccattacctagaacatcctaatcgaaaagttgtcttggcggctgcggcggagcacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaaacctaccctgctggttttcatggatgtcatttccatccctaagacaatggagaactacaggctgctttatgacaccaaggggccgcttccgtcttcaccaaatcaagggatgaggatgccaagttcagctcggccaggggtggggtcccgttcagtttgggccagaagggcatcccctacctgaa

SEQ ID NO: 11431 - protein, 140 aa, Zea mays
  misc_feature: Ceres CLONE 1360834-F
  misc_feature (3)..(40): Pfam Name: RS4NT Pfam Description: RS4NT (NUC023) domain
MARGLKKHLKRLNAPKHWMLDKLGGAFAPKPSSGPHKSRECLPLILIIRNRLKYALNYREVISILMQRHVLVDGKVRTDKPTLLVFMDVISIPKTMENYRLLYDTKGPLPSSPNQGMRMPSSARPGVGSRSVWARRASPT

SEQ ID NO: 11432 - DNA, 624 bp, Zea mays
  misc_feature: Ceres CLONE 1360873-F
  misc_feature: Encodes the peptide sequence at SEQ ID NO. 11433
  misc_feature (314)..(314): n is a, c, t, g, unknown, or other
  misc_feature (409)..(409): n is a, c, t, g, unknown, or other
  misc_feature (507)..(507): n is a, c, t, g, unknown, or other
  misc_feature (544)..(544): n is a, c, t, g, unknown, or other
  misc_feature (568)..(568): n is a, c, t, g, unknown, or other
  misc_feature (599)..(599): n is a, c, t, g, unknown, or other
aagctggagctccccgcggtggcggccgctctagaactagtggatcccccgggctgcaggaattcgcacgagaccattacctagaacatcctaatcaaaaccagatccctcttccctctccgctcccccacgtcatctagtcgccgcccccgctcaccgattgtcctctgctgtggagcgagcaagcagcggcgaagcgatggaggaggagatcagaaaggagttccagagtaacggcttctccatcggaggagccggccccgaggacgccgcccagatcctctccacgctgctgacctactgcatcaactacnagatgagccccgcggatctcgtctcaaactgggaggtctactaccctcataggcaattggatggcttaaagctcgaaagctcgtatcttgatggntttctgtcacaccttcaaaaaatgagttaagacaggggatataaagaagaagctaaccttcacatttactccagtaacgatgttgacatgctcttaangcattcacatgtagatgaagcagcattccatgacacnacaggctatgaacaggaaaggcancctgaagatcatctatctctgagttactccntcgggcagtgacagacatcattccg

SEQ ID NO: 11433 - protein, 79 aa, Zea mays
  misc_feature: Ceres CLONE 1360873-F
  misc_feature (39)..(39): Xaa is any aa, unknown, or other
MEEEIRKEFQSNGFSIGGAGPEDAAQILSTLLTYCINYXMSPADLVSNWEVYYPHRQLDGLKLESSYLDGFLSHLQKMS

SEQ ID NO: 11434 - DNA, 645 bp, Zea mays
  misc_feature: Ceres CLONE 1360886-F
  misc_feature: Encodes the peptide sequence at SEQ ID NO. 11435
  misc_feature (633)..(633): n is a, c, t, g, unknown, or other
tggagctccccgcggtggcggccgctctagaactagtggatcccccgggctgcaggaattcgcacgagaccattacctagaacatcctaatcgaaaagactattcttcttcgtccctgatttttatccccaaactcaccgccggggcacaacaatccagttctcctttcgccggaatctgtccctcctccccctcctccccgcctctgcgggtactggaccaccgtggagcgggcattcatccaggctaggtccattccttcctttgctcgttctcttctccatcgcggaagctccacccgagttgacgccagaagagaatcggtgccctagggtgttctcgcagaattattttccagaagatttgcagatcgagtcgaaccctatgccccacgttaagcctgccgccggcctgcccccttaccaccaccgggcgctccctggccccgggcagggtccagttcccacgggacatgggatgatgcaccgggaggtccgtgatcagtacgggccgctggggccgaggatgcacctaccaccgctggggcacgggcccgctccgttcccctacgacatgctgcctccgctgcccccaccggagggtctggagcagaagcttgtggcacagcacggngagatgcagaag

SEQ ID NO: 11435 - protein, 87 aa, Zea mays
  misc_feature: Ceres CLONE 1360886-F
MPHVKPAAGLPPYHHRALPGPGQGPVPTGHGMMHREVRDQYGPLGPRMHLPPLGHGPAPFPYDMLPPLPPPEGLEQKLVAQHGEMQK

SEQ ID NO: 11436 - DNA, 648 bp, Zea mays
  misc_feature: Ceres CLONE 1360893-R
caattgggtaccgggccccccctcgaggtcgacggtatcgataagcttttttttttttttttttacaacatagcatttatttcgatggcgccaaaaaatgcggattgaattttttcacaattgctagcaaagaacaaatcaacatatctcggacgaaacaaacaaaaaaacacgggcacacgcacaaataaggaatcctttgatcctaaagttgggtatgtacaactaaagttgcagattagagtagtaaccaagctgagttgcgtgtgatgaccctacacgcaatcgtctgatcctccacaccaccatttttttgtgtgtgtttctcatctttctgctcgtttattattttatagtatttattgcgatatgagattcggatcattcctggtggatatgaatactgggacaaccctgagcgatgaatcaacggccctgcaatcctcgctccaattgatccatgctttgtccctgcaatccttagatccaatcgatcgatctatggagtgccgctccagctttccgattgcaatcgatctatgggcatgctgacacgatcctccagtgtgacgctgggtggctcctccagtataccacccattgacaatgatccaaaccactacttgctagtatagctttatccttgtg

SEQ ID NO: 11437 - DNA, 697 bp, Zea mays
  misc_feature: Ceres CLONE 1360901-F
  misc_feature (390)..(390): n is a, c, t, g, unknown, or other
  misc_feature (417)..(417): n is a, c, t, g, unknown, or other
aaagctggagctccccgcggtggcggccgctctagaactagtggatcccccgggctgcaggaattcgcacgagaccattacctagaacatcctaatcgaaaagattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgctatcggtggcgcggtcggcggagccgtcggtaaccttcgtccctaaacccctaaacactaggcttgcagcatcaatccgtccgtgcgagcgcttcacccgtncgtggtttttttttttgggttggaagnaaaatagtgtggcgatttcaggaatcttctcgagctaggtaggacctacctccctgggtttggggggtaagctagggggcaatggaatactaagggggctttttggtaaaagttacaaaggggctaagaaaaccctccggggggggggaaaaatcccagggccccaattgggaattttgttccccccaattggttggggcctaaaggggggtgggttattccgcccccgccgggggttttgaaaacctcccggggggggggaaaaaaatggggggggaaa

SEQ ID NO: 11438 - DNA, 655 bp, Zea mays
  misc_feature: Ceres CLONE 1360905-F
  misc_feature: Encodes the peptide sequence at SEQ ID NO. 11439
  misc_feature (423)..(423): n is a, c, t, g, unknown, or other
  misc_feature (424)..(424): n is a, c, t, g, unknown, or other
  misc_feature (508)..(508): n is a, c, t, g, unknown, or other
  misc_feature (518)..(518): n is a, c, t, g, unknown, or other
  misc_feature (526)..(526): n is a, c, t, g, unknown, or other
  misc_feature (541)..(541): n is a, c, t, g, unknown, or other
  misc_feature (587)..(587): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaaagctcgcatccgatttccaatttcaaatccttcgatcgcgcagcgccgcccgccctctcgcagctctctccgatggcccgcacgaagcagacggcgaggaagtcaactggcggcaaggcgccgcggaagcagctggccaccaaggcggcgcgcaagtcggctccggccaccggcggcgtgaagaagccgcacaggttccgccccggcaccgtcgctctccgcgagatccgcaagtaccagaagagcacggagctgctcatccggaagctgcccttccagcggctggtgcgtgagatcgcgcaagacttcaagaccgacctnntcgttcagtcctccgctgtcgccgcgctgcaggaggccgccgaggcgtatctggtgggtctctttgaggacaccaacctctgcngcatccacgncaagaggntcaccatcatgcccnaggacatccagctcgcgcgccgcatcaggggcgagagggcctgatngctgctctgtcttcctggttctgaatgtctgaactaggcgatggactctatcgcttcttgtctgcatn

SEQ ID NO: 11439 - protein, 136 aa, Zea mays
  misc_feature: Ceres CLONE 1360905-F
  misc_feature (58)..(132): Pfam Name: Histone Pfam Description: Core histone H2A/H2B/H3/H4
  misc_feature (84)..(84): Xaa is any aa, unknown, or other
  misc_feature (112)..(112): Xaa is any aa, unknown, or other
  misc_feature (115)..(115): Xaa is any aa, unknown, or other
  misc_feature (118)..(118): Xaa is any aa, unknown, or other
  misc_feature (123)..(123): Xaa is any aa, unknown, or other
MARTKQTARKSTGGKAPRKQLATKAARKSAPATGGVKKPHRFRPGTVALREIRKYQKSTELLIRKLPFQRLVREIAQDFKTDLXVQSSAVAALQEAAEAYLVGLFEDTNLCXIHXKRXTIMPXDIQLARRIRGERA

SEQ ID NO: 11440 - DNA, 657 bp, Zea mays
  misc_feature: Ceres CLONE 1360907-F
acccgcggtggcggccgctctataactagtggatcccccgggctgcaggaattcgcacgagaccattacctagaacatcctaatcaaaaaaagagcgcagacaagagagagaaatcggaatccaagcgcaaccaaaagagaagaggccagacacgaggaagcgcgtgcatggacaggacatggtctctctcgtcccggcagtcccgtctcaagcaaaagctctctcctcttcttccgctcagggcaccaatcactgcaacatactgccctgagggcattgagttgtggaaaggcaaggagggggtatcatgggcatctcatccaagtggattaaatccttggttggcataaggaagcaagaaaaagcgcagaatgcagaataggatcaaaaagggtggaacgctgagagcagtgaaactaatagctctgctaatcaatcactgcacaaacggaaacattctttggatcccggagctgcacttgcagtcgaagaaattacagtacaaagtgaagcattgactgataacaaaagcgcacaaatggattcaaattcatttttttcagacagtacaccgcttgatgtgcacatttctcaggctgaacatcatagtaacgaagatttggacgcaactgttgtccagtctgcgtttcgagcgt

SEQ ID NO: 11441 - DNA, 664 bp, Zea mays
  misc_feature: Ceres CLONE 1360908-F
  misc_feature: Encodes the peptide sequence at SEQ ID NO. 11442
  misc_feature (486)..(486): n is a, c, t, g, unknown, or other
tggagctccccgcggtggcggccgctctataactagtggatcccccgggctgcaggaattcgcacgagaccattacctagaacatcctaatcgaaaagctagggtttactgcttgtcttcctttctcggcagtcggaaccttcgcggcttcgcctgatcacctacgccgcttctgcctgattctgattctctggtgctcccaagaagaaaggcaggtaatgaaggatcgccacctctcgctgaaccacaaccagcgggtccgcctcgaggacgcgcttcaagagctccagaccgttgagaccgccgtggagtccgacgccgtcgtcaccgtcgcggacaccattgccgtcaatcaagaggacatcatcctcaaggagcatgagacgtcggataagaacgtgtagggggttgcgacgctctgcgtggcgacgaaacgcgtcaacaagatgaggtacgtccgcactcttcgcacgagatacaacccgnaggatggcgatatcatagttgaccgtgagattgatattgctcctaagtgatgcaggttggagatcatatttacccaagatgttgctccgaggcttacatctatgagctggcctgacggcattcagagaaggtcatctgctgttgatgaacctaagatgcggcatatctttgaataaaa

SEQ ID NO: 11442 - protein, 61 aa, Zea mays
  misc_feature: Ceres CLONE 1360908-F
MKDRHLSLNHNQRVRLEDALQELQTVETAVESDAVVTVADTIAVNQEDIILKEHETSDKNV

SEQ ID NO: 11443 - DNA, 753 bp, Zea mays
  misc_feature: Ceres CLONE 1360909-F
  misc_feature: Encodes the peptide sequence at SEQ ID NO. 11444
aagctggagctccccgcggtggcggccgctctataactagtggatcccccgggctgcaggaattcgcacgagaccattacctagaacatcctaatcgaaaaatcctcgttcctatcgccagttcgccacctcctttgctctcgcctcgcgcgcgctcccccccgcgcatcgtgccgttcgccaccgcaccgcgccgatggaggtcgccgccgtgcccagatccgccgcggcctgccgtgcggcgcccctgctcccggccgtccgagccgctgcgtgccacctggccctgccccggggcgcgttctccgcatccgtcgcggcggcaccggcgccgcgccgcctcgccgctcgtcgcgctgcggatggcgacaagcgtggagacggcgccggaggcggtccccattgaaaaaaaggttcccctccctttccgagcgtcatggaacatccacccaaatccccgaagatcctccccccacagggttccccatttcctttttggtcgatacgagcaatttgaatacaaaggcttggaaaaaaatcgcgttgggggatcaaagaaatggtaccaaaaaatgaaaaatttccttcccaaggaaatttttcctggaaacccccaaaaaaggccccggggctcctccatggccccaggacttatggcccacggtcgggcgggttctgggggactgttccaaacctccaaagttggggggaatttccgagaaaaaattctttttttcccagcggaattgaaca

SEQ ID NO: 11444 - protein, 69 aa, Zea mays
  misc_feature: Ceres CLONE 1360909-F
MEVAAVPRSAAACRAAPLLPAVRAAACHLALPRGAFSASVAAAPAPRRLAARRAADGDKRGDGAGGGPH

SEQ ID NO: 11445 - DNA, 723 bp, Zea mays
  misc_feature: Ceres CLONE 1360916-F
  misc_feature: Encodes the peptide sequence at SEQ ID NO. 11446
  misc_feature (363)..(363): n is a, c, t, g, unknown, or other
  misc_feature (366)..(366): n is a, c, t, g, unknown, or other
  misc_feature (367)..(367): n is a, c, t, g, unknown, or other
  misc_feature (395)..(395): n is a, c, t, g, unknown, or other
  misc_feature (469)..(469): n is a, c, t, g, unknown, or other
  misc_feature (476)..(476): n is a, c, t, g, unknown, or other
tggagctccccgcggtggcggccgctctagaactagtggatcccccgggctgcaggaattcgcacgagaccattacctagaacatcctaatcgaaaatcacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggcctttgccctggccgtgtcgaccgccgaggcgaggaacatcaagaccacnacnnacgaaaagaggacgacgcggtggtgcanccgaaaaccttcccgcccttccaacgcttcgggggggggcgtccccgggggtccggggcctccccgggggaagnattcctnaaaaagaatccccgggtcacaatggcccggaagggaaaaaacctacccgggtttaactttgcccggaaggggaaaatgcccccttttgggggggggtcccccgggttttaagggttttggggggatgccggggggcccccaccgcggggtcccctcccgagagagcccaaaaaagcccgggaaacaaaaaaaggggggaaaaaagagggggttctttttttttataaaaccccccccccccctttct

SEQ ID NO: 11446 - protein, 151 aa, Zea mays
  misc_feature: Ceres CLONE 1360916-F
  misc_feature (33)..(33): Xaa is any aa, unknown, or other
  misc_feature (42)..(42): Xaa is any aa, unknown, or other
  misc_feature (67)..(67): Xaa is any aa, unknown, or other
  misc_feature (69)..(69): Xaa is any aa, unknown, or other
MARSSKMMVAAALLAFALAVSTAEARNIKTTTXEKRTTRWCXRKPSRPSNASGGGVPGGPGPPRGKXSXKRIPGSQWPGREKTYPGLTLPGRGKCPLLGGGPPGFKGFGGMPGGPHRGVPSRESPKKPGKQKKGGKKRGFFFFIKPPPPLS

SEQ ID NO: 11447 - DNA, 706 bp, Zea mays
  misc_feature: Ceres CLONE 1360919-F
  misc_feature: Encodes the peptide sequence at SEQ ID NO. 11448
aaagctggagctccccgcggtggcggccgctctagaactagtggatcccccgggctgcaggaattcgcacgagaccattacctagaacatcctaatcgaaaaatataaggctgcgactgcgagagccagccgcacccgcaccagtccataggccggcctcctctcttaccttcccacaccccttctcgaccgtacgtagcctagttgtgcttggtagccagccagaaggtcgtcggccgatgatgggaggaagaacagtggccccgccgctcgtcctcgcgctggtgaccatcatcgccatcgcggcggccgagggggacgaggtgaagtgtggcgggtgctctccgtgcggcggcgccgactgcccggtgctgtacccgtcgccgcccccgccgccgtactactactacagccctcccccacccgcgacctaccccggggagtcctcgtcatactaccaggccgcgccgccggggcgcgtacatccagatcgggagcgcgccgcccgggcaagggcccgctgtacccgcaggacccaggggttcatcccggcccggggggcggggcggggccgggccggttcgggggtgtacttggccttccgcgccggggttggcggggcccatgggcccttaatgggaatctccaaggggctttgactggaaaaggggcaggggaacttcttttttccgcgggaaaagaaagg

SEQ ID NO: 11448 - protein, 139 aa, Zea mays
  misc_feature: Ceres CLONE 1360919-F
MMGGRTVAPPLVLALVTIIAIAAAEGDEVKCGGCSPCGGADCPVLYPSPPPPPYYYYSPPPPATYPGESSSYYQAAPPGRVHPDRERAARARARCTRRTQGFIPARGAGRGRAGSGVYLAFRAGVGGAHGPLMGISKGL

SEQ ID NO: 11449 - DNA, 656 bp, Zea mays
  misc_feature: Ceres CLONE 1360922-F
  misc_feature: Encodes the peptide sequence at SEQ ID NO. 11450
  misc_feature (390)..(390): n is a, c, t, g, unknown, or other
  misc_feature (400)..(400): n is a, c, t, g, unknown, or other
aaagctggagctccccgcggtggcggccgctctagaactagtggatcccccgggctgcaggaattcgcacgagaccattacctagaacacctaatcaaaaaaacccaactcgagccctcgacgagcacccgagagacacgagagtgaaggaaagaggaaaaagaagaagactacagccaaaaccctatctcactccggcgcgccaccggccgatggcttcgatgaacaccacgccgaatccgcttgactccgccgccggcagcgccgccgtcgccggcggaatgcgtggacgagggaggaggaggaggcggcaggaagaagcggatgcgcggggcggtagcggcggcgatggtgccgccgccgatggcggtcccgctgacggccgggtgncccgcgtcgngggaggaggttcggaaggtcaggaagccgtacaccatcaccaaatcccgggagagctggacggagccggagcacgataagttcctcgaggccctgcaggtttttgatcgtgattggaagaagattgaagcatatgtcggctcgaagactgttatacagataaggagctatgcacagaagtacttcttgaaggttcagaagaatggcacaggcgagcatctgcccccacccaggccaaaacggaagggagctcatcc

SEQ ID NO: 11450 - protein, 110 aa, Zea mays
  misc_feature: Ceres CLONE 1360922-F
  misc_feature (42)..(87): Pfam Name: Myb_DNA-binding Pfam Description: Myb-like DNA-binding domain
  misc_feature: The sequence is a functional homolog of SEQ ID NO 1752 in the 10/412,699 US patent application
  misc_feature: The sequence is a functional homolog of SEQ ID NO 1974 in the 10/374,780 US patent application
  misc_feature: The sequence is a functional homolog of SEQ ID NO 337 in the 11/479,226 US patent application
  misc_feature: The sequence is a functional homolog of SEQ ID NO 392 in the 10/666,642 US patent application
  misc_feature: The sequence is a functional homolog of SEQ ID NO 146 in the 10/412,699 US patent application
  misc_feature: The sequence is a functional homolog of SEQ ID NO 1049 in the 11/479,226 US patent application
  misc_feature: The sequence is a functional homolog of SEQ ID NO 454 in the 10/412,699 US patent application
  misc_feature: The sequence is a functional homolog of SEQ ID NO 12 in the 10/225,066 US patent application
  misc_feature: The sequence is a functional homolog of SEQ ID NO 1889 in the 11/479,226 US patent application
  misc_feature: The sequence is a functional homolog of SEQ ID NO 2676 in the 10/374,780 US patent application
  misc_feature: The sequence is a functional homolog of SEQ ID NO 156 in the 10/225,066 US patent application
  misc_feature: The sequence is a functional homolog of SEQ ID NO 1636 in the 11/479,226 US patent application
  misc_feature: The sequence is a functional homolog of SEQ ID NO 2560 in the 10/374,780 US patent application
  misc_feature: The sequence is a functional homolog of SEQ ID NO 804 in the 10/412,699 US patent application
  misc_feature: The sequence is a functional homolog of SEQ ID NO 390 in the 10/666,642 US patent application
  misc_feature: Functional homolog of the protein sequence given in SEQ ID NO 96871
  misc_feature: Useful for making plants with modulated light response
  misc_feature: The sequence is a functional homolog of SEQ ID NO 1067 in the 11/479,226 US patent application
  misc_feature: The sequence is a functional homolog of SEQ ID NO 146 in the 10/374,780 US patent application
  misc_feature: The sequence is a functional homolog of SEQ ID NO 1806 in the 10/412,699 US patent application
  misc_feature: The sequence is a functional homolog of SEQ ID NO 254 in the 11/375,241 US patent application
  misc_feature: The sequence is a functional homolog of SEQ ID NO 464 in the 10/412,699 US patent application
  misc_feature: The sequence is a functional homolog of SEQ ID NO 794 in the 10/225,066 US patent application
  misc_feature: The sequence is a functional homolog of SEQ ID NO 1096 in the 10/225,066 US patent application
  misc_feature: The sequence is a functional homolog of SEQ ID NO 128 in the 10/412,699 US patent application
  misc_feature: The sequence is a functional homolog of SEQ ID NO 1744 in the 10/412,699 US patent application
  misc_feature: The sequence is a functional homolog of SEQ ID NO 303 in the 11/479,226 US patent application
  misc_feature: The sequence is a functional homolog of SEQ ID NO 34 in the 11/375,241 US patent application
  misc_feature: The sequence is a functional homolog of SEQ ID NO 36 in the 10/374,780 US patent application
  misc_feature (22)..(22): Xaa is any aa, unknown, or other
  misc_feature (26)..(26): Xaa is any aa, unknown, or other
MRGAVAAAMVPPPMAVPLTAGXPASXEEVRKVRKPYTITKSRESWTEPEHDKFLEALQVFDRDWKKIEAYVGSKTVIQIRSYAQKYFLKVQKNGTGEHLPPPRPKRKGAH

SEQ ID NO: 11451 - DNA, 698 bp, Zea mays
  misc_feature: Ceres CLONE 1360930-F
  misc_feature: Encodes the peptide sequence at SEQ ID NO. 11452
  misc_feature (514)..(514): n is a, c, t, g, unknown, or other
aagctggagctccccgcggtggcggccgctctagaactagtggatcccccgggctgcaggaattcgcacgagaccattacctagaacatcctaatcgaaaaccgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctgtgacggccggcacatcaccgtcagcgaggcccagtcccgcggcggccgtgaaggcggagccgatgtctacggtggtgaccgtggaggcgncgactacggtggtgttggccgcatgatgtcggtggcgcctactcggtggctgcgtctacggtggcggcgaggtctacggcgtggggggcggtgactacgatggtgccaaccgtggtggggggtacggtaatcccgagggaaactggaggaattgagcgggtgggccccggcgggctaggtatcc

SEQ ID NO: 11452 - protein, 74 aa, Zea mays
  misc_feature: Ceres CLONE 1360930-F
  misc_feature (10)..(75): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKEL

SEQ ID NO: 11453 - DNA, 698 bp, Zea mays
  misc_feature: Ceres CLONE 1360934-F
  misc_feature: Encodes the peptide sequence at SEQ ID NO. 11454
  misc_feature (469)..(469): n is a, c, t, g, unknown, or other
  misc_feature (507)..(507): n is a, c, t, g, unknown, or other
  misc_feature (524)..(524): n is a, c, t, g, unknown, or other
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaagccgaattaagttcgtgcacgtacgcacgcaccgggacaccagcaacccccaacagcgccactgtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacngtcgcggctccgttcaccaagagagtctgctgctcaangtcctgctgctgggcgncggctcacttctgggctacgtcagcgcgtcggcgtcaccggacctcctgccgatcagaaaggacctcaggagcccgcgcagccgggcccgcgcggcaagatctaagctcagcttctcccattgcatggnctagtagcttgctttgactgctagcgccggtcgatccgtcgcaat

SEQ ID NO: 11454 - protein, 155 aa, Zea mays
  misc_feature: Ceres CLONE 1360934-F
  misc_feature (5)..(142): Pfam Name: PSI_PsaH Pfam Description: Photosystem I reaction centre subunit VI
  misc_feature (102)..(102): Xaa is any aa, unknown, or other
  misc_feature (108)..(108): Xaa is any aa, unknown, or other
  misc_feature (151)..(151): Xaa is any aa, unknown, or other
MASLAAVSVKPVAIKGLAGSSISGRKLAVARPSARSIRRPRAAAVVAKYGDKSVYFDLDDIGNTTGQWDLYGSDAPSPYNPLQSKFFETVAAPFTKRVCCSXSCCWAXAHFWATSARRRHRTSCRSERTSGARAAGPARQDLSSASPIAWXSSLL

SEQ ID NO: 11455 - DNA, 724 bp, Zea mays
  misc_feature: Ceres CLONE 1360940-F
  misc_feature: Encodes the peptide sequence at SEQ ID NO. 11456
  misc_feature (293)..(293): n is a, c, t, g, unknown, or other
  misc_feature (314)..(314): n is a, c, t, g, unknown, or other
  misc_feature (401)..(401): n is a, c, t, g, unknown, or other
  misc_feature (450)..(450): n is a, c, t, g, unknown, or other
  misc_feature (498)..(498): n is a, c, t, g, unknown, or other
  misc_feature (500)..(500): n is a, c, t, g, unknown, or other
  misc_feature (502)..(502): n is a, c, t, g, unknown, or other
aaagctggagctccccgcggtggcggccgctctagaactagtggatcccccgggctgcaggaattcgcacgagaccattacctagaacatcctaatcgaaaaatcccatctccatccccatccatagagctgcaggcggcctgcgctgcagccaacaagctcatcagctcaccgtacctaggaggacgaccgagcagctaaggtagtagtagctagctagccagtgatggcgggctacaaagcgcagggcggggcgctcggcgtcgtcctggctgtcgccgcgctcttcgcgncggcagcgatggcgatggcgntggacgacgagcacatgtaccactggaagtgcttcaagtcgtgcacggggaactgccgcgacgaggacgcccttgacgacgtcttcnccggcactccgagggctccctccacgtcgtcgtcgctgccgtcctcggngggaaggtgaaggaacaggtgcctcaacgaggggcttcgaggacctgncngncccttgctaacacaagggggttgccaccaaatggctcggtttaccccccttttaaaaaaaaaaaaggggatgggcctgaaaaaattggttaaaaaaagtggttccccccagggccccccttgtcccaaaaacgagaggcccccataggtttgggccccccaaaagcccccctcgccccggggaaaaccaaaaccccccccgaaaccgaaaaccccaaacccc

SEQ ID NO: 11456 - protein, 77 aa, Zea mays
  misc_feature: Ceres CLONE 1360940-F
  misc_feature (23)..(23): Xaa is any aa, unknown, or other
  misc_feature (30)..(30): Xaa is any aa, unknown, or other
  misc_feature (59)..(59): Xaa is any aa, unknown, or other
  misc_feature (75)..(75): Xaa is any aa, unknown, or other
MAGYKAQGGALGVVLAVAALFAXAAMAMAXDDEHMYHWKCFKSCTGNCRDEDALDDVFXGTPRAPSTSSSLPSSXGR

SEQ ID NO: 11457 - DNA, 721 bp, Zea mays
  misc_feature: Ceres CLONE 1360947-F
  misc_feature: Translation starting site: 173
  misc_feature (245)..(245): n is a, c, t, g, unknown, or other
  misc_feature (246)..(246): n is a, c, t, g, unknown, or other
  misc_feature (295)..(295): n is a, c, t, g, unknown, or other
  misc_feature (334)..(334): n is a, c, t, g, unknown, or other
  misc_feature (336)..(336): n is a, c, t, g, unknown, or other
  misc_feature (349)..(349): n is a, c, t, g, unknown, or other
  misc_feature (362)..(362): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (706)..(706): n is a, c, t, g, unknown, or other
aaagctggagctccccgcggtggcggccgctctagaactagtggatcccccgggctgcaggaattcgcacgagaccattacctagaacatcctaatcgaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctgnnagagacgagcaccgccgcgcaggccaccgtcgtccctcgcgtgccccgnagaagaaagccgcgcccgagttcgtcgaggcccgcgcgnantcggggaaggccncccacggttgcanctggcgtgggaactgggaagggcgacccctgaaacggttgatccattcgatcgaagaccgtgggaaatgatattacccattcgaggtggggggggggggtgaacaaaaaaaaggagggcggatgggtggcccaaaaagggatttgggggggggggggaaaaaaaaaaaaaaaaaaaactccccagttgtgttctcccccccggggggtggggggcactttttgtgtttatgacaaaagggggcccccccccgggggggggagacaacatccttttgaaaaaaaaaatattggccccccccttgttttttttttcttttttttnnnnnnnnnnnnnggnnngagnaaaaaaaaaaaaaaa

SEQ ID NO: 11458 - DNA, 666 bp, Zea mays
  misc_feature: Ceres CLONE 1360949-F
  misc_feature: Encodes the peptide sequence at SEQ ID NO. 11459
  misc_feature (511)..(511): n is a, c, t, g, unknown, or other
  misc_feature (609)..(609): n is a, c, t, g, unknown, or other
aaagctggagctccccgcggtggcggccgctctagaactagtggatcccccgggctgcaggaattcgcacgagaccattacctagaacatcctaatcgaaaatcccctctccgtctcccagtccggcctcgctcgccactcggagtctcggagtcaaccgccagcgcctcgatccggcgaagccagcccagcccatggcctccggcgccgtaccaccgcagcgggtcgccctgctggcgctcgccgtcctctccgtcgtctcattcccgcacctgtccctccccgcctcgtcccatccgctcccgcaggaagctgctgctgctgctgctgcgggtgcggcggcgggaggcgaggcgtccgagcctcacggcaccgccgccgatggtgccgccgtggcgcggcgcgcgtgcacgtacacggtgcagatcaagacgagctgcgcgtccccgcggagctccgcggacgcggtgagcctcgcgttcggggacgcgtaccgcaacgaggtgtacgncgcgacggtgacgccgcggcgcgggttcgagcgctgcgccacggacacgttccgcgtcgccgggccctgcggctacggcgtctgctactctacatggncccgggtcgggccgcccccgccggtgtacgcccggaggggggtcagttgtaacaaac

SEQ ID NO: 11459 - protein, 157 aa, Zea mays
  misc_feature: Ceres CLONE 1360949-F
  misc_feature (53)..(155): Pfam Name: ATS3 Pfam Description: Embryo-specific protein 3, (ATS3)
  misc_feature (106)..(106): Xaa is any aa, unknown, or other
  misc_feature (139)..(139): Xaa is any aa, unknown, or other
MASGAVPPQRVALLALAVLSVVSFPHLSLPASSHPLPQEAAAAAAAGAAAGGEASEPHGTAADGAAVARRACTYTVQIKTSCASPRSSADAVSLAFGDAYRNEVYXATVTPRRGFERCATDTFRVAGPCGYGVCYSTWXRVGPPPPVYARRGVSCNK

SEQ ID NO: 11460 - DNA, 676 bp, Zea mays
  misc_feature: Ceres CLONE 1360950-F
  misc_feature: Encodes the peptide sequence at SEQ ID NO. 11461
  misc_feature (290)..(290): n is a, c, t, g, unknown, or other
  misc_feature (324)..(324): n is a, c, t, g, unknown, or other
  misc_feature (355)..(355): n is a, c, t, g, unknown, or other
  misc_feature (356)..(356): n is a, c, t, g, unknown, or other
  misc_feature (394)..(394): n is a, c, t, g, unknown, or other
aaagctggagctcaccgcggtggcggccgctctagaactagtggatcccccgggctgcaggaattcgcacgagaccattacctagaacatcctaatcgaaaaagactccagtctcctctagccgtctcgcgcgcttcaccttccccaccccgccgccgccatcgcacgcccgcagccgcatccgctatgggtgcgtacaagtacgtctcggagctatggcggaggaagcagtccgatgtgatgcggttcgtgcagcgcgtgcgctgctgggagtacaggcagcagccggncatcgtccgcctcacaggcccactcgccctgacnaggcgcgccgcctcggctacaaggcaagcannggtatgtcgtttacgggtccgtggtaagcgtggtgcangaaagaggccttgtgctaaggtattgtctatgggcaagccaaagcacaggggatcacccagctcaagtcccaaggaaacaaaaggtctggtgcttgaggaaagggcttgaaaaaagttgggtggaaccggggttcccaactccaacgggggggatgggggaaccccccacgggtcttttggaacccttcttggtggagggggccccacatcccctccccatagggcccaggaaccaggggtttattaaaccttgggcaaaaacccgggggttccgggggccc

SEQ ID NO: 11461 - protein, 105 aa, Zea mays
  misc_feature: Ceres CLONE 1360950-F
  misc_feature (2)..(106): Pfam Name: Ribosomal_L15e Pfam Description: Ribosomal L15
  misc_feature (35)..(35): Xaa is any aa, unknown, or other
  misc_feature (57)..(57): Xaa is any aa, unknown, or other
  misc_feature (70)..(70): Xaa is any aa, unknown, or other
MGAYKYVSELWRRKQSDVMRFVQRVRCWEYRQQPXIVRLTGPLALTRRAASATRQAXVCRLRVRGKRGAXKRPCAKVLSMGKPKHRGSPSSSPKETKGLVLEERA

SEQ ID NO: 11462 - DNA, 684 bp, Zea mays
  misc_feature: Ceres CLONE 1360951-F
  misc_feature: Translation starting site: 499
  misc_feature: Pfam Name: Auxin_BP Pfam Description: Auxin binding protein
  misc_feature (205)..(205): n is a, c, t, g, unknown, or other
  misc_feature (399)..(399): n is a, c, t, g, unknown, or other
aaagctggagctccccgcggtggcggccgctctagaactagtggatcccccgggctgcaggaattcgcacgagaccattacctagaacatcctaatcgaaaactagcctctatctcattccactccgacattcacgtgcagctgtcgggagcaggcaatggcgccggatctaagcgaagtcgccgccgccgctccagcccgtgangcctacctcgccggcgtcggtgtcgcgatcctcctcgctgcctccttcctccagtagccgagtcgtcctgcgtgcgagaatactcattggtgagagacataagccagatgcgcacagcagctatgggattgaaggatgtcacatataacagttgctcgtgccctcaatcatggggaggagggaggtgaaatttncctccacacaataagtccaggtcaagggacgccaatccacagggaatttcctgtgaagaagtttccactgccctccaaagggggaggggtacgctcttgatgggatcaagctcactaaaggacccagggcagccccaaggaaatccttttctttcagaaaaccccaattttccatccccggaaaaggaaccccaccaggttgggaattttgacaaacacaaaaaatttgcaagttcttttggaccatatcgaggccccccctggctaagaatttttaaaaggagg

SEQ ID NO: 11463 - DNA, 697 bp, Zea mays
  misc_feature: Ceres CLONE 1360952-F
  misc_feature: Encodes the peptide sequence at SEQ ID NO. 11464
  misc_feature (449)..(449): n is a, c, t, g, unknown, or other
  misc_feature (473)..(473): n is a, c, t, g, unknown, or other
  misc_feature (517)..(517): n is a, c, t, g, unknown, or other
  misc_feature (535)..(535): n is a, c, t, g, unknown, or other
  misc_feature (581)..(581): n is a, c, t, g, unknown, or other
  misc_feature (648)..(648): n is a, c, t, g, unknown, or other
  misc_feature (649)..(649): n is a, c, t, g, unknown, or other
  misc_feature (655)..(655): n is a, c, t, g, unknown, or other
  misc_feature (656)..(656): n is a, c, t, g, unknown, or other
  misc_feature (673)..(673): n is a, c, t, g, unknown, or other
aaagctggagctccccgcggtggcggccgctctagaactagtggatcccccgggctgcaggaattcgcacgagaccattacctagaacatcctaatcgaaaagcccgcggtgctagtgacggttgctctagatccgttcatcctggtggttttgtgaggtcgaaagcggcgagcgaattagaagatgctggacaagctgtgggacgacgtggtggccgggcctcgcccggagacgggcctcgagaagctccgcaaggccaccaccgcccgcccgctcgtcatcaacaaagacgcggacggcggcagctacaagcgggcgcagtcgacgccgtcgaccccgacgacgccggtgacgccgtcgtcgtcgacgacgccgcgcggcgccggcaacgtgtggcgcagcgtcttccaccccgggagcaacctggccaccaagggcatgggcgccnacctcttttcgacggcgcagcccnactcccccaccgtctacgactgtctctacagcgacgagaccagnagcaaccaccgctagatncggcgagatggatggacagtgaaagagccatggttgctggtccttngtggtatctaaaacgcacgcatgctctattatagctagtcatcactatatatatacttggggtttgnngatggnntgtctttgtctgctggngtctccgcccgttaatttgactag

SEQ ID NO: 11464 - protein, 115 aa, Zea mays
  misc_feature: Ceres CLONE 1360952-F
  misc_feature (5)..(115): Pfam Name: Auxin_repressed Pfam Description: Dormancy/auxin associated protein
  misc_feature (89)..(89): Xaa is any aa, unknown, or other
  misc_feature (97)..(97): Xaa is any aa, unknown, or other
  misc_feature (111)..(111): Xaa is any aa, unknown, or other
MLDKLWDDVVAGPRPETGLEKLRKATTARPLVINKDADGGSYKRAQSTPSTPTTPVTPSSSTTPRGAGNVWRSVFHPGSNLATKGMGAXLFSTAQPXSPTVYDCLYSDETXSNHR

SEQ ID NO: 11465 - DNA, 688 bp, Zea mays
  misc_feature: Ceres CLONE 1360953-F
  misc_feature: Encodes the peptide sequence at SEQ ID NO. 11466
  misc_feature (516)..(516): n is a, c, t, g, unknown, or other
  misc_feature (550)..(550): n is a, c, t, g, unknown, or other
aaagctggagctccccgcggtggcggccgctctagaactagtggatcccccgggctgcaggaattcgcacgagaccattacctagaacatcctaatcgaaaaatcctcgcaagtctccctctcctagattccggtgccgcaccgcgttgcggtttttatagtcctctctgccactggtgatcccactaggcacagatgcctgccttcgcgaagcccgcatcgagctgctgccagaccgccgcgtctccaaagccgaaatctggcactgccaagcctaatacggctaccgctggtgcctcccagccttcttaattcaagatgatagaggatgctatcacgactttgaatgagaggaccgcttctagctcagaagcatatccgaagtattcgccagacaagcactctccgacttcttcggccgactgcacaagatgctcttcatctggctctatgcatccggatgctagcgcaccctcgacgagttcaacgtcttagtacagctctcgtacgtctccnagtaagtatccccctacatcattgataaagcgcnaacggtcgctttggcagtagcacgcacctcagccggccgaggccggctctcgcaaaaactaagaatgctccccctccaaaccaaataaacccccatgttgctgatcccagcttccaagggcccgaaaagaggttcggt

SEQ ID NO: 11466 - protein, 38 aa, Zea mays
  misc_feature: Ceres CLONE 1360953-F
MPAFAKPASSCCQTAASPKPKSGTAKPNTATAGASQPS

SEQ ID NO: 11467 - DNA, 716 bp, Zea mays
  misc_feature: Ceres CLONE 1360963-F
  misc_feature: Encodes the peptide sequence at SEQ ID NO. 11468
  misc_feature (303)..(303): n is a, c, t, g, unknown, or other
  misc_feature (377)..(377): n is a, c, t, g, unknown, or other
  misc_feature (378)..(378): n is a, c, t, g, unknown, or other
  misc_feature (404)..(404): n is a, c, t, g, unknown, or other
  misc_feature (410)..(410): n is a, c, t, g, unknown, or other
  misc_feature (415)..(415): n is a, c, t, g, unknown, or other
  misc_feature (427)..(427): n is a, c, t, g, unknown, or other
aaagctggagctccccgcggtggcggccgctctagaactagtggatcccccgggctgcaggaattcgcacgagaccattacctagaacatcctaataaaaatcacaattcactccactcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggncggatcgggcgctacctgaagaagggccggtacgcgcagcgcgtgggcactggcgcccccgtctacctcgccgnncgtctggagtacctcgccgccgaggntctggnagtgncagggaacgcgncgaaagaaacacagaagacgcgcatcatcccgcggcacgtgctcctggcgatcggcaacgacaagagctcctgaagctgctggaggggtcaccatcgcggaggggggggtcctcccaaaattcattccgggtttctgcccaaaaagggggcgaaaaagggggccagggccgggaaaaagggacccattcccccaagaaggggggccagtcccccaaaaagggtttaaaaggagggcctttttttgcccgggggggtgaaaaaagcccccggacaaaatttggggaggga

SEQ ID NO: 11468 - protein, 105 aa, Zea mays
  misc_feature: Ceres CLONE 1360963-F
  misc_feature (29)..(102): Pfam Name: Histone Pfam Description: Core histone H2A/H2B/H3/H4
  misc_feature (65)..(65): Xaa is any aa, unknown, or other
  misc_feature (74)..(74): Xaa is any aa, unknown, or other
  misc_feature (76)..(76): Xaa is any aa, unknown, or other
  misc_feature (78)..(78): Xaa is any aa, unknown, or other
  misc_feature (82)..(82): Xaa is any aa, unknown, or other
MDASGAGSKGKKGAAGRKAGGPRKKSVTRSVKAGLQFPVGRIGRYLKKGRYAQRVGTGAPVYLAXRLEYLAAEXLXVXGNAXKETQKTRIIPRHVLLAIGNDKSS

SEQ ID NO: 11469 - DNA, 685 bp, Zea mays
  misc_feature: Ceres CLONE 1360969-F
  misc_feature: Encodes the peptide sequence at SEQ ID NO. 11470
  misc_feature (413)..(413): n is a, c, t, g, unknown, or other
ctggagctccccgcggtggcggccgctctagaactagtggatcccccgggctgcaggaattcgcacgagaccattacctagaacatcctaatcaaaaaaccatatggaccacaagcctcgcgctggtagtctggtacagacgtacagtacagtcgctgcagcgaaagggggatcgcgcgaggcgagatggagctctcgccggtggggaggtgggccgacctccccgaggacatcgccgtagccgtcgcctcctgcctccaggaggccgacgtctgcgcgctcggcggctgctcgcgctcctggcgcagagcctgcgacgctgactgcatctgggagcgcctcttcccgctgcgctggccatctgccgtggcgtcggcgtcccctgtgcagggatggaaagctctctacatcangcagcacagaagaatggctggtgcaatatcttatggtggttgaattttgtgggcagcagcttaaataatgagtcacttgaatcggaatactatctggaagctattgctgatttggccttgatactggatatagattcctcgatggccagtttttcttgtccccagggatcatagggcggtatcaacctattggactgcccactcgatccatctttgcatggctgccactggaggcagaaggccctccagtcccgaatacaaaaagggtattt

SEQ ID NO: 11470 - protein, 89 aa, Zea mays
  misc_feature: Ceres CLONE 1360969-F
  misc_feature (7)..(54): Pfam Name: F-box Pfam Description: F-box domain
  misc_feature (76)..(76): Xaa is any aa, unknown, or other
MELSPVGRWADLPEDIAVAVASCLQEADVCALGGCSRSWRRACDADCIWERLFPLRWPSAVASASPVQGWKALYIXQHRRMAGAISYGG

SEQ ID NO: 11471 - DNA, 684 bp, Zea mays
  misc_feature: Ceres CLONE 1360974-F
  misc_feature: Encodes the peptide sequence at SEQ ID NO. 11472
  misc_feature (287)..(287): n is a, c, t, g, unknown, or other
  misc_feature (327)..(327): n is a, c, t, g, unknown, or other
  misc_feature (336)..(336): n is a, c, t, g, unknown, or other
tggagctccccgcggtggcggccgctctagaactagtggatcccccgggctgcaggaattcgcacgagaccattacctagaacatcctaatcgaaaaagagattcagagctgatgaactgcttctggtgtcctgtacatctcaagatgaaaaaaagcaccaccgtcctcgccatctccatcttggtcctctcccttgcctcccagttctcatggtgtgcagaagcagctgagggaagcgccggaatttccacagagcctgatctccaggtgcaagaacagtgcacgncgatatgaaaacccgcctgggaaatgcaggtcgcaaccgnaagcttggncatgaggtgaccacagtggagttgaaacatcacaggaggattacccagtggcaacagggtggcagcgcgggtgaaggcgcggccgccggtgcgcgggcgcaagcaccggtgggcataagggggggggcggggcccccggaccatccccacaattccaaaaaggggggggggccttccaggggccgggggcccccgcctgacccttgcctgggcctggggattttttttgcccccttggcctatggaggaaagaaatttttgctttcccggagccgattggatttcccaacccaattttaggggatttggccaaaaatttccccatttttcccggaaaaatttaaaaaa

SEQ ID NO: 11472 - protein, 49 aa, Zea mays
  misc_feature: Ceres CLONE 1360974-F
  misc_feature (48)..(48): Xaa is any aa, unknown, or other
MKKSTTVLAISILVLSLASQFSWCAEAAEGSAGISTEPDLQVQEQCTXI

SEQ ID NO: 11473 - DNA, 704 bp, Zea mays
  misc_feature: Ceres CLONE 1360976-F
  misc_feature: Encodes the peptide sequence at SEQ ID NO. 11474
  misc_feature (109)..(109): n is a, c, t, g, unknown, or other
  misc_feature (486)..(486): n is a, c, t, g, unknown, or other
  misc_feature (490)..(490): n is a, c, t, g, unknown, or other
  misc_feature (491)..(491): n is a, c, t, g, unknown, or other
  misc_feature (528)..(528): n is a, c, t, g, unknown, or other
  misc_feature (529)..(529): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (585)..(585): n is a, c, t, g, unknown, or other
  misc_feature (586)..(586): n is a, c, t, g, unknown, or other
  misc_feature (588)..(588): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
aaagctggagctccccgcggtggcggccgctctagaactagtggatcccccgggctgcaggaattcgcacgagaccattacctagaacatcctaatcgaaaagatactnacgggacctaggagtccgttcgatgaagctgatgactaatagccctgcgaaatatagtggtctgaagggttatggactgagcattgcgggcagggtgccccttggttacgccaattaccagcgagaaccgtaagtacctcgagaccaaaagacaaagatggggcatgtatatggattggctaatgcgcaggttaaccagccaagtggtagccagagcacagaagagaagcattgagcccaaaaaagtgatgcagtcttctttttgggagttcctgaaatcttctccctcgatatttccatatatcctttttttctatatttccataatatctttcctccacatagaaggcccgttttgtctttcactgtagctgtangttnncagatggttaatgagcctaataaaagcaagtttaatnnatatnnnnnnnnnnnnnnnnnnnnnnnnnnnnnnnnnnnnnnnnnnnnnnnnnaannanaaaaaaaannnnaannnnnnnnnnnnnnnnntttttnnnnnnnnnnnnnnnntgtttttctcttccccccccccccggggggggggcccgggcacacatttccccctaataggggg

SEQ ID NO: 11474 - protein, 36 aa, Zea mays
  misc_feature: Ceres CLONE 1360976-F
MKLMTNSPAKYSGLKGYGLSIAGRVPLGYANYQREP

SEQ ID NO: 11475 - DNA, 723 bp, Zea mays
  misc_feature: Ceres CLONE 1360981-F
  misc_feature: Translation starting site: 111
  misc_feature (402)..(402): n is a, c, t, g, unknown, or other
ctggagctccccgcggtggcggccgctctagaactagtggatcccccgggctgcaggaattcgcacgagaccattacctagaacatcctaatcgaaaaaacgacgacgagatggcgctccgtcggagcttcccctccctcggccgcgcgcttctcacgccggcgccggcgccggcgcggacgctctccgcggaggcctccgatgccctcgttgagatcaagcccggggagattgggatggtctccggcatccccgaggagcacctccgccgtaaggttgtaatttattcaccagctaggactgcatctcagcaaggttcaggcaaagttgggaggtggaaaattaactttttgtcaacccaaaagtgggcagaacccgctgatgggatggacatctactggngatccatatgctaatgtcggggaaagcaggacttacattcaacaggtgcgaagtcagcaaaaagcatttgctgaaaaacatggaatgggaataatgtgggacggaaaaacggaatactcctcttctggaagcctaagggcccacggtggagaaccttcaggtgggaaaaggccccccgaaagggggaagcaaggaaaacaaccccccagcaagcatgtggcccccggaacactgggaaaggatggttattttccccccccggaggctccaaaaaagtctataaacctccttgggcccgggagaaccgtggaattagggaaa

SEQ ID NO: 11476 - DNA, 736 bp, Zea mays
  misc_feature: Ceres CLONE 1360990-F
  misc_feature: Translation starting site: 201
  misc_feature (310)..(310): n is a, c, t, g, unknown, or other
aagctggagctccccgcggtggcggccgctctagaactagtggatcccccgggctgcaggaattcgcacgagaccattacctagaacatcctaatcgaaaagtgctttcttagaggtgggttggcttctcctccccctccggttcgggttcgggttcgtgaggttctccgaggttcggtttcgtgggtgagcggatcgagatggcggcgtcggatgttgagtaccgctgcttcgtcgggcggctcgcctgggccacggacgaccactccctccacaacgccttcagcacctacggcgaggtcctcgaatncaagatcatcctcgatcgggagacgaagaggtcccgggggtttcgggttcgtcaccttctccacggaggaggcgatgggggaacgccatcaagggcattgaagggcaagggagttgaagggccggaaaatcaccgtcaaagaaggcccaaatcccggggccgcccgtggagagcggtcgccggtgggaaacggggggggccctggaagggggcggtatacggccgtttgcggcaccccctaatgggcggggggagaaaacgagggggggcgtggatggcttacctggcgagggcgcgagttaagggggggggggggggggggttaaaggggggggggaaagcgtggggaggggttttaagctaatttcctaatgggaaattgggggaatattgtggggggggggcgcccccgcgggaaaaaaataa

SEQ ID NO: 11477 - DNA, 696 bp, Zea mays
  misc_feature: Ceres CLONE 1360996-F
  misc_feature: Encodes the peptide sequence at SEQ ID NO. 11478
  misc_feature (361)..(361): n is a, c, t, g, unknown, or other
aaagctggagctccccgcggtggcggccgctctagaactagtggatcccccgggctgcaggaattcgcacgagaccattacctagaacatcctaatcgaaaacgccgcacccccaagacttccgtccgagtctgagctcatctccgcgcgctgccgccgccgccgccgccgctcgacgcccaccgcgcagccatggcggaacagaccgagaaggcttttctcaagcagcctaaggtgttcctcagctcacagaaatctggcaagggtaacaagccaggcaagcctggcaatcgattttgactgagcatgtggcttggtttctagactcccagggcagctattgaagggatctacattgacnagagatgtccattcactggtaccgtatctatcagacgcagaattatcgctgggacatgccacagtgctaaaatggacagaaccatcatttgttcggcagactacctgccctttgttaataaataccggaggtatgaaaagagggacttccagattccagttcaaatctccccatggttccgggaaaggagggcgaacttggcccccttgggccagggaagcccctttaaaaagtgggaggtcaaagggcgttaaaacattccccctggtttggtggggggggaaaaagccttacccgaacccgggtttaaacactggcccgggaacttttatagt

SEQ ID NO: 11478 - protein, 35 aa, Zea mays
  misc_feature: Ceres CLONE 1360996-F
MAEQTEKAFLKQPKVFLSSQKSGKGNKPGKPGNRF

SEQ ID NO: 11479 - DNA, 683 bp, Zea mays
  misc_feature: Ceres CLONE 1360998-F
  misc_feature: Encodes the peptide sequence at SEQ ID NO. 11480
  misc_feature (393)..(393): n is a, c, t, g, unknown, or other
  misc_feature (435)..(435): n is a, c, t, g, unknown, or other
  misc_feature (438)..(438): n is a, c, t, g, unknown, or other
  misc_feature (446)..(446): n is a, c, t, g, unknown, or other
  misc_feature (455)..(455): n is a, c, t, g, unknown, or other
  misc_feature (456)..(456): n is a, c, t, g, unknown, or other
  misc_feature (463)..(463): n is a, c, t, g, unknown, or other
  misc_feature (496)..(496): n is a, c, t, g, unknown, or other
  misc_feature (520)..(520): n is a, c, t, g, unknown, or other
aagctggagctccccgcggtggcggccgctctagaactagtggatcccccgggctgcaggaattcgcacgagaccattacctagaacatcctaatcgaaaaatcacacactcgactctcctctctcgcatccgcagcctttcgagctctactccaccccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggtacctgaagaagggccggtacgcgcagcgcgtcggcacgggcgcccccgtctacctggncgccgtcctcgagtacctggccgccgaggtgctggagctggncgncaacgctngcaaggacnnacagaangaccgcatcatccccgcgcacgtggctcttggncatcggcacgacgaggagctcggnaagctgctgtcccgcggtaccatcgcccaggggggggtccttccccaaaataaacccgggggtccggcccaaaaaaaaccgttaaaaaaggggggggccaaagggaggcccaatccgccccaaaaaagggcccccaaaccccccccaaaaaaaggggagaagg

SEQ ID NO: 11480 - protein, 162 aa, Zea mays
  misc_feature: Ceres CLONE 1360998-F
  misc_feature (31)..(104): Pfam Name: Histone Pfam Description: Core histone H2A/H2B/H3/H4
  misc_feature (66)..(66): Xaa is any aa, unknown, or other
  misc_feature (80)..(80): Xaa is any aa, unknown, or other
  misc_feature (81)..(81): Xaa is any aa, unknown, or other
  misc_feature (84)..(84): Xaa is any aa, unknown, or other
  misc_feature (87)..(87): Xaa is any aa, unknown, or other
  misc_feature (89)..(89): Xaa is any aa, unknown, or other
MDASAAGAGGKAKKGAAGRKAGGPRKKSVTRSVKAGLQFPVGRIGRYLKKGRYAQRVGTGAPVYLXAVLEYLAAEVLELXXNAXKDXQXDRIIPAHVALGHRHDEELGKLLSRGTIAQGGVLPQNKPGGPAQKKPLKKGGAKGRPNPPQKRAPKPPPKKGEK

SEQ ID NO: 11481 - DNA, 683 bp, Zea mays
  misc_feature: Ceres CLONE 1361012-F
  misc_feature (371)..(371): n is a, c, t, g, unknown, or other
  misc_feature (683)..(683): n is a, c, t, g, unknown, or other
aagctggagctccccgcggtggcggccgctctagaactagtggatcccccgggctgcaggaattcgcacgagaccattacctagaacatcctaatcgaaaaagctgaaagtccgccaaaacgcagaagctgcactgcctacatccagctaactatctgcagcgatgtctcgctcctgctgccgcgccgtgtcgaggattctctgtgtctccacgatagccagcgtcaccgcgcctatatggctgaaccaggaggccatggtcacggtcctccctgccggagagggtgcaaggaacgactacctccgcgtacacctgaactgcagacaaggcgacacccgcaaggccgaccagagacatggccacgcagacnaactactagagctctctaagcgcaagtgagactactgataagcacagctgaatggcgtcggacagctatagcatatgtcgctcagcgaggaggagtgccacgagaaaatgatgatatgctttactgggagaacgctcctcgtcggcacagaaagtgcaccagccgagggcaccatagcccatgtgccgccccccttgctagcaaacgcgaggtccgcgaccttgcccgcccggtaaacaccgcgaaacggatcaagttgctttgccttaaccttcccttggggaacacctgctctggtttttccttcccaan

SEQ ID NO: 11482 - DNA, 669 bp, Zea mays
  misc_feature: Ceres CLONE 1362267-F
tggagctccccgcggtggcggccgctctagaactagtggatcccccgggctgcaggaattcgcacgagaccattacctagaacatcctaatcgaaaaaagatgatgttcaaggagttcccctcctccacgcaagcttctcccctccatatccaggattgccgggatccttgtactctctagctcgcgcgacctcggcgagctactttgtttcgatttatagacaaatcaggttgcttcatgatgcgcaggcttaaatctgaatgccggattctgtctccttacagattgaatcgagctgggaggatgcggatctgaacacgggaggaactacaaatcctcgtgtatgacgagttggatacgttaccgactagtctctgacctgaagatattgcagctgagatggaatagaatgcctcgcagataagattctcgcctagacctagcgagaactgaaggttagtatggctcctttcggatcgcgactgaaacgatgatggctgtaggcctccgagtgatcagaatcttctctgctctgctcactcgggatgatgaatctgctgcgctgataatgatggcatgacttcgatgattatgacatcgaagagatgctgcgacttcaaccagatacgtatggagctacatgtttacacgtgacatgctatagatcc

SEQ ID NO: 11483 - DNA, 722 bp, Zea mays
  misc_feature: Ceres CLONE 1362271-F
  misc_feature: Translation starting site: 206
aagctggagctccccgcggtggcggccgctctagaactagtggatcccccgggctgcaggaattcgcacgagaccattacctagaacatcctaatcgaaaagcgctcttcacccatttccccatctccgacctcccccttcctctcccccctgccgctccccgcgccgagaaggagaaccccagccgccgcgcagcgcgccgcccatggcctcctcgtcggagaacgcggctgtgccgccggaggaggagccccaggccccgccgccgccggacacagagcctaccgaggcggcgcccggcgaggcggaggatgagccgcaaaccctagagcgggcgcaggagctcttcgacaggggttcaaggccatcgaggatgaggacttcgtcgacgccgtagactgcctcagccgagcgctcgagatcagggcttcacattatggagagctcgcgccggagtgtgccacacataacttcaaaatgggatggggcctgctataccaagtcaggaggaaaagggatgttttggaaaagttccacagaagctgcccaaagggaaaccccggggagaggtacgggtaccaaagagggaaggggaaaccccaaagggcccgggtacccaggggggagggagcgtggcccctcaaaaaaggttggggggggaaaaagggcaaacctcagggggaaaatcccgaaaaagggagagggggatattaaaaaaaaaa

SEQ ID NO: 11484 - DNA, 827 bp, Zea mays
  misc_feature: Ceres CLONE 1362281-R
  misc_feature: SWISSPROT Homolog: EC 2.5.1.67 Chrysanthemyl diphosphate synthase
tgtctgctgctgcggtccacaaagagaaacagcaccttgccttaattgcctgttaatattgagagcaacaaggtgcttcatactacctcgagttttttcaactagacgctccacatcatactttagctaccaggtgaggaagtccggttatgtcatgcatgccgaaggattaacgactccggagctcgtttgtgctttagcaccctacttctggctcgtgtacatcttgtgcaagaaggatttcagctctttcggaaccgcaatgcttgggtggggttcaatgtctgccatcaacttcttgtagatctcgttcacggactcgtgaaataccgcctctggggcaagtactttgtacaggttcttcacttttgccacagaacggtggatctttcttgggataattttcaaataggaatgcgcttttggctctcataaggacgctcaacggctagcacaactagacgtgagcgcttgtgatcctatatggccggtcaaatcttgccgagtcaatctctggatcaccataacaatccagacagtcatactggacttgaaagcatagtcacattgcaacagagatgttatcgacatcaccataattgtgcaaattctcaccagatagcagcaagtcacatgcaaccggcagatcacatgaataataggctgtcctcgccttgaacaattcgaccgtgtactgccatgttatacaggggttaagatctctctctggcgtcatgcgtagtgataactgtccaccagcgtgaacctgaaagatgccgtttgaacttctacctcattggaacagatccagggagatctagcatggt

SEQ ID NO: 11485 - DNA, 677 bp, Zea mays
  misc_feature: Ceres CLONE 1362313-F
caaagctggagctccccgcggtggcggccgctctagaactagtggatcccccgggctgcaggaattcgcacgagaccattacctagaacatcctaatcgaaaaattctcgatccctctacctctcgcatccggtgcctggctgccagccccagcgctcgccaacctcatcttccccggcgtttcctcctagctccctccaccatgccgctgccatggaactcactgctcggccgcgccctggccatgctccctgcgctcgccagccgtgcgcatctccctctgcgcgcgctcctacgtcctgcgccgcgaaccccgctgtggagcttccccgagctcgccccatggcgcccggccgagctcctccctgccgtgttcttgctcggcgtccagttttcctgtgtgccgcggtcttcctccccgagctcaccccagccccttgtattccccatggccggagcttcttccagctccagctcggctccctctcccatggctctctgcgcgctagccgctgtgcgcccatctatctctcgtggatctccctccccagctcctctctgctcgcgccgtcgcccagcctgttggcacacgcactcctctgtcgcacgctcctccaagtcagagctccctctggccgttcccatggtcgcccctctctcagcttcatcttcagctt

SEQ ID NO: 11486 - DNA, 664 bp, Zea mays
  misc_feature: Ceres CLONE 1362358-F
  misc_feature: Encodes the peptide sequence at SEQ ID NO. 11487
  misc_feature (310)..(310): n is a, c, t, g, unknown, or other
  misc_feature (351)..(351): n is a, c, t, g, unknown, or other
  misc_feature (400)..(400): n is a, c, t, g, unknown, or other
  misc_feature (408)..(408): n is a, c, t, g, unknown, or other
  misc_feature (409)..(409): n is a, c, t, g, unknown, or other
  misc_feature (424)..(424): n is a, c, t, g, unknown, or other
  misc_feature (457)..(457): n is a, c, t, g, unknown, or other
  misc_feature (500)..(500): n is a, c, t, g, unknown, or other
  misc_feature (551)..(551): n is a, c, t, g, unknown, or other
  misc_feature (630)..(630): n is a, c, t, g, unknown, or other
aagctggagctccccgcggtggcggccgctctagaactagtggatcccccgggctgcaggaattcgcacgagaccattacctagaacatcctaatcgaaaaatcgcaccgcgagtttcgaaaaccccaaccaatcgcgcctcaaatcacgcgagggcgtgagggggaattcgctctcccagcctccgctcacccgtcgatcgatcgtccgggccaggggctctccggcggcaccggggccatggaggaggacccgctcatccctctggtgcacgtctggaacaacgccgccttcgaccatgcctccgccntccgcctccgcgtggcacgcccattcccctgcgcccgcgangcgcccgcgagggggacaaggagaaccaccgccccgagcccgacgttgnaggcgagnnggtcgacgacgttgnaggccgagatttaccacatcggaggcggagatncctggcgcctggtcttcccgcctccaccacctccgcacctccnagcagacggagccgcccaagcgtggacgggtcgcgcgggacgcggatgggnggggctcagtctggggcaaactcggacgtcgcggctggccgtcgactccgacccgctcaccgacaagcagcagcgaaancgccggcgcagggcttgaaaaagcctatcagcag

SEQ ID NO: 11487 - protein, 135 aa, Zea mays
  misc_feature: Ceres CLONE 1362358-F
  misc_feature (24)..(24): Xaa is any aa, unknown, or other
  misc_feature (37)..(37): Xaa is any aa, unknown, or other
  misc_feature (54)..(54): Xaa is any aa, unknown, or other
  misc_feature (56)..(56): Xaa is any aa, unknown, or other
  misc_feature (57)..(57): Xaa is any aa, unknown, or other
  misc_feature (62)..(62): Xaa is any aa, unknown, or other
  misc_feature (73)..(73): Xaa is any aa, unknown, or other
  misc_feature (87)..(87): Xaa is any aa, unknown, or other
  misc_feature (104)..(104): Xaa is any aa, unknown, or other
  misc_feature (130)..(130): Xaa is any aa, unknown, or other
MEEDPLIPLVHVWNNAAFDHASAXRLRVARPFPCARXAPARGTRRTTAPSPTLXAXXSTTLXAEIYHIGGGDXWRLVFPPPPPPHLXADGAAQAWTGRAGRGWXGLSLGQTRTSRLAVDSDPLTDKQQRXRRRRA

SEQ ID NO: 11488 - DNA, 654 bp, Zea mays
  misc_feature: Ceres CLONE 1362360-F
  misc_feature: Encodes the peptide sequence at SEQ ID NO. 11489
  misc_feature (385)..(385): n is a, c, t, g, unknown, or other
  misc_feature (406)..(406): n is a, c, t, g, unknown, or other
  misc_feature (484)..(484): n is a, c, t, g, unknown, or other
acccgcggtggcggccgctctagaactagtggatcccccgggctgcaggaattcgcacgagaccattacctagaacatcctaatcgaaaaactccgtatctctcgtgcctttttcctttcctggttgcgacgagccgacgactgggcggacgccgctgccgccctacgccaggtcttcgtcggccccttcgacgagcacacacaagattcagtcgggaatgttgaatgcatagtgtaatttctgcgcaaaaagatggcatcagacgagttcatcagccttgacgcaccttgtgaggctgatgcgaaagatgaagggggagacgttcaggttaaagctcctgatgtgagtgggatggagcctctggtatcggatctccaccagaangggaagctggtgctgtgggtntaatcccaagacatctgctgggaacctggaatctgagaggggcaaggggagaatatggactcccggatgatgacgtantggttggaaagatcaacttataaatgcttccatccagccccaaatcagggtgcacctgggcaaactgtgatggtttttaggccagctggacaggggggcgggcctgaaaaaagaaaatttttggggccaaccccctccctttggaaaaagcccccaaaaggggttaaaaa

SEQ ID NO: 11489 - protein, 51 aa, Zea mays
  misc_feature: Ceres CLONE 1362360-F
  misc_feature (44)..(44): Xaa is any aa, unknown, or other
MASDEFISLDAPCEADAKDEGGDVQVKAPDVSGMEPLVSDLHQXGKLVLWV

SEQ ID NO: 11490 - DNA, 698 bp, Zea mays
  misc_feature: Ceres CLONE 1362361-F
  misc_feature: Encodes the peptide sequence at SEQ ID NO. 11491
  misc_feature (457)..(457): n is a, c, t, g, unknown, or other
aaagctggagctccccgcggtggcggccgctctagaactagtggatcccccgggctgcaggaattcgcacgagaccattacctagaacatcctaatcgaaaaagtcgaccgccgcagaccgggagtagtcgacgcgccgtcactgaatcctcagatcacggctagccgtaatcacgccactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaaagctcaggccgagcgtgagagaagtatcacaattgatattgctttgtggnaagtcgagaccaccaagtactactgcactgtcattgatgcccctggacaccgtgacttcatcaggaatatgattactggcacttcccaagctggatgggctgttcttatcattgactcccttacgggggttttggaggtgggatcccccaaggatggacgaaaccggaggatggtttcttggttttccccttgggaaggaacaaaatattttttttgtccacaaaaggggtgccccccccc

SEQ ID NO: 11491 - protein, 158 aa, Zea mays
  misc_feature: Ceres CLONE 1362361-F
  misc_feature (5)..(153): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (79)..(79): Xaa is any aa, unknown, or other
MGKEKTHINIVVIGHVDSGKSTTTGHLIYKLGGIDKRVIERFEKEAAEMNKRSFKYAWVLDKAQAERERSITIDIALWXVETTKYYCTVIDAPGHRDFIRNMITGTSQAGWAVLIIDSLTGVLEVGSPKDGRNRRMVSWFSPWEGTKYFFCPQKGCPP

SEQ ID NO: 11492 - DNA, 707 bp, Zea mays
  misc_feature: Ceres CLONE 1362362-F
  misc_feature: Encodes the peptide sequence at SEQ ID NO. 11493
  misc_feature (417)..(417): n is a, c, t, g, unknown, or other
  misc_feature (445)..(445): n is a, c, t, g, unknown, or other
  misc_feature (446)..(446): n is a, c, t, g, unknown, or other
aagctggagctccccgcggtggcggccgctctagaactagtggatcccccgggctgcaggaattcgcacgagaccattacctagaacatcctaatcgaaaaccatcgcacgcactcctcatcttatcccccgcctcctccggtcctcccgccgctgttgctcacttctgagtcccgacgcacgagctcccaagagctagccatggcgtccaccaccctctcctccgccttcaccctcctatcccgcccctccacctccccgtgccccgccgcctcgctcccgaggtcctcccacgccgcgccccacatccgccggggccgccgcgccgtcgccgtcgcgtgcaccgccaccgagtccccccagatcctggagctcggggacgccatcgccgggctcacgctcgaggaggcccgcagnctcgtcgaccacctccaggagcggtcgnngtcacggcgggggcttcgcgccggcgccgtcgtcggggggcccgggggggggggggggccccgcccaagaggaggccccgtcaaaaaaaggggttccaccggatgtccaaaaagggcccacaaaggggggaatcccccatttaaagggggggggggggtttccaacttcggggttagggggggccaggaccttattggggggtcccccaaaaaggaaaggggggcgccttcaagggggagggggggggcccccaaaaaaac

SEQ ID NO: 11493 - protein, 168 aa, Zea mays
  misc_feature: Ceres CLONE 1362362-F
  misc_feature (72)..(72): Xaa is any aa, unknown, or other
  misc_feature (82)..(82): Xaa is any aa, unknown, or other
MASTTLSSAFTLLSRPSTSPCPAASLPRSSHAAPHIRRGRRAVAVACTATESPQILELGDAIAGLTLEEARXLVDHLQERSXSRRGLRAGAVVGGPGGGGGPRPRGGPVKKRGSTGCPKRAHKGGNPPFKGGGGVSNFGVRGGQDLIGGSPKKERGAPSRGRGGAPKK

SEQ ID NO: 11494 - DNA, 595 bp, Zea mays
  misc_feature: Ceres CLONE 1362386-F
  misc_feature: Translation starting site: 123
  misc_feature (206)..(206): n is a, c, t, g, unknown, or other
  misc_feature (226)..(226): n is a, c, t, g, unknown, or other
  misc_feature (241)..(241): n is a, c, t, g, unknown, or other
  misc_feature (246)..(246): n is a, c, t, g, unknown, or other
  misc_feature (247)..(247): n is a, c, t, g, unknown, or other
  misc_feature (256)..(256): n is a, c, t, g, unknown, or other
  misc_feature (259)..(259): n is a, c, t, g, unknown, or other
  misc_feature (263)..(263): n is a, c, t, g, unknown, or other
  misc_feature (265)..(265): n is a, c, t, g, unknown, or other
  misc_feature (266)..(266): n is a, c, t, g, unknown, or other
  misc_feature (309)..(309): n is a, c, t, g, unknown, or other
  misc_feature (319)..(319): n is a, c, t, g, unknown, or other
  misc_feature (324)..(324): n is a, c, t, g, unknown, or other
  misc_feature (329)..(329): n is a, c, t, g, unknown, or other
  misc_feature (340)..(340): n is a, c, t, g, unknown, or other
  misc_feature (350)..(350): n is a, c, t, g, unknown, or other
  misc_feature (351)..(351): n is a, c, t, g, unknown, or other
  misc_feature (369)..(369): n is a, c, t, g, unknown, or other
  misc_feature (386)..(386): n is a, c, t, g, unknown, or other
  misc_feature (387)..(387): n is a, c, t, g, unknown, or other
  misc_feature (416)..(416): n is a, c, t, g, unknown, or other
  misc_feature (430)..(430): n is a, c, t, g, unknown, or other
  misc_feature (431)..(431): n is a, c, t, g, unknown, or other
  misc_feature (435)..(435): n is a, c, t, g, unknown, or other
aaagctggagctccccgcggtggcggccgctctagaactagtggatcccccgggctgcaggaattcgcacgagaccattacctagaacatcctaatcgaaaaattcgtccatcccacctaccatggccaccgcctccggcactgacgccggtgcccagccgcgcgacgaccccagcctcctccccttcgcgtccttctcgctcggnctctccatccgcgcggcggncacccccacactcgncttcnngtccctcanccntcancnntcccatcaatctctacactcggcgtctgggctcaacccctcgncggggaagcntcctnccggncggacaaccgncttaatttcnngcaactcttcgtcatcgncccgttgcccctctaanngccgggctcttccgtcctttccctcgggngcggccgccgcaannaggncgccgcgcaagttctggtgggttccgggcgacttccgctcacgaacatgagccgttcacgcgcaggggggggggggggctcctcctcccccgtttcgctttgatacccggggaatcggagccccccccggggtttaacggggaaggcccgaacgggcatt

SEQ ID NO: 11495 - DNA, 634 bp, Zea mays
  misc_feature: Ceres CLONE 1362394-F
  misc_feature: Encodes the peptide sequence at SEQ ID NO. 11496
  misc_feature (442)..(442): n is a, c, t, g, unknown, or other
  misc_feature (452)..(452): n is a, c, t, g, unknown, or other
  misc_feature (555)..(555): n is a, c, t, g, unknown, or other
  misc_feature (562)..(562): n is a, c, t, g, unknown, or other
tggcggccgctctagaactagtggatcccccgggctgcaggaattcgcacgagaccattacctagaacatcctaatcgaaaaacgtaaggacaaacgcgaacggaaccctccccagcagatgagcggagtaggtgggcggggttctcttccactcccgctccagctttctctggcccgatcgatgctacattcccgcggcgagccgctcgccttcctccgcgggccttgggctacccaacccatcgccgagccgcctcgcgcggtcccccctccatctttgcccggctctctcgcctcggaggacggacagagaaagagaggatgagaagggactcctcgacccgcgtcccgcgctcgggctattggaccgaggggttgcggtggatttggagcgcggagtggactcgtcgctgatggtattctccgatgcaagaggcaggnagagagcggnacagggcggcggcggcggcggatctcggaggcgtcgccgctagcgtcaggccaacggatacagcagctgtaagcacaaagccggcaaagcgatacccactggncctatgnataggcatattgggcctggatataaagggaaggggagaggccttgtcatgatcccagttattccagacacag

SEQ ID NO: 11496 - protein, 61 aa, Zea mays
  misc_feature: Ceres CLONE 1362394-F
  misc_feature (9)..(9): Xaa is any aa, unknown, or other
  misc_feature (43)..(43): Xaa is any aa, unknown, or other
  misc_feature (45)..(45): Xaa is any aa, unknown, or other
MQEAGRERXRAAAAADLGGVAASVRPTDTAAVSTKPAKRYPLXLXIGILGLDIKGRGEALS

SEQ ID NO: 11497 - DNA, 651 bp, Zea mays
  misc_feature: Ceres CLONE 1362395-F
  misc_feature (449)..(449): n is a, c, t, g, unknown, or other
  misc_feature (483)..(483): n is a, c, t, g, unknown, or other
  misc_feature (513)..(513): n is a, c, t, g, unknown, or other
aaagctggagctccccgcggtggcggccgctctagaatagtggatcccccgggctgcaggaattcgcacgagaccattacctagaacatcctaatcgaaaaagatctgctatgagctcagctcagttcacacaaaaatcacaagctagcagtccacgtgtgcagctcgaactaatggcgacgaacctggccctcttcaccgagtggccttgcaacaatctcggccacttcaagtacctgctgctggagccgcgcgagccacacggtgcttacgaagcggggaccaacgcccgcaggcgggctgactctgcggcaagtgggcatcctcccgtccgtgctccatagggcgctgaccaccatgggtgtattcccgagtaccgcctgcaatggcgcgaaggacggcggaaactcctgcacgcttcatccacttcaaggaggtcgcacgcgagncgcaactggtgactaccagatgctgtctcagcgngatcctccctgtacctgtgtcactaaacangtggccgggggggcagaaaattgggcccctgttgggcgcaacgaaattttttcctcgatcatccaccctgattgcaacgccaccccccgtggagtttggccatattactggtttgacgcgcgtggctagggcgaacat

SEQ ID NO: 11498 - DNA, 840 bp, Zea mays
  misc_feature: Ceres CLONE 1362395-R
ggggaccgggccccccctcgaggtcgacggtatcgataagcttttttttttttttttttaatttttttttttttttttttttttttttttttttttttttttttttttttacggtattaattttggcacaacattagcatttttgcgttcttacccacagggaaatatatggaatcttttccttcccatttaaaacatgcacacgggaaggaagcaatgctatgcttctttttgcaaaaccccgaccacatccatgctgttttggcatgctgctgcttctgtagcttctgcatcactaaatgtctctgaaaaacatgaaaatgtctccagaacagcctttccagcttcaaatctcgctctcctctcaacagcctctcgcaccctctgggcaaactcttcatcaaaaccagtcagcatgtaacgcaacttcatgttgatcctgttcaccaccaaagttcggggccgaagctctatcctgtcctccagggagtaactgaagaaccttggaaactaaatgagatctttcaggggccgcaccattacacgcctcaagtactggtattttggtctcaggatatccacattgtacctgagaaacgttgggaagtcggcaatcatctgacccagcacaaagtggtagatgcccagcgaccggaagtacttgacactaacttctagcttatgtgcgatactacagcccaagagctgtggatccaaagcgataacctttccgatgtcatcctgttttactccacctttcgtcagcaaggatataaccactgggcgtattttcttgtacaagctataagttaatacacgaggaaacttcccaagcacata

SEQ ID NO: 11499 - DNA, 629 bp, Zea mays
  misc_feature: Ceres CLONE 1362413-F
  misc_feature: Encodes the peptide sequence at SEQ ID NO. 11500
  misc_feature (444)..(444): n is a, c, t, g, unknown, or other
tggagctccccgcggtggcggccgctctagaactagtggatcccccgggctgcaggaattcgcacgagaccattacctagaacatcctaatcaaaaagaggcaaagccgttagccaatctgctgttgcgtgttgcaccgatcaacgtcggttcccagcgcttgctcgtcaagcgtgtcctgctgctgttctctgctcctgcttgccgcgagagctcctctcgctcatctacccaaggtccgacagcaacgacttcgtcgagctgctatgggagaacggccaggcggtggtgcacgggaggaggaagcagcatccccaggccgccttcccgcccttcacctgcggcgcggccagcagcagtagagctcaagaaaaccagccgggtactaccgacccggtctcgctggtcaagacgggaggcctctttcgcgacttctcgtccggnctagacgccgcccgtggcaacgtggaccttgacgacaccgtgccctggattcactgccccatcgtccaggaaaaaagggccgaacccgacctggcctttgggaggggttaaagccccaaattttttccccgaagcccctgggaagggggtttaacaaggggggggggaaaaaaaaaaaccctccc

SEQ ID NO: 11500 - protein, 31 aa, Zea mays
  misc_feature: Ceres CLONE 1362413-F
MGERPGGGAREEEAASPGRLPALHLRRGQQQ

SEQ ID NO: 11501 - DNA, 648 bp, Zea mays
  misc_feature: Ceres CLONE 1362417-F
  misc_feature: Encodes the peptide sequence at SEQ ID NO. 11502
tcaccgcggtggcggccgctctagaactagtggatcccccgggctgcaggaattcgcacgagaccattacctagaacatcctaatcgaaaagagctctctctcacgtcgatccctctctctcatctcgttctttagcatggtacggctggagcggccactcctccactccagcccgagcccatgccgcgccgcgcgcgccgatttgtagacccaacgatgcgccgcccagcccagcgcgtcctccggccgtgaggcgtgagaggatctgctgttcctcgggctgagcgccacgctcagactcctctggaggaggctgagaaaacaacgctcctccttcaagatcctggtgtacgagattgtattccggctgattaatcggcggagacaaagcgtctgatgcggctgctcgagcatgacgcacgaggaggctgcgtagggcaacgaaaccaggaggtacatgaatctaaacctgtatctcggcctccctccattgccgctgtctccagtctgtgtggacccgacgttgatgcccaacttgaccggtgctgcgccagaatcctcaataactggtgagcctgaggaatcgttggacctggatggcggcagcctattctccgtcgaatgcactttccaccccggaggagcat

SEQ ID NO: 11502 - protein, 63 aa, Zea mays
  misc_feature: Ceres CLONE 1362417-F
MNLNLYLGLPPLPLSPVCVDPTLMPNLTGAAPESSITGEPEESLDLDGGSLFSVECTFHPGGA

SEQ ID NO: 11503 - DNA, 743 bp, Zea mays
  misc_feature: Ceres CLONE 1362418-R
  misc_feature (722)..(722): n is a, c, t, g, unknown, or other
cgattgggtaccgggccccccctcgaggtcgacggtatcgataagcttttttttttttttttttgcgaatgaataattgatggatcgagtccattcatctttattcgtccacaattagctcagacatggtctgcttccacaagatgtgttattgaggactgagacgaaatatcagctgcccgactgcccgggacaaataaaacgaagtagaggctgttttctgtcacagatcgacatgctgatatatgctgtccacgagtgcaagggcaagggcacccaccgagatacttggagtaccgagcttagggaaccaacgaaccgaagtatggctgattcctatacagatgacagtgtctgatactgtatactgccggtatagatgccacccaaccgtgcctctgctacttagctgctgttgggaggcaagactacacattgccaggaaagtttaacttgatacatcattatatagctgctgccaattgtcttcaccacatatagtcatatacaggacctaaaccatgttaacagcagctgcctgtggcggcgacagcttctggagccttctgcttgaagatgttcttcctgctgacccctgctgagcgagcatgagccaggaggcttgacgtgtctaagatctttagaaccacgtcgtcagacactgttctacgattacttatgttttcgcactgcatgctacacacaaacaaccgtatccctgnccaatgcattcccctcttttt

SEQ ID NO: 11504 - DNA, 601 bp, Zea mays
  misc_feature: Ceres CLONE 1362418-F
  misc_feature: Encodes the peptide sequence at SEQ ID NO. 11505
tggagctccccgcggtggcggccgctctagaactagtggatcccccgggctgcaggaattcgcacgagaccattacctagaacatcctaatcgaaaaaatgaccattgcgtgatagatcgcaccggtctcggtctccgtgtctcactctcaagttgcagcagccagtcttttcgttggcaaccagggcagaaataaatatccgtggataagagctgcgctgtgtgctgctgagatatcaagaacggtagggtggaagacaaggccccgttctcgattaacccaagccaaagagtcagagggagagagagagagagagtcgtattggtcgtcacctgtcgaaggttttcggtgtctcctgagccacagctgctgctgctgctggaaccatggagatggaggccgtggagtcgcacggcggcgccggtcgccggacgccaagagggatcgcggaatctcctgggcctgcgtcttcatcctggcgagtaactgcttccagttcatcggctacttcggcgggtcaaagaacctggggaactacctcaaggaccgcccggctccggggaagaaaagccgcccggaagggggtcacaaaggggttgg

SEQ ID NO: 11505 - protein, 71 aa, Zea mays
  misc_feature: Ceres CLONE 1362418-F
MEMEAVESHGGAGRRTPRGIAESPGPASSSWRVTASSSSATSAGQRTWGTTSRTARLRGRKAARKGVTKGL

SEQ ID NO: 11506 - DNA, 692 bp, Zea mays
  misc_feature: Ceres CLONE 1362425-F
  misc_feature: Encodes the peptide sequence at SEQ ID NO. 11507
ggagctccccgcggtggcggccgctctagaactagtggatcccccgggctgcaggaattcgcacgagaccattacctagaacatcctaatcgaaaacttccattcacccgcagctcccatcctctcgctcgccaggagaagcagccgccgttgctgctgccgcgtccacagaatggggggtttcgtgaagacccataagaccaatgcgtatttcaaacgtttccaagtgaaattcaagagaaggcggtctggcaagacagactacagggccaggataaggctgattaaccaagacgaaaacaagtaccacactcccaaatacagatttgttgtgcgattttacaacaaggacatcactgcacaaatcatatctgctaggaatagcggcggatatggttcttgcttctgcctactcccatgaattgccacaaaattggcttggaagtgtggctgaaccaattgggggttggcaaatgggcttgggctttcggtgggccccccgggggttaaaatccccgggttgggaaaaggaaattagggccaattgttgggccccgggggaggagcttttcttgggagccccttggggaaagagggcgcctttccgggtctctttgggagggggggcccttttgggaacccccccggggaaccctgtgtttttggccccccaagaggggtttttgtggggg

SEQ ID NO: 11507 - protein, 82 aa, Zea mays
  misc_feature: Ceres CLONE 1362425-F
MGGFVKTHKTNAYFKRFQVKFKRRRSGKTDYRARIRLINQDENKYHTPKYRFVVRFYNKDITAQIISARNSGGYGSCFCLLP

SEQ ID NO: 11508 - DNA, 668 bp, Zea mays
  misc_feature: Ceres CLONE 1362426-F
  misc_feature: Encodes the peptide sequence at SEQ ID NO. 11509
  misc_feature (340)..(340): n is a, c, t, g, unknown, or other
  misc_feature (356)..(356): n is a, c, t, g, unknown, or other
  misc_feature (359)..(359): n is a, c, t, g, unknown, or other
  misc_feature (363)..(363): n is a, c, t, g, unknown, or other
  misc_feature (428)..(428): n is a, c, t, g, unknown, or other
  misc_feature (430)..(430): n is a, c, t, g, unknown, or other
  misc_feature (501)..(501): n is a, c, t, g, unknown, or other
  misc_feature (509)..(509): n is a, c, t, g, unknown, or other
  misc_feature (514)..(514): n is a, c, t, g, unknown, or other
tggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagnctttcatgtgctcggncgnacgntgttgtcccgtccggcgctctgcccgcccagctgtgctgtgcgccagctgctgcttccctacggngnttccagtcccgaacggaaaagtgcaggggtttgccctgcgccaggatctccaccgcttggccgagggttanggattttngttgncaggggccggggcggtgcaatcctaaggttggggggcctcaaccaaaacccgaaaaggggggtctttgaaattgtacaggcccggtccaccccggggggccggggttccaaaccggcccgcccttagaccccccccgccccaaccggccaaatt

SEQ ID NO: 11509 - protein, 94 aa, Zea mays
  misc_feature: Ceres CLONE 1362426-F
  misc_feature (14)..(14): Xaa is any aa, unknown, or other
  misc_feature (20)..(20): Xaa is any aa, unknown, or other
  misc_feature (21)..(21): Xaa is any aa, unknown, or other
  misc_feature (22)..(22): Xaa is any aa, unknown, or other
  misc_feature (44)..(44): Xaa is any aa, unknown, or other
  misc_feature (68)..(68): Xaa is any aa, unknown, or other
  misc_feature (71)..(71): Xaa is any aa, unknown, or other
  misc_feature (72)..(72): Xaa is any aa, unknown, or other
MLLTSCRQGRGMAXLSCARXXXVVPSGALPAQLCCAPAAASLRXFQSRTEKCRGLPCARISTAWPRVXDFXXQGPGRCNPKVGGPQPKPEKGGL

SEQ ID NO: 11510 - DNA, 640 bp, Zea mays
  misc_feature: Ceres CLONE 1362486-F
  misc_feature: Encodes the peptide sequence at SEQ ID NO. 11511
  misc_feature (322)..(322): n is a, c, t, g, unknown, or other
  misc_feature (328)..(328): n is a, c, t, g, unknown, or other
  misc_feature (412)..(412): n is a, c, t, g, unknown, or other
  misc_feature (436)..(436): n is a, c, t, g, unknown, or other
  misc_feature (478)..(478): n is a, c, t, g, unknown, or other
ctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacagcggcgcccacgccacctacgggcagcagcagcagcagggaggaggcgggcgcccgatgggtgagcaggtgaagggcatgctccacgacnaggggncgacagcgtcccaagcgctgaccgtggcgacgctgctcccgcttggcgggctgctgctggtgctgtccgggctggcgctgacgnctccgtggggggggctggccgggncaccccccggggtcctgatcttcggccccgtggtgtccccgncgcgctgctcatcgggaggccggcaatggggtcctcaacgctggcgcgcttgggggttccgggggcctttccccccttcacaggggccgccaaaacggggggggggggggtttcagagcacccggggtaaaatggggggagggggaacccaggaatgggggg

SEQ ID NO: 11511 - protein, 146 aa, Zea mays
  misc_feature: Ceres CLONE 1362486-F
  misc_feature (41)..(41): Xaa is any aa, unknown, or other
  misc_feature (43)..(43): Xaa is any aa, unknown, or other
  misc_feature (71)..(71): Xaa is any aa, unknown, or other
  misc_feature (79)..(79): Xaa is any aa, unknown, or other
  misc_feature (93)..(93): Xaa is any aa, unknown, or other
MADRDRSGIYSGAHATYGQQQQQGGGGRPMGEQVKGMLHDXGXTASQALTVATLLPLGGLLLVLSGLALTXPWGGLAGXPPGVLIFGPVVSPXRCSSGGRQWGPQRWRAWGFRGPFPPSQGPPKRGGGGFQSTRGKMGGGGTQEWG

SEQ ID NO: 11512 - DNA, 648 bp, Zea mays
  misc_feature: Ceres CLONE 1362571-F
  misc_feature: Encodes the peptide sequence at SEQ ID NO. 11513
  misc_feature (361)..(361): n is a, c, t, g, unknown, or other
  misc_feature (600)..(600): n is a, c, t, g, unknown, or other
tggagctccccgcggtggcggccgctctagaactagtggatcccccgggctgcaggaattcgcacgagaccattacctagaacatcctaatcgaaaaaccgatgcgcaacccacgcctcagaacccaaggcccggtccgatcccagggggcccccatgatgccacagacgagcttcgtctgatccggttgctggtcgagccccgaccctcgctggcgcgcttccatctaggtgctcaacgaggagaccatctaccaccctcgcaagtgccaacactgctaggatgcccgtatcatggatgagatccctcaacctgccgcctcaggcttttgtactgatatgttcggcaggtataggagatngtcatgatcttgaggacttatcaatgcaggcgaactgtttgataaaatagcccgatatgacaacctacgtgagaatgaagccaggatacatttccagcagcttattgatgccattgcatattgccacagcacaggagtttatcataggtatttgcagcctggacatatgcttcttgactcacgtgcaaacttaaaagtttctgatcttggacttatacactggtctcaaagtgcagcangacttcttcacacaacatgtgggacaccaaattatgcttgctgctgag

SEQ ID NO: 11513 - protein, 39 aa, Zea mays
  misc_feature: Ceres CLONE 1362571-F
  misc_feature: SWISSPROT Homolog: EC 2.7.11.1 Non-specific serine/threonine protein kinase
  misc_feature (25)..(25): Xaa is any aa, unknown, or other
MLLDSRANLKVSDLGLIHWSQSAAXLLHTTCGTPNYACC

SEQ ID NO: 11514 - DNA, 661 bp, Zea mays
  misc_feature: Ceres CLONE 1362581-F
  misc_feature: Encodes the peptide sequence at SEQ ID NO. 11515
  misc_feature (589)..(589): n is a, c, t, g, unknown, or other
  misc_feature (661)..(661): n is a, c, t, g, unknown, or other
tggagctccccgcggtggcggccgctctagaactagtggatcccccgggctgcaggaattcgcacgagaccattacctagaacatcctaatcgaaaaatcgagctgtcccctccctgtgctcttgcgccttgctagcttgcttgcttccctgctccctccctcctcttcctcgtcgcctcttctctggttcttcctggtgtttgccggagcgaggctaggcgcaaggggagggagctgcggtcagccagagctcatcggcgctacgcaagcgcgctgcctggtgtgctgcactgccgaactatcaggggaaaacactgaaataatggaaatcagcttattgcataatgaatctgatgcaggaagcaccagtttgctaccgctgccattgttgtcatatggtccaagatcaatggttccaatacaagtaccaccatcatcagactttgagagtatcctgtcaccagagccaatctacagtgatcttcagttgaaagagatgaactacaatgcagcagcaatggatgaaaagcactgagttccttcacttgattcttagtggcaatgatgaaggatacaatagcacactgnattacaagtttttgggaattggtgggggactcctatgtctcagaaaacttttctgtcccactttgaaaaggn

SEQ ID NO: 11515 - protein, 70 aa, Zea mays
  misc_feature: Ceres CLONE 1362581-F
MEISLLHNESDAGSTSLLPLPLLSYGPRSMVPIQVPPSSDFESILSPEPIYSDLQLKEMNYNAAAMDEKH

SEQ ID NO: 11516 - DNA, 642 bp, Zea mays
  misc_feature: Ceres CLONE 1362585-F
  misc_feature: Translation starting site: 228
  misc_feature: Pfam Name: Rep-A_N Pfam Description: Replication factor-A protein 1, N-terminal domain
  misc_feature (575)..(575): n is a, c, t, g, unknown, or other
aaagctggagctccccgcggtggcggccgctctagaactagtggatcccccgggctgcaggaattcgcacgagaccattacctagaacatcctaatcgaaaaaggtcgacgcatcttcgcctccgctcaacgctcgcccacgcccgccgcccccccaccgatccacgagaaaccttctcgcctccgcgggacgattcgccagggagagcaaaggtagcagaggcgccatggacgctgccaagtcggtgacgccgggcgccgtgtcctacatcctggcgcacccgtctacgggctccaatggcgccgtgtcggatctcgtcgttcaggtcctcgatctcaagtccatcggcatggggcagccggttcagtttcacggcaaccgatgggaacgacaaaatcaaggcgatgctccccacttactgtggcgtcggaggtccactccggcaatctgaaaagaatttcggtctcatccgcatcctcgactacacttggcactccgtcaaagggcacgctgacaaaagtcctgattgtcgtcaaatgcgagactgtgtgcgaagcgctcgacgccgagatcnacggcgagccaaagaaagagatcctccaattgtgctgaagcctaagacgaaggctcagtcgtggctg

SEQ ID NO: 11517 - DNA, 658 bp, Zea mays
  misc_feature: Ceres CLONE 1362587-F
  misc_feature: Encodes the peptide sequence at SEQ ID NO. 11518
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaaaccattcgaaagatccctccaggaaagatttttcttccctcctccgacgccccagcccaccaacacactctataaagcagccccccagtcacacacagaacgcacaagcgcaagcagggcaagaaaactccgcaggccagtctgcgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacgcaccttctgggctgcccgtgcgtgatgctggcgagccggaaaggcggcgcggttcgtgctgggtgacgcaggcgcacctgttcaagccgacctacccgcggagcaggagcgcatggattcgggccgtcggctctcttcttccancagggcgactaccac

SEQ ID NO: 11518 - protein, 102 aa, Zea mays
  misc_feature: Ceres CLONE 1362587-F
  misc_feature: SWISSPROT Homolog: EC 1.14.13.93 (+)-abscisic acid 8'-hydroxylase
MAFFLALVCILVLLAIASYVQYTRWQKGKGRFGGHGRSAPLKLPPGSMGWPYLGETLQLYSQDPSVFFASKQKRYGEIFKTHLLGCPCVMLASRKGGAVRAG

SEQ ID NO: 11519 - DNA, 649 bp, Zea mays
  misc_feature: Ceres CLONE 1362589-F
  misc_feature: Encodes the peptide sequence at SEQ ID NO. 11520
  misc_feature (305)..(305): n is a, c, t, g, unknown, or other
  misc_feature (421)..(421): n is a, c, t, g, unknown, or other
  misc_feature (519)..(519): n is a, c, t, g, unknown, or other
  misc_feature (535)..(535): n is a, c, t, g, unknown, or other
  misc_feature (536)..(536): n is a, c, t, g, unknown, or other
  misc_feature (596)..(596): n is a, c, t, g, unknown, or other
  misc_feature (605)..(605): n is a, c, t, g, unknown, or other
  misc_feature (606)..(606): n is a, c, t, g, unknown, or other
aagctggagctccccgcggtggcggccgctctagaactagtggatcccccgggctgcaggaattcgcacgagaccattacctagaacatcctaatcgaaaaacttctcgttctcgccgatccagtgccactacactacaatactgctgcgcgctagcggtagcgctcgcgctcccactcgcaccacagcacgccaccgctgctgccggctcctccccgcgctcgcattgcgatttgcgacctagcgcgagggtaccgggggtggtgcgcgtgctccgtgatccgggaagcgccgcgagatggcgngggcggaaagcggcggtgccgcgccgaagcacgacgacttcacgccgcaccccgtcaaggacccagctccctggggtctcctactgcatcaccagccctcccccgtggcctggagncgtttcttcttgggttccaacattatctggtcatgcttggtaccactgtgatcataccaactgcacttgttccacaaatgggaggaacaatggggacnaaagcagtggtatcannacattggctggttcgtgcaggtatcaacaccctcctgcagagtttctttggtaccatggntgcctgcanntgatcggcggtcaatacacctttggtctgcctaccatttcatc

SEQ ID NO: 11520 - protein, 50 aa, Zea mays
  misc_feature: Ceres CLONE 1362589-F
  misc_feature (28)..(28): Xaa is any aa, unknown, or other
  misc_feature (48)..(48): Xaa is any aa, unknown, or other
MLGTTVIIPTALVPQMGGTMGTKAVVSXHWLVRAGINTLLQSFFGTMXAC

SEQ ID NO: 11521 - DNA, 698 bp, Zea mays
  misc_feature: Ceres CLONE 1362596-R
  misc_feature (110)..(110): n is a, c, t, g, unknown, or other
  misc_feature (698)..(698): n is a, c, t, g, unknown, or other
agtttgtggcgttgaattatagacaagatataaaaagttagaaatggaagttggtagatgaagctattataattaaataaatacgtgacggtggcgctggtgggtgtttntcgttgttcgaaatggggtaccgggccccccctcgaagtcgacggtatcgataagcttttttttttttttttttgatttttcaagtagccactctaatattctgctagttcagagattacaggtatatcactcctttaatcaggagaacaaaaaaaagagagactggagatccccataagtagtaatctccatcaaaggaactcttcttataaggatactaaccctggaaacccctttaaaaccccccaaaataactgaatgacccaagggggtgaaaaagcttaaaaccaagggaacccgtggcccttccatccccctttggggggtgaagcccctcccccccccaaaggggaaatggggggccccagggggtgggccccccctcgggcccgaaaaccctcaatttgccccccccgggggcgcgggtaagccctttttttcccaaaaaaagtgaaggaggggctcctccaaaaacccccttcttaaaaaatgtggcccccaaaagggggggggccccccccgggaggggggggggaggatttcttccggcgctttgtaaaaggggcgtttttaatctctcccccccn

SEQ ID NO: 11522 - DNA, 626 bp, Zea mays
  misc_feature: Ceres CLONE 1362597-F
  misc_feature: Pfam Name: Glyco_hydro_9 Pfam Description: Glycosyl hydrolase family 9
  misc_feature: SWISSPROT Homolog: EC 3.2.1.4 Cellulase
  misc_feature (224)..(224): n is a, c, t, g, unknown, or other
  misc_feature (284)..(284): n is a, c, t, g, unknown, or other
aaagctggagctccccgcggtggcggccgctctagaactagtggatcccccgggctgcaggaattcgcacgagaccattacctagaacatcctaatcgaaaaagtttcgacagtcgtcgtcccctctactctcccggcttccgcagaatcccagcttctctggccctctcactccaaacatcgggcttcaggccgtctcccgccaacccaaattcgcttcccgncgctccccattaaacccgcttgaaaggtcgcgccctcgagcagagcaacccctggacacnaatccgatcccgtagcggcgtggctcgatttcgtctcttcccctctgctcgagtacgagcggctactccccgggggcgcggcggcgggcgccattaacgcggtgagctcgacatatccaagagctggatcaggggggaacagatacattctcaaaaccttcaatcatctgctgacacgataaacaaggatgtccctcaagtgggtggtagggacaactcttaaaggggcaatcagcctaatgggcactactggtgggagagaacacagggcatctactacaaaagggccggtcccgagtgggcctcttgtgccaaaattaaagcttgaaaaggctgctgccc

SEQ ID NO: 11523 - DNA, 665 bp, Zea mays
  misc_feature: Ceres CLONE 1362600-F
  misc_feature (355)..(355): n is a, c, t, g, unknown, or other
  misc_feature (356)..(356): n is a, c, t, g, unknown, or other
  misc_feature (364)..(364): n is a, c, t, g, unknown, or other
  misc_feature (365)..(365): n is a, c, t, g, unknown, or other
  misc_feature (368)..(368): n is a, c, t, g, unknown, or other
  misc_feature (369)..(369): n is a, c, t, g, unknown, or other
  misc_feature (426)..(426): n is a, c, t, g, unknown, or other
  misc_feature (443)..(443): n is a, c, t, g, unknown, or other
  misc_feature (451)..(451): n is a, c, t, g, unknown, or other
aaagctggagctccccgcggtggcggccgctctagaactagtggatcccccgggctgcaggaattcgcacgagaccattacctagaacatcctaatcgaaaagaaaacggaagttaccaattcacccgactcgatagacacaccggctctgctctaagcgagaatccgaggagcgctgccaagcgcctccgcgacgggatcgacgcgacttgattcgcgagtttcaacgtcgcgaggagagcagaaaattacgcaggcagagcggctgccggctgggtgttgaagctagagcggctaggagcaggttcggagcgctaccaaacaggcccttaacctaagcgctcctgcccttcgnnatcggaanntgnnagcgcgcgaggaggcgaggctttgcaggtctccttgctaaacggcaacgggttgacnatggcgcccgaccgtgncgccccgnatccgccacccaggggttccaacctcggaggaaaaccccggggttaatgtttattacatgaaaggccctggttgggcccgggagcctaaaaaaaaaatggggggcaccttgccggactttattggggggttttgggggggggggcctttccgccccggggaattttttttcgcggcgaaaaaaggtcccccccgtgggtgagggccccgcgggc

SEQ ID NO: 11524 - DNA, 654 bp, Zea mays
  misc_feature: Ceres CLONE 1362603-F
  misc_feature: Translation starting site: 166
  misc_feature (533)..(533): n is a, c, t, g, unknown, or other
  misc_feature (547)..(547): n is a, c, t, g, unknown, or other
  misc_feature (569)..(569): n is a, c, t, g, unknown, or other
  misc_feature (596)..(596): n is a, c, t, g, unknown, or other
  misc_feature (597)..(597): n is a, c, t, g, unknown, or other
  misc_feature (602)..(602): n is a, c, t, g, unknown, or other
  misc_feature (603)..(603): n is a, c, t, g, unknown, or other
  misc_feature (612)..(612): n is a, c, t, g, unknown, or other
tggagctccccgcggtggcggccgctctagaactagtggatcccccgggctgcaggaattcgcacgagaccattacctagaacatcctaatcgaaaaaatccactccactccatcatcccgtgcctcacgagtcacgagtcactccaggtccaggctgagcagcaatggcgccgcgaacgctcggcttcaacgcggccccgctcctccagattctgcggtccctgtgcctcctggccctcgccgcggcggcggcggtgtccggtcggcgccacggggcctccccggcgcgcggcagcgggcagagcatgtacctggcgccggcctgccgggcgcacacggcgtcggtggcggacttcggcggcgtgggcgacggcaccacttccaacaccgcggcgttccggtccgcggtggaccacctgtcgcagtactcgggcgagggcggcggcggtggcatgctgtacgtgccctgagcaagtggctgacgtgccccttcaactggacagccacttcaccctctacctccaccaagacngcgtcatcctcggntcccaggacgtaggcgagtggncaatcgtggatccctggcttcttacgnnaaggnnaggacaggncccggagggaggtcgctagcctcatcggggatcgaactggac

SEQ ID NO: 11525 - DNA, 674 bp, Zea mays
  misc_feature: Ceres CLONE 1362610-F
  misc_feature: Encodes the peptide sequence at SEQ ID NO. 11526
  misc_feature (403)..(403): n is a, c, t, g, unknown, or other
  misc_feature (404)..(404): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (567)..(567): n is a, c, t, g, unknown, or other
  misc_feature (568)..(568): n is a, c, t, g, unknown, or other
  misc_feature (571)..(571): n is a, c, t, g, unknown, or other
  misc_feature (600)..(600): n is a, c, t, g, unknown, or other
aaagctggagctccccgcggtggcggccgctctagaactagtggatcccccgggctgcaggaattcgcacgagaccattacctagaacatcctaatcgaaaaacctttgccgctccgcatccgaagccaccgagccgctacccgtcgcagccgccgcgaaatggccgccggcgcgcgccccctggtctccgtgagggccctggagggcgacatggccacggactccgtcggtgtcccgcttccggacgtcctccgcgcgccgatccgcccagacatcgtccgcttcgtccacaagctcctgtcctgcaacagccggcagccgtacgcggtgtcgcgtcgcgctggccaccagacctccgcggagtcctggggcacggggcgtgcggtgtcccgtatccccgcnntccctgggcggtggtacccaccgcgccggccagggagccttcggcaacatgttgccgtggcggacgcatgtttgcgcccaccaagatcttggcgccgctggcaccgccgcgtcacatccaccctcccgccggtgtgggcatcgcctccgccctcgnnnngcanncgncgtccccgtccctcgtcctcgccgggggncacccggggggtggagtctggtccccgagctttcggcttcgtcgtttcccgactccgccgagttccaattgaga

SEQ ID NO: 11526 - protein, 171 aa, Zea mays
  misc_feature: Ceres CLONE 1362610-F
  misc_feature (82)..(82): Xaa is any aa, unknown, or other
  misc_feature (134)..(134): Xaa is any aa, unknown, or other
  misc_feature (135)..(135): Xaa is any aa, unknown, or other
  misc_feature (136)..(136): Xaa is any aa, unknown, or other
  misc_feature (147)..(147): Xaa is any aa, unknown, or other
MAAGARPLVSVRALEGDMATDSVGVPLPDVLRAPIRPDIVRFVHKLLSCNSRQPYAVSRRAGHQTSAESWGTGRAVSRIPAXPGRWYPPRRPGSLRQHVAVADACLRPPRSWRRWHRRVTSTLPPVWASPPPSXXXRRPRPSSSPGXTRGVESGPRAFGFVVSRLRRVPIE

SEQ ID NO: 11527 - DNA, 646 bp, Zea mays
  misc_feature: Ceres CLONE 1362618-F
  misc_feature: Encodes the peptide sequence at SEQ ID NO. 11528
  misc_feature (408)..(408): n is a, c, t, g, unknown, or other
aaagctggagctccccgcggtggcggccgctctagaactagtggatcccccgggctgcaggaattcgcacgagaccattacctagaacatcctaatcgaaaaaaactaccgaagtctacttccattccttcctttctcctttcatatacccgcgtcgcccacgagcccgccgtgccgacagaggtgtggacctcgccggagcagaggctatggggccaccgcagccagccaggcccggcgtcatcaacatcgaggcctgcgcgcggccgatcgccgtcgaccaccgcatcagccttccctactacttccgcatcgcgggcagcctcctccgacaggctaatatatatcggaacgagagtaacttcctcgacctatatgtcatccttctgagatactcgagctggctgntgggaaacattccgaggcatcgtgattaccatggcctccagtaaaaaaaaaggcattttttgaaaaactggtgagggtatccaaaaactggaaatttggaacccgttggggcgggggaattgccatttataaaaagagggggcgcgggggaacttattaggaaaaccccaaggggcaacggggccccccccaggggagaaggcggaatccccggtttttaatccccccccccttgtgg

SEQ ID NO: 11528 - protein, 80 aa, Zea mays
  misc_feature: Ceres CLONE 1362618-F
  misc_feature: SWISSPROT Homolog: EC 3.1.2.15 Ubiquitin thiolesterase
  misc_feature (67)..(67): Xaa is any aa, unknown, or other
MGPPQPARPGVINIEACARPIAVDHRISLPYYFRIAGSLLRQANIYRNESNFLDLYVILLRYSSWLXGNIPRHRDYHGLQ

SEQ ID NO: 11529 - DNA, 702 bp, Zea mays
  misc_feature: Ceres CLONE 1362619-F
  misc_feature: Encodes the peptide sequence at SEQ ID NO. 11530
aaagctggagctccccgcggtggcggccgctctagaactagtggatcccccgggctgcaggaattcgcacgagaccattacctagaacatcctaatcgaaaaatagctctgggtagggactccaccaaccctcagtaggcctcgggtgtttttgtagaacggatcacacaggaggggcgggagaagaaccaagccgccgcccatgaatccaccacacgtcgtcactaaaaccagggggttctcggggatcgtctcaggagcacgagggatctcgctggcaaccggaccatgtgcgtggcaatgtggtggcgccataatttctcgccggagtgcatggcaccgccgagggccacattgacctgcggttggagctcgccatgacacattcccggggtaagaaaggtcgaagtacaatcccgctccatctgctaactgcataagggcatgtacagcggcggtttaacggggagggtcttaaggcgcctaaggggtgtatttgcaaaaaaatcttagagccgtctctccgggaagaaacgtctctggctcccggacccaaacccaaggaggaataggacgtctccatttcctactggacgaaattgggcggccggccccaccgaatccggcggccggacccaatggccttttaaaaaaaaaaaaaaaaaaaagctttatccgattcccggtccgaccctccgaggg

SEQ ID NO: 11530 - protein, 51 aa, Zea mays
  misc_feature: Ceres CLONE 1362619-F
MNPPHVVTKTRGFSGIVSGARGISLATGPCAWQCGGAIISRRSAWHRRGPH

SEQ ID NO: 11531 - DNA, 662 bp, Zea mays
  misc_feature: Ceres CLONE 1362623-F
  misc_feature: Encodes the peptide sequence at SEQ ID NO. 11532
  misc_feature (334)..(334): n is a, c, t, g, unknown, or other
  misc_feature (424)..(424): n is a, c, t, g, unknown, or other
  misc_feature (464)..(464): n is a, c, t, g, unknown, or other
  misc_feature (509)..(509): n is a, c, t, g, unknown, or other
  misc_feature (662)..(662): n is a, c, t, g, unknown, or other
aagctggagctccccgcggtggcggccgctctagaactagtggatcccccgggctgcaggaattcgcacgagaccattacctagaacatcctaatcgaaaaccagtggcaggcgagcgagaggcggttgaggaggagcggacggaaccgtcgcctgctgcgtctgcctgcgagatctaggcgagcgcggccatgggtgctcgctgctccaagctctccgtctgctggtggcctccccacttcaaatcgccaatgctcgagaatggcgccgccggagatgatggcagcggcgtgcccgtgttcgccgagtacagcttcgacgacctccgggtggncaccgacggcttcgcccccgatcgcatcgtgtcggagcacggggagagggcacccacgtggtctacccgtggacgctcttcagctccggncgcacccgtcgcattaagcgcttcggccgctccgcctggncggactcacgccagtttcctggaggaggcgagggcttgtgggcanctgcgtaatggcaggctggccaatctgatcggttgctgctgccagagcggcaagcgtctcctcgtcgcaaagttcatgccgcacgagacctgggcaaagcatctcttccactgggagacaaatccattggagtgggcaatgaaggatggaggn

SEQ ID NO: 11532 - protein, 157 aa, Zea mays
  misc_feature: Ceres CLONE 1362623-F
  misc_feature: SWISSPROT Homolog: EC 2.7.11.1 Non-specific serine/threonine protein kinase
  misc_feature (48)..(48): Xaa is any aa, unknown, or other
  misc_feature (78)..(78): Xaa is any aa, unknown, or other
  misc_feature (106)..(106): Xaa is any aa, unknown, or other
MGARCSKLSVCWWPPHFKSPMLENGAAGDDGSGVPVFAEYSFDDLRVXTDGFAPDRIVSEHGERAPTWSTRGRSSAPXAPVALSASAAPPGRTHASFLEEARACGXLRNGRLANLIGCCCQSGKRLLVAKFMPHETWAKHLFHWETNPLEWAMKDGG

SEQ ID NO: 11533 - DNA, 663 bp, Zea mays
  misc_feature: Ceres CLONE 1362624-F
  misc_feature: Encodes the peptide sequence at SEQ ID NO. 11534
  misc_feature (514)..(514): n is a, c, t, g, unknown, or other
aaagctggagctccccgcggtggcggccgctctagaactagtggatcccccgggctgcaggaattcgcacgagaccattacctagaacatcctaatcgaaaaaaccgagacaccgcgtgcgaaccaagcagaccccagcagaagaagcgaagtcgtcgccggagcaggaggaagagcgaggagcaacatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggacttcgatgaacctggaactcttgcaccaactggtctttttgttggaggtacgaagtacatggtgatccaaggtgaacctggagttgtcatccgaggagagaagggcactggatgcattactatcaagaaaactggcatgtccttgattatcggtatctatgatgagccnatgactccaggggcatgcaatatggtgctggagaggctcggcgattacctgatcgaacagggctttctagggggtgtttggtttgagcatcactccatccaaatgtggtggtgcatcatggatccattcctcagattgggggggatgcc

SEQ ID NO: 11534 - protein, 158 aa, Zea mays
  misc_feature: Ceres CLONE 1362624-F
  misc_feature (2)..(126): Pfam Name: Profilin Pfam Description: Profilin
MSWQAYVDDHLLCDIEGQHLSAAAIVGHDGSVWAQSENFPELKPEEVAGMIKDFDEPGTLAPTGLFVGGTKYMVIQGEPGVVIRGEKGTGCITIKKTGMSLIIGIYDEPMTPGACNMVLERLGDYLIEQGFLGGVWFEHHSIQMWWCIMDPFLRLGGM

SEQ ID NO: 11535 - DNA, 688 bp, Zea mays
  misc_feature: Ceres CLONE 1362626-F
  misc_feature: Translation starting site: 222
  misc_feature: Pfam Name: Flavodoxin_1 Pfam Description: Flavodoxin
aaagctggagctccccgcggtggcggccgctctagaactagtggatcccccgggctgcaggaattcgcacgagaccattacctagaacatcctaatcgaaaaaccaagccagcaggcgctgcgatacattccacacaacaacacccagctctgccccagcccgccacaggagttcccgcatctccctctggtccggtcacaggagctccgagacctctccaatggcggttaagatctacgttgtgtactattccatgtatgggcatgttggcaaactatctgatgagatcaagacaggtgccttatctgttgaaggtgttgaggctataatatggcacgtccctgaaattctctctgaacagtgcttggaagatgggcgcgccccctaagcccgacgtgccagtcatcacaccgcatgaacttgcagagggtgacggtatcctcttttggtttcccacaaaggtccggaatgatggcaactcaaatggagggcttcttcaatgccccccgttgggctctggagggaacaaaccctccctggggaaccctgccgggatttcctttaaccctggaacccagggggggggccaaaaaaaaaaccccggtgacggggatttcccttttggccccccccccctatgggtgttttggccccggggttaaaccctttggggcccattgtttggga

SEQ ID NO: 11536 - DNA, 652 bp, Zea mays
  misc_feature: Ceres CLONE 1362631-F
  misc_feature: Encodes the peptide sequence at SEQ ID NO. 11537
  misc_feature (611)..(611): n is a, c, t, g, unknown, or other
tggagctccccgcggtggcggccgctctagaactagtggatcccccgggctgcaggaattcgcacgagaccattacctagaacatcctaaaaaaaaaaaaaggcgtaaaagccatcgccactctttccccatcccacgctgccctcggcgctgcgcctggccccggcacctacctcccccctccccacctcgccgccggcgggtggagtcgggctggagcagccgctctcctctgttaccccctaaccccctataaagaaaaagaaaaaaacagagagagagcgagcgaccggcggctcggcagccatggggcacggcgtcagctgcgcccgcaccggtgacgagcacgactacttccgcgcggcgcaggtcggggacctcgaggccctggaagcgctcctcgacgctgacccctcccttgcccgccgcgccacgctctacgaccgcctctccgcgctccacatcgccgccgcgaatgaccgcctcgaggtgctgtcaatggtcttggatcacggggtgccgccggacgtggtgaatcggcacaagcagacgccgctgatgctcgcggcgatgcacggcaagaccgactgcgtgctgaagctcctgcaggncggcgccaatatcctcatggtcgactcccagcacgggcgga

SEQ ID NO: 11537 - protein, 115 aa, Zea mays
  misc_feature: Ceres CLONE 1362631-F
  misc_feature (79)..(111): Pfam Name: Ank Pfam Description: Ankyrin repeat
  misc_feature (46)..(78): Pfam Name: Ank Pfam Description: Ankyrin repeat
  misc_feature: SWISSPROT Homolog: EC 2.7.11.1 Non-specific serine/threonine protein kinase
  misc_feature (102)..(102): Xaa is any aa, unknown, or other
MGHGVSCARTGDEHDYFRAAQVGDLEALEALLDADPSLARRATLYDRLSALHIAAANDRLEVLSMVLDHGVPPDVVNRHKQTPLMLAAMHGKTDCVLKLLQXGANILMVDSQHGR

SEQ ID NO: 11538 - DNA, 640 bp, Zea mays
  misc_feature: Ceres CLONE 1362632-F
  misc_feature: Encodes the peptide sequence at SEQ ID NO. 11539
  misc_feature (594)..(594): n is a, c, t, g, unknown, or other
  misc_feature (595)..(595): n is a, c, t, g, unknown, or other
  misc_feature (604)..(604): n is a, c, t, g, unknown, or other
  misc_feature (605)..(605): n is a, c, t, g, unknown, or other
  misc_feature (618)..(618): n is a, c, t, g, unknown, or other
tccccgcggtggcggccgctctagaactagtggatcccccgggctgcaggaattcgcacgagaccattacctagaacatcctaatcaaaaatcgctctctcctttgcacccctagctagctagtactactgctgctcctccgacttgctcttcgcgcagcaggacggagaaacaagaaccatccctccccctaccggctaccgctgctactcatggtcgcgcgcactgcctcctggtgccgccgcgtatgatccagacatgaatagggcgcacagcagcagctccaagctcatcaacgagaagctcgtggaacaccggatctccactgcgaagcactgcccccactggcgcgagaaaatcgacagcaaacccggattggtggggctgccggcaagcgtcaagttcgatccaactgaccaagagctgatcgagcacctcgaggcgaaagtgaaggatgaaggctcgagatctcaccctctcatcgacgaggtcatacccaacatagatggggaggacggcatatggtacaacccaccccgaggaacttccaagtgttgaccagggatggcctaggcaagcacttcttcccacggnncgtcaaggnnctacacgacgggncaccgaggaagaggaggaagat

SEQ ID NO: 11539 - protein, 99 aa, Zea mays
  misc_feature: Ceres CLONE 1362632-F
  misc_feature: The sequence is a functional homolog of SEQ ID NO 1710 in the 10/374,780 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 542 in the 10/666,642 US patent application
  misc_feature: The sequence is a functional homolog of SEQ ID NO 1711 in the 10/374,780 US patent application
  misc_feature: The sequence is a functional homolog of SEQ ID NO 1712 in the 10/374,780 US patent application
  misc_feature: The sequence is a functional homolog of SEQ ID NO 1713 in the 10/374,780 US patent application
  misc_feature: The sequence is a functional homolog of SEQ ID NO 210 in the 10/666,642 US patent application
MNRAHSSSSKLINEKLVEHRISTAKHCPHWREKIDSKPGLVGLPASVKFDPTDQELIEHLEAKVKDEGSRSHPLIDEVIPNIDGEDGIWYNPPRGTSKC

SEQ ID NO: 11540 - DNA, 649 bp, Zea mays
  misc_feature: Ceres CLONE 1362634-F
  misc_feature: Encodes the peptide sequence at SEQ ID NO. 11541
aaagctggagctccccgcggtggcggccgctctagaactagtggatcccccgggctgcaggaattcgcacgagaccattacctagaacatcctaatcgaaaagctcacactgctgtctccgttccatcccctacgagatctgccccctcgccctcgccctgctccaatccccatctccttgcggcccgatccaccctgctccaatcccccggcgatggtcgtgtgcaaatgccgaaaggcgacgagggtttactgcttcgtccatcaggtccccgtctgtggcgtgtgcatatgcttcccggacatcagctatgtgtggtgaagactatgctgaatggggttgtaattctgagtatgactggcccacacactggtcgtcttggcattctgttctcgagggtgaactgaagaaacacacgatgggttgcttgcatgtgggacacacaatggctgaaatccatatccaaggtttcctaccaaacgccccaaagggaacgtttgccctccggtttggaccaattggccccttctaaaataaaaaaagggttccggccttccctgaaataaaaaaccttttcccaacggggaagggaaaattgtttttgaaaatttttgggcaaaattaaggggtacccaaacccccccgttt

SEQ ID NO: 11541 - protein, 35 aa, Zea mays
  misc_feature: Ceres CLONE 1362634-F
MVVCKCRKATRVYCFVHQVPVCGVCICFPDISYVW

SEQ ID NO: 11542 - DNA, 728 bp, Zea mays
  misc_feature: Ceres CLONE 1362639-F
  misc_feature: Encodes the peptide sequence at SEQ ID NO. 11543
  misc_feature (647)..(647): n is a, c, t, g, unknown, or other
aaagctggagctccccgcggtggcggccgctctagaactagtggatcccccgggctgcaggaattcgcacgagaccattacctagaacatcctaatcaaaaaacggcagctctgaagggaaagagatcgatcgtatctgcggaacaagcagcgaaggatcggagcctatccaatggccgagggcaacagcagctccggcggcgacctgttctccagcggcaagctggtggcgggggccgccgtgtcggtgttccagcagaagagcgtggagaacgtctacaagcaggaggtcgccggcgcggcggtcgagctcctgcacgcggcgtccgcgtacggtaagctcgacgacaagccggccgggcagtacgtcgagaagggcgaggggtacttggaggagttcagcgcgtgcgcgggacacgccaccgaccaggagcagcctgcggtggaagaaggagacgacccgggacccaacccacggggcccggaaggccccagggaccccggggggggcctggccccggccggggaggaggaaaccaagccttccgaggggttccgcccccggcaacttattaaaggggccccaaaacctttggggagaggaaacaacaaatggccccctaaaaaaaaaacccccccccgccccnggttttggtttaaaagggcccccggccttcccacaaaaaaaatttggggcggccccccgttttttaccgacctcgtttttt

SEQ ID NO: 11543 - protein, 185 aa, Zea mays
  misc_feature: Ceres CLONE 1362639-F
  misc_feature (159)..(159): Xaa is any aa, unknown, or other
MAEGNSSSGGDLFSSGKLVAGAAVSVFQQKSVENVYKQEVAGAAVELLHAASAYGKLDDKPAGQYVEKGEGYLEEFSACAGHATDQEQPAVEEGDDPGPNPRGPEGPRDPGGGLAPAGEEETKPSEGFRPRQLIKGAPKPLGRGNNKWPPKKKTPPRPXFWFKRAPGLPTKKIWGGPPFFTDLVF

SEQ ID NO: 11544 - DNA, 685 bp, Zea mays
  misc_feature: Ceres CLONE 1362640-F
  misc_feature: Encodes the peptide sequence at SEQ ID NO. 11545
  misc_feature (298)..(298): n is a, c, t, g, unknown, or other
  misc_feature (304)..(304): n is a, c, t, g, unknown, or other
  misc_feature (347)..(347): n is a, c, t, g, unknown, or other
aaagctggagctccccgcggtggcggccgctctagaactagtggatcccccgggctgcaggaattcgcacgagaccattacctagaacatcctaatcgaaaaacctcagcactagtctcctcttcgcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggnagctgncgaggaggggtggcgtgaaacgcatctcccggctgatctacgnagagaccccgcgcgtgctcaagatctttctcgagaatgtcatccgcgacgctgtgacctacacggagcacgcccgtcgcaaacccgtcaccgctatggacgtcgtggacgccctcaaacggcaggggccgactctctatgggttccgcggctaggtaaggggggggtatttgcctggccagggggtcccgaactggggaacaaattggctgccttccccgggtccaattgaaaaaattgggggaacgggtgcttttccccccctgaaaccgggtttcttgggtcagaaaaaaccctggttttatggttttggttttgccggaaaaaaaaaatgtgtct

SEQ ID NO: 11545 - protein, 103 aa, Zea mays
  misc_feature: Ceres CLONE 1362640-F
  misc_feature (25)..(94): Pfam Name: Histone Pfam Description: Core histone H2A/H2B/H3/H4
  misc_feature (37)..(37): Xaa is any aa, unknown, or other
  misc_feature (39)..(39): Xaa is any aa, unknown, or other
  misc_feature (53)..(53): Xaa is any aa, unknown, or other
MSGRGKGGKGLGKGGAKRHRKVLRDNIQGITKPAIRXLXRRGGVKRISRLIYXETPRVLKIFLENVIRDAVTYTEHARRKPVTAMDVVDALKRQGPTLYGFRG

SEQ ID NO: 11546 - DNA, 716 bp, Zea mays
  misc_feature: Ceres CLONE 1362644-F
  misc_feature: Encodes the peptide sequence at SEQ ID NO. 11547
  misc_feature (354)..(354): n is a, c, t, g, unknown, or other
  misc_feature (359)..(359): n is a, c, t, g, unknown, or other
  misc_feature (371)..(371): n is a, c, t, g, unknown, or other
  misc_feature (398)..(398): n is a, c, t, g, unknown, or other
  misc_feature (453)..(453): n is a, c, t, g, unknown, or other
  misc_feature (458)..(458): n is a, c, t, g, unknown, or other
  misc_feature (479)..(479): n is a, c, t, g, unknown, or other
  misc_feature (480)..(480): n is a, c, t, g, unknown, or other
  misc_feature (489)..(489): n is a, c, t, g, unknown, or other
aaagctggagctccccgcggtggcggccgctctagaactagtggatcccccgggctgcaggaattcgcacgagaccattacctagaacatcctaatcgaaaagaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaagcgcctcgacgacgacacccgaaacctcgcccatgagcgangtccnagtgatctgaanaataatctcatgcaagcaaggctcgantagaagctgacacaggcactacttgctcagatgataaatgagaagccacaggtgnattcnggagtatgaatcagggcaggnncatccccancccaggagatcatttaacagctccgagaggccttggggaacaagttggcgggcaagaaatagctttccctacaagttggggcccggagcatcctaatagggggaaaacaaggcaagctggccgctttatttggcataggtgggaaccccaagccctgggggattgtttcggtggcaccaaaaggaaataaggtggttccccgacacgggaaggggttgccccctggc

SEQ ID NO: 11547 - protein, 92 aa, Zea mays
  misc_feature: Ceres CLONE 1362644-F
  misc_feature (9)..(79): Pfam Name: MBF1 Pfam Description: Multiprotein bridging factor 1
  misc_feature (79)..(79): Xaa is any aa, unknown, or other
  misc_feature (84)..(84): Xaa is any aa, unknown, or other
MAGIGPIRQDWEPVVVRKKAPTAAAKKDEKAVNAARRAGAEIDTMKKYNAGTNKAASSGTSLNTKRLDDDTRNLAHERXPSDLXNNLMQARL

SEQ ID NO: 11548 - DNA, 674 bp, Zea mays
  misc_feature: Ceres CLONE 1362646-F
  misc_feature: Encodes the peptide sequence at SEQ ID NO. 11549
  misc_feature (515)..(515): n is a, c, t, g, unknown, or other
aaagctggagctcaccgcggtggcggccgctctagaactagtggatcccccgggctgcaggaattcgcacgagaccattacctagaacatcctaatcgaaaaatctccgatcgtccgtgtccctcaccaaaagttcaaaaccccatccaattccaaatcccacttctcgccagttcacctccgcctccgctcctcccctccccctcccgtcctgccatggccaccgcagcacgcgccctcgtcgccgcacgcccggcacggccgctgctgccgtctcggcgcctcccgtcctcctcttccatccgtcccgcgcggcaacgtgctggcgtcgggtgcgtccgctgcatggctcggcggccggattccacctattccccgctgcgttcgggccagggcggtgaccgtgcaccgactgaaatggcgcctctgttccctggctgcgactacgagcactggctcatcgtcatggacaagccccggggcgagggcgccaccaagcagcaaatgatagattngtacatccagaccctttgcccaggtgtagggagtgaagaggaggcgaaaaaaagatatataatgtgtcctgcgagcgctattttggattcggatgcgaaattgacgaggagacctccacgagctcgagggcctccagggggtctttttgggctacatga

SEQ ID NO: 11549 - protein, 152 aa, Zea mays
  misc_feature: Ceres CLONE 1362646-F
  misc_feature (100)..(100): Xaa is any aa, unknown, or other
MATAARALVAARPARPLLPSRRLPSSSSIRPARQRAGVGCVRCMARRPDSTYSPLRSGQGGDRAPTEMAPLFPGCDYEHWLIVMDKPRGEGATKQQMIDXYIQTLCPGVGSEEEAKKRYIMCPASAILDSDAKLTRRPPRARGPPGGLFGLH

SEQ ID NO: 11550 - DNA, 652 bp, Zea mays
  misc_feature: Ceres CLONE 1362650-F
  misc_feature: Encodes the peptide sequence at SEQ ID NO. 11551
  misc_feature (256)..(256): n is a, c, t, g, unknown, or other
  misc_feature (629)..(629): n is a, c, t, g, unknown, or other
aaagctggagctccccgcggtggcggccgctctagaatagtggatcccccgggctgcaggaattcgcacgagaccattacctagaacatcctaatcgaaaaactcgtctcatctcttccatactaccataccctacctccaaattcccaattgtcaacctctcctcagagttcgagtgaccatgtcggggcgcggaaagggcggaaaggggctgggcaagggcggcgcgaagcgtcaccgcaaggtcctccgcgancacatccagggcattacgaagccggcgatccggaggctggcgagaaggggcggcgtgaaacgcatctcggggctcatctacgaggagaccggcggcgtgctcaagatcttcctcgagaatgtcattcgcgacgctgtcacctacacggagcacgcccgccgtaagaccgtcacggccatggacgtcgtctacgcgctcaagcggcaggccgcaccctctacggatttggcgggtgaggggtcaggggtgccggcagctgctgctggtcggggcaaaagtcttgggtcgcgcccacgaaatggagtggatcgagagtatcctttgccagggccttagtttcgagggttattactctagactctagggcctgggncccagaataaaatacgacttgac

SEQ ID NO: 11551 - protein, 136 aa, Zea mays
  misc_feature: Ceres CLONE 1362650-F
  misc_feature (25)..(94): Pfam Name: Histone Pfam Description: Core histone H2A/H2B/H3/H4
  misc_feature (25)..(25): Xaa is any aa, unknown, or other
MSGRGKGGKGLGKGGAKRHRKVLRXHIQGITKPAIRRLARRGGVKRISGLIYEETGGVLKIFLENVIRDAVTYTEHARRKTVTAMDVVYALKRQAAPSTDLAGEGSGVPAAAAGRGKSLGSRPRNGVDREYPLPGP

SEQ ID NO: 11552 - DNA, 687 bp, Zea mays
  misc_feature: Ceres CLONE 1362656-F
  misc_feature: Encodes the peptide sequence at SEQ ID NO. 11553
  misc_feature (397)..(397): n is a, c, t, g, unknown, or other
  misc_feature (398)..(398): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (523)..(523): n is a, c, t, g, unknown, or other
  misc_feature (524)..(524): n is a, c, t, g, unknown, or other
  misc_feature (676)..(676): n is a, c, t, g, unknown, or other
  misc_feature (679)..(679): n is a, c, t, g, unknown, or other
  misc_feature (687)..(687): n is a, c, t, g, unknown, or other
aaagctggagctccccgcggtggcggccgctctagaactagtggatcccccgggctgcaggaattcgcacgagaccattacctagaacatcctaatcgaaaaatagcgaacaaacatcgagtacagccggctaggtaatctggtacgacgacccacgacgacatggcggcggccaccaccaccagcagcagcaagaagtcgtcgtcgccgtcgtcctcgagctcggcgcagcgggcagcagctgccgccctgctcgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgnnggcggacctcaagtgcctgtgcggcttacagaactcgccgtggatgggcgtctacaacatcgaccccaagcgcgccatggagctgccgnnncagtgcggcctcgccacgcccgccgactgctagnncagccaagcaggaaagcccccggcattgctagctgtacgtgtgtgtgtgtgcatctgcagcagggtgcaggggcccgtacgtacgtgtcactctctctctcatctgtgcactatggagagggggtgtgttcgaactaattaaatggtcttgncgncgtctggn

SEQ ID NO: 11553 - protein, 119 aa, Zea mays
  misc_feature: Ceres CLONE 1362656-F
  misc_feature (45)..(119): Pfam Name: Tryp_alpha_amyl Pfam Description: Protease inhibitor/seed storage/LTP family
  misc_feature (79)..(79): Xaa is any aa, unknown, or other
  misc_feature (109)..(109): Xaa is any aa, unknown, or other
MAAATTTSSSKKSSSPSSSSSAQRAAAAALLVAVSVLVVGAAAVCDMSNEQFMSCQPAAAKTTDPPAAPSQACCDALAXADLKCLCGLQNSPWMGVYNIDPKRAMELPXQCGLATPADC

SEQ ID NO: 11554 - DNA, 684 bp, Zea mays
  misc_feature: Ceres CLONE 1362657-F
  misc_feature: Encodes the peptide sequence at SEQ ID NO. 11555
  misc_feature (550)..(550): n is a, c, t, g, unknown, or other
  misc_feature (558)..(558): n is a, c, t, g, unknown, or other
  misc_feature (605)..(605): n is a, c, t, g, unknown, or other
  misc_feature (656)..(656): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcgaaaaactacacacaaacacacaatggcaccagaaaggatgctcctcggcgtctgtgccgtgctgatggtggtcggcgtcacgaacgcggcggagggccaggtggcgtcggtcgtcgtgggcctggcgaggtgcgccgacagcacgaggaagaacatgaaggctgaggccggtttcaagggtcttcaggtggcgatcaagtgaaagaacagcaacggcgagtacgagacaaaggccgtgagtgagatccaaagctccggagccttcagcgtcccactcgccgccgacctccacggtgccgactgccacgcgcagctccacagcgccgccaataacgcgccttgccctggggcagagccgtccaggatcgcgcccatgtcaggcggcaccttcgtcgccgtgcctgacaagatgcactacccgtccgcggagtgcgcgtccgcgtttctctgcntcccgatncagaagcactttgtagatcacttccacaaggcacccctggcggtgcngtagtaccaccggttgcctggacacagcaagccgccgggtgcggagtaccnaccggntgctgagcacagcaagccgtcg

SEQ ID NO: 11555 - protein, 59 aa, Zea mays
  misc_feature: Ceres CLONE 1362657-F
MAPERMLLGVCAVLMVVGVTNAAEGQVASVVVGLARCADSTRKNMKAEAGFKGLQVAIK

SEQ ID NO: 11556 - DNA, 620 bp, Zea mays
  misc_feature: Ceres CLONE 1362660-F
  misc_feature: Pfam Name: Ribosomal_L37ae Pfam Description: Ribosomal L37ae protein family
  misc_feature (251)..(251): n is a, c, t, g, unknown, or other
  misc_feature (424)..(424): n is a, c, t, g, unknown, or other
aaagctggagctccccgcggtggcggccgctctagaactagtggatcccccgggctgcaggaattcgcacgagaccattacctagaacatcctaatcgaaaactcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagncttgcgtaagcaaatcaagaagatggaggtatctcagcatttccaagtactttttgcgagtttctgtggggaagttttgcctgttgaaagaggaaaaagccaggttggaaattttggggggggggccaaaggggaactgggggggaaaaaagggggaaaggggcttgggttgnttttcctttaacaccccaggggaaccccccctggcttaagggggggggggccaccccgggctccggggaaagcccacgaatttccccgcccccccctggggggggggagaccccaaaacctgtgggaaaaccccgggggaaaataaaacgcccccccttaaaaaaaaaaaaaaggggggggggggtttttcccccg

SEQ ID NO: 11557 - DNA, 682 bp, Zea mays
  misc_feature: Ceres CLONE 1362664-F
  misc_feature: Encodes the peptide sequence at SEQ ID NO. 11558
  misc_feature (490)..(490): n is a, c, t, g, unknown, or other
  misc_feature (574)..(574): n is a, c, t, g, unknown, or other
  misc_feature (596)..(596): n is a, c, t, g, unknown, or other
  misc_feature (597)..(597): n is a, c, t, g, unknown, or other
aaagctggagctccccgcggtggcggccgctctagaactagtggatcccccgggctgcaggaattcgcacgagaccattacctagaacatcctaatcaaaaatcacaattcacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagaagacgcgcatcgtcccgcgacacttgctcctggcgattcgtaacgacngtgagctcggcaagctgctgtctggcgtcccatcgcgcacggcggtgtcctccccacatcaacccggttctcctgccccagaangtggcggagaggcgtccagcgnncgcagcaaggagagcaagtcccctaagaaaggccgcaagtccccaaagaagggcagcaagtcccccgaggaggcttagaaaatag

SEQ ID NO: 11558 - protein, 163 aa, Zea mays
  misc_feature: Ceres CLONE 1362664-F
  misc_feature (29)..(102): Pfam Name: Histone Pfam Description: Core histone H2A/H2B/H3/H4
  misc_feature (103)..(103): Xaa is any aa, unknown, or other
  misc_feature (131)..(131): Xaa is any aa, unknown, or other
  misc_feature (138)..(138): Xaa is any aa, unknown, or other
MDASGAGSKAKKGAAGRKAGGPRKKSVSRSVKAGLQFPVGRIGRYLKKGRYAQRVGTGAPVYLAAVLEYLAAEVLELAGNAAKDNKKTRIVPRHLLLAIRNDXELGKLLSGVPSRTAVSSPHQPGSPAPEXGGEASSXRSKESKSPKKGRKSPKKGSKSPEEA

SEQ ID NO: 11559 - DNA, 718 bp, Zea mays
  misc_feature: Ceres CLONE 1362670-F
  misc_feature: Translation starting site: 190
  misc_feature (558)..(558): n is a, c, t, g, unknown, or other
aaagctggagctccccgcggtggcggccgctctagaactagtggatcccccgggctgcaggaattcgcacgagaccattacctagaacatcctaatcgaaaaacaacacaacaacaacaaccatctccaacgcagcaagcagacagaaggacaggcaggcagcgagtgcaaccgcgagagcgatcagcgatgggctccttcttctcgaccttagtgacgccccctccggccgccgacgacccgaactgcgccgtggtggccgcgcactccaagggcacctacgacgagcagtgagcggcccacaagagcagcagcaagctgatgatgatcgacttctcggcgtgctggtgcgggacatgccgcttcatcgagcctgccattgcaggagctggcctcccgcttcaccgatgccatcgtacgtcagggtgacgtctacaagctcgcgcaggtcgcaaggacatcggaagtaaaggcgatgcccacgttcgtgctggtcacgtatggggagggaggcaggccgtgccgatcggggctaacaaggactaccttgagagtacnatcagatgttcgtaacggccatctgcttcgcaaaaaattaagaagggataccctccccactttcttacgggtttctccaactcggggggtccacctgggaaggggggggggtgaaacgggtcccttttctggaaacccgaaaaatcaaaaaaggagggta

SEQ ID NO: 11560 - DNA, 744 bp, Zea mays
  misc_feature: Ceres CLONE 1362674-F
  misc_feature: Encodes the peptide sequence at SEQ ID NO. 11561
  misc_feature (687)..(687): n is a, c, t, g, unknown, or other
aaatctcctcattattttttccgctcctttttccctacccatacaaaaataaaattggaactctccctattgtggttactcttgaaataagggtcccccggtctgagggattcgcacgagaccttacctatacatcctaatcgaaaaaccggtctactcatcttactacagcagcatgctcccacggtcagatgcgcattcagcttacgagcctctcgccggccgtgtggccatcgtgacaggaggcgccggtggaatcggctcggcggtggccgcgcacttggcgtccctgggcgcccgcgtcgtggtcggcttcatcggcgacccggcccccgcggaccagctcgtggcggccctcaacaactcctcgtcggtaggtaacagcgacccgcgcgccgtggtggtggtagcggacgtgtcggacccggcgcaggtggcgcggctgttcgacgcggtggaggcggcgttcgggccggagctgcacgtgctggtggccgcgccggccgtgcaagacgcgacgtacccgcggatcgcggacaccgtcgcccgagcagtggaacctcgcgtttcggggtgaacacgcgcggcacgttccctgtgctgcccgggaagcggacgcgccgccttggagcggcgggcggtttcggttacgcattggtcacccttctcgtcccttcaaacgggggngcccatggagcataccgggttactgagcggtacgggggcctagcaggggctgccgtg

SEQ ID NO: 11561 - protein, 133 aa, Zea mays
  misc_feature: Ceres CLONE 1362674-F
  misc_feature (17)..(134): Pfam Name: adh_short Pfam Description: short chain dehydrogenase
MLPRSDAHSAYEPLAGRVAIVTGGAGGIGSAVAAHLASLGARVVVGFIGDPAPADQLVAALNNSSSVGNSDPRAVVVVADVSDPAQVARLFDAVEAAFGPELHVLVAAPAVQDATYPRIADTVARAVEPRVSG

SEQ ID NO: 11562 - DNA, 708 bp, Zea mays
  misc_feature: Ceres CLONE 1362675-F
  misc_feature: Encodes the peptide sequence at SEQ ID NO. 11563
  misc_feature (326)..(326): n is a, c, t, g, unknown, or other
  misc_feature (363)..(363): n is a, c, t, g, unknown, or other
  misc_feature (364)..(364): n is a, c, t, g, unknown, or other
  misc_feature (384)..(384): n is a, c, t, g, unknown, or other
  misc_feature (398)..(398): n is a, c, t, g, unknown, or other
  misc_feature (407)..(407): n is a, c, t, g, unknown, or other
  misc_feature (492)..(492): n is a, c, t, g, unknown, or other
aaagctggagctccccgcggtggcggccgctctagaactagtggatcccccgggctgcaggaattcgcacgagaccattacctagaacatcctaatcaaaaataaaagcacagcgcttctacacccgccgccgccactcgttgcagcctctctacctctacctactggagtagggagcacgccgcacgagccctttccgccgccgccaaaatggtgaacgttcctaagaccaagaagacctactgcaagaacaaggagtgcaagaagcacactctccacaaggttactcagtacaagaagggtaaggatagcctgtctgcccaggnaaagcgccgttatgacccgcagcagtcaggatatggnntgccagacaagcctgtcttnccacagaaggccangaccaccangaaaatcgtattgaagctgcagtgccagagctgcaagcactactcacagcacgcaattaagaaggggcagcattttgaagatggntgaagacaagaaggccaaggaaacatctcttctctaagtttcccatcgccatcccaatgttggatcgaaacgtgggggccactactggtcaaaaactcggcaaatttcaatgttaccaaaaattccaaaagggggcctggtggggatcaaatccaagggccgaaatttgcggcggggggggggttgctttttggaaaagggaattttcccccctaa

SEQ ID NO: 11563 - protein, 94 aa, Zea mays
  misc_feature: Ceres CLONE 1362675-F
  misc_feature (19)..(95): Pfam Name: Ribosomal_L44 Pfam Description: Ribosomal protein L44
  misc_feature (39)..(39): Xaa is any aa, unknown, or other
  misc_feature (52)..(52): Xaa is any aa, unknown, or other
  misc_feature (58)..(58): Xaa is any aa, unknown, or other
  misc_feature (63)..(63): Xaa is any aa, unknown, or other
  misc_feature (66)..(66): Xaa is any aa, unknown, or other
MVNVPKTKKTYCKNKECKKHTLHKVTQYKKGKDSLSAQXKRRYDPQQSGYGXPDKPVXPQKAXTTXKIVLKLQCQSCKHYSQHAIKKGQHFEDG

SEQ ID NO: 11564 - DNA, 695 bp, Zea mays
  misc_feature: Ceres CLONE 1362678-F
  misc_feature: Encodes the peptide sequence at SEQ ID NO. 11565
  misc_feature (572)..(572): n is a, c, t, g, unknown, or other
  misc_feature (588)..(588): n is a, c, t, g, unknown, or other
  misc_feature (626)..(626): n is a, c, t, g, unknown, or other
  misc_feature (671)..(671): n is a, c, t, g, unknown, or other
aaagctggagctccccgcggtggcggccgctctagaactagtggatcccccgggctgcaggaattcgcacgagaccattacctagaacatcctaatcgaaaaacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagaagacgcgcatcgtcccgcgacacttgctcctggcgattcgtaacgacgttgagctcggcaagctgctgtctggcgtcacatcgcgcacggcggtgtcctccccacatcaacccggttctcctgccccagaaagtggcgnagaaagcgtccagcgncggcagcaaagagagcaagtcccctaagaagggccgcnagtcccccaagaaggcagccaagtcccccgagaaggcttagaaantagtcacttcactagcgctctgct

SEQ ID NO: 11565 - protein, 146 aa, Zea mays
  misc_feature: Ceres CLONE 1362678-F
  misc_feature (29)..(102): Pfam Name: Histone Pfam Description: Core histone H2A/H2B/H3/H4
  misc_feature (133)..(133): Xaa is any aa, unknown, or other
MDASGAGSKAKKGAAGRKAGGPRKKSVSRSVKAGLQFPVGRIGRYLKKGRYAQRVGTGAPVYLAAVLEYLAAEVLELAGNAAKDNKKTRIVPRHLLLAIRNDVELGKLLSGVTSRTAVSSPHQPGSPAPESGXESVQRRQQREQVP

SEQ ID NO: 11566 - DNA, 712 bp, Zea mays
  misc_feature: Ceres CLONE 1362679-F
  misc_feature: Encodes the peptide sequence at SEQ ID NO. 11567
  misc_feature (358)..(358): n is a, c, t, g, unknown, or other
  misc_feature (486)..(486): n is a, c, t, g, unknown, or other
aagctggagctccccgcggtggcggccgctctagaactagtggatcccccgggctgcaggaattcgcacgagaccattacctagaacatcctaatcaaaaaacactatatatcacagtcagacagccatatcacttagttatctgtgcagaggcaatggctctcaaggttgagctggtgatgaaggccaagtccccgaatgacaagatgtggctggcgctgggtgactcgacggatctgttcccgaagatcttccccgagaagtacaagatcatcgaagaccgtcaagggcgacgtgaagtcaaccggcaccgtccacctcctcacgtacaccgatgaggagccgatgctgacgttcntcaagatcaatctcgagacggggatccacgacactaggtcgtgtcgtacaacgtgcggcacgagaagctgccgacttctacaagaacttacagatcacgctgaagggactcccctcaaggggtaggcngagggagggccctcgtcagctgcccattgtagttggacaagccaaaaaacttggggcctggcccggacttgttaaggggaacgacaattattggtttcgggctcttctccgaaaccttcccaaaaaaaaaaaggaggcgcaattgggaaagggtcacaaaaagtaggttctcgttccttttttcggacccctcaaaattaaaaaaagagacggcccctccgggggg

SEQ ID NO: 11567 - protein, 60 aa, Zea mays
  misc_feature: Ceres CLONE 1362679-F
MALKVELVMKAKSPNDKMWLALGDSTDLFPKIFPEKYKIIEDRQGRREVNRHRPPPHVHR

SEQ ID NO: 11568 - DNA, 702 bp, Zea mays
  misc_feature: Ceres CLONE 1362681-F
  misc_feature: Encodes the peptide sequence at SEQ ID NO. 11569
  misc_feature (340)..(340): n is a, c, t, g, unknown, or other
  misc_feature (341)..(341): n is a, c, t, g, unknown, or other
  misc_feature (347)..(347): n is a, c, t, g, unknown, or other
  misc_feature (352)..(352): n is a, c, t, g, unknown, or other
  misc_feature (354)..(354): n is a, c, t, g, unknown, or other
  misc_feature (359)..(359): n is a, c, t, g, unknown, or other
  misc_feature (360)..(360): n is a, c, t, g, unknown, or other
  misc_feature (686)..(686): n is a, c, t, g, unknown, or other
aaagctggagctccccgcggtggcggccgctctagaactagtggatcccccgggctgcaggaattcgcacgagaccattacctagaacatcctaatcaaaactccctccaactttgcacagtctgcgcaccctgccacgacgagatggcttcctgttcctcatcgccacggccacccaccatccctctcatcttcctcttcctcctcctccacttctcctccgtcctcgccgcaccagctcctccagccttgtcacaacaggctggtaccggcggcggcggcggcaatgcgacggattcggcggcggcgtggacgccgcggctgaagaaaaacgtcttgnnacgcgncatgnancgctnngcgcgggcgccgctggtggggcggttccagggtgtgcgcgtgggcacctgctgcgggggcccgccacggatgtgcatcccggggccctgctgctacccatcaactgaacatccccaaccgccccttcggggtttgctccttcccccccgggacctgaaatgccttacctggcacctctaggtaaggcttcccgccttggacccatggtttggcttgccaaactggccgtttcgttggcaaaggaaggaaatccgggaatcgtcctttggggaacgatttcacaaaagttccccctgcccaaacgggttggttggccctggccccantaaaaacaatgggggg

SEQ ID NO: 11569 - protein, 131 aa, Zea mays
  misc_feature: Ceres CLONE 1362681-F
  misc_feature (66)..(66): Xaa is any aa, unknown, or other
  misc_feature (68)..(68): Xaa is any aa, unknown, or other
  misc_feature (70)..(70): Xaa is any aa, unknown, or other
  misc_feature (72)..(72): Xaa is any aa, unknown, or other
MASCSSSPRPPTIPLIFLFLLLHFSSVLAAPAPPALSQQAGTGGGGGNATDSAAAWTPRLKKNVLXRXMXRXARAPLVGRFQGVRVGTCCGGPPRMCIPGPCCYPSTEHPQPPLRGLLLPPRDLKCLTWHL

SEQ ID NO: 11570 - DNA, 697 bp, Zea mays
  misc_feature: Ceres CLONE 1362682-F
  misc_feature: Encodes the peptide sequence at SEQ ID NO. 11571
tggagctccccgcggtggcggccgctctagaactagtggatcccccgggctgcaggaattcgcacgagaccattacctagaacatcctaatcgaaaaaaaaccctagcatcaaagaagccgcatctgcaatctgcctctctcgtcccctggcggccgaccgtgacaggatgtcgaaatctacggcgaggacgctgaaggatcgtcaacccggacgagtacgtcaaggcctactccgcccacctctagcgctccgcgtgagatggagctccctgagcgtcttgacattgtgaacactgcgaggctcagggagcttcctccttatgatcctgactggtactacatcaggcctggatccattgcaacgagcatctacctaaggcacggcaccggggtgggtggctttcataataccccccgtggccgccaaaggaatgggtcccgcccaccaccttctgaaagagcattgctgctgttgcgcgccacatcctcaaaccgctggagattatgggcggtcatcgaagtcgaacccaaaggagggaggctcatccccacccgcgtaaagggtcctctggaaccaaagggactggcagggtcacctgttggaaccggcgagcaagggccattctttgggatttccatggcggctacggtatgacaggaatgaaaagagtgggccctctaatccgggccctaggg

SEQ ID NO: 11571 - protein, 131 aa, Zea mays
  misc_feature: Ceres CLONE 1362682-F
  misc_feature (1)..(109): Pfam Name: Ribosomal_S19e Pfam Description: Ribosomal protein S19e
MELPERLDIVNTARLRELPPYDPDWYYIRPGSIATSIYLRHGTGVGGFHNTPRGRQRNGSRPPPSERALLLLRATSSNRWRLWAVIEVEPKGGRLIPTRVKGPLEPKGLAGSPVGTGEQGPFFGISMAATV

SEQ ID NO: 11572 - DNA, 1016 bp, Zea mays
  misc_feature: Ceres CLONE 1362682-R
  misc_feature (1)..(1): n is a, c, t, g, unknown, or other
naaaaacaattgggtaccgggccccccctcgaggtcgacggtatcgataagcttttttttttttttttttggacgagctacagcatcgttagactgtcgacctaaagtccagttgtaatacaagtgaaactgaccatgacaaacaggaagatgctggtcgatcaaacgagccagaatcgcgtgatatatagactctgcgaaagatggaacaaaacatgcagggcttcagctcttggttacatacactacactacttcattgtccggtacttttacagcgaccaatgcatagcatgcgcccagaacaatgaggaggttgagcggataccagggtctgcctgatcttgagcttctcccccaaatcgcattcgaagcttgaaccggtctgttcgaaaaattcttggaataaaagccttgccccccccgctcagttagcttcttgcaccccccatccgcggtcccctaacaaggtccgaaggggggagccccccctcctcccttggaggcgaggtgtcgtccccctggaatcgcgccaacaccactccgcggaaagaggcggcgcccccgtaacctcccaccccccccataaccgcctcatggaggatacaggcccccgcctctgcgctccccccgggcctggatagtgaaccgaattcgtacccttgccggcgccaacaaagaacctcttagtgaggaaaaatccttgccctttcaccgagaatactacccattaaaacgtggacgagacaccccctccccgatccgttgtccagatccgcggggcccattcctccgtcctcccgccccccgggttcctaacgagcaagacccccccccaccggcgctcttctgccggtagggaattatttgttttccatcccccaccctgccttctcttactcgcaaccagaggcgccccccgcgcaacgggtcgagagtctcccgcggccacgcccctttcgctctgcgttgtaaccgcgtttcacctgaatatacaggatcacccggtaccccccg

SEQ ID NO: 11573 - DNA, 660 bp, Zea mays
  misc_feature: Ceres CLONE 1362686-F
  misc_feature: Encodes the peptide sequence at SEQ ID NO. 11574
  misc_feature (568)..(568): n is a, c, t, g, unknown, or other
aaagctggagctccccgcggtggcggccgctctagaactagtggatcccccgggctgcaggaattcgcacgagaccattacctagaacatcctaatcaaaaaacaacaccagaatccgcgaatcacagacgcgtctatctcagcttgctgcactgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgccctcagaacgtcgccaacggcgccaacgggagcggcacctacatcagccgcgccgccgcgctgcccagcaagtgcggcgtcgccctgccgtacagatcagcaccaacgttnactgcacacgataatttagtgatgaggcgtcctgtgcgcgtccgggcgagaatgcatgcatgcccgctgcggaagtaataaataatgctacg

SEQ ID NO: 11574 - protein, 142 aa, Zea mays
  misc_feature: Ceres CLONE 1362686-F
  misc_feature (32)..(113): Pfam Name: Tryp_alpha_amyl Pfam Description: Protease inhibitor/seed storage/LTP family
  misc_feature (117)..(117): Xaa is any aa, unknown, or other
MAAPKLATLALAVLLAATVVAPPAAVRAAMSCSTVYSTLMPCLPFVQMGGAMPPQPCCGGIRSLLQQANNTPDRRTICGCPQNVANGANGSGTYISRAAALPSKCGVALPYRSAPTXTAHDNLVMRRPVRVRARMHACPLRK

SEQ ID NO: 11575 - DNA, 684 bp, Zea mays
  misc_feature: Ceres CLONE 1362687-F
  misc_feature: Encodes the peptide sequence at SEQ ID NO. 11576
  misc_feature (279)..(279): n is a, c, t, g, unknown, or other
  misc_feature (664)..(664): n is a, c, t, g, unknown, or other
tggagctccccgcggtggcggccgctctagaactagtggatcccccgggctgcaggaattcgcacgagaccattacctagaacatcctaatcgaaaaagtctgcggcccgcagtgcgagtacaagtgagcggccagcagtgcgaggacaggcatggcggctgccggcggacgcgcggttgcggtggcagccatggtggcggtggcggcggcgctgcctctgctcgcgtgtggcggttacgcggagtgctacgactactgcttcaaggactgcatctccnagggacagtccatgagagactactgcagctacgcctgcgacaagacctgcgcgcccgacgcccggcggcggcgccccgcggtcgtcccccatgaactggcagctcgcctgcgtcagggagtcctgccaccgtcgccgcgcggctgatgccgacgacgacacgaagacgaaggcctgctacgggcagtgctacgacgacggcggctgcgagaccagtggcgccctgcccgagcctctgcgcgcaggcggcggtgcttgcgttgtcggccgcccagggccaggggagtcacgggaccaccattccacgagagaaggacgctcccggacccggggggggggcccccgaccttccatccacgtggagcaggacgctctccgccgggggngggggggggcccctggccac

SEQ ID NO: 11576 - protein, 90 aa, Zea mays
  misc_feature: Ceres CLONE 1362687-F
  misc_feature (43)..(43): Xaa is any aa, unknown, or other
MAAAGGRAVAVAAMVAVAAALPLLACGGYAECYDYCFKDCISXGQSMRDYCSYACDKTCAPDARRRRPAVVPHELAARLRQGVLPPSPRG

SEQ ID NO: 11577 - DNA, 686 bp, Zea mays
  misc_feature: Ceres CLONE 1362689-F
  misc_feature: Encodes the peptide sequence at SEQ ID NO. 11578
  misc_feature (365)..(365): n is a, c, t, g, unknown, or other
aaagctggagctccccgcggtggcggccgctctagaactagtggatcccccgggctgcaggaattcgcacgagaccattacctagaacatcctaatcgaaaacttctagaatcgtgtgccagctgcacagtatgaagagccgtacagttccacccgaggagcgagcgagtgattacctcgtgcgtgctgtgcaaggaaagtaaccaagcagatcgatcggtcgaggaggataggacaggatccatacgtatctagccatgcaggacgaagcgtctgcgcctgctgcgggtacgctcgctccgccggttaatatgacaatgctgctaggggtcgacgagagcgagcacagcttctacgcgctgcancgccctctgtagcacttcttcccggcggcccagccgctatgaggaccgcctcgtcctcgacaccgccgaagcactcgccgcctacgccgtcggactcgccgacccaggcgccttggatgtcctgccgtacggggaggcaggatctaaaggtctctgacctgcgcgtcttcaaaatagcctaaggcctctgcccacaagcaagcgacgctgggctaggggtgttggagggggacgttataaccgccttctgctaaggtgtccccgaagcacgggaccctgatgcttcgttctcggaggcatggttacttagacatttaaagg

SEQ ID NO: 11578 - protein, 39 aa, Zea mays
  misc_feature: Ceres CLONE 1362689-F
  misc_feature (36)..(36): Xaa is any aa, unknown, or other
MQDEASAPAAGTLAPPVNMTMLLGVDESEHSFYALXRPL

SEQ ID NO: 11579 - DNA, 671 bp, Zea mays
  misc_feature: Ceres CLONE 1362691-F
  misc_feature: Translation starting site: 185
  misc_feature (335)..(335): n is a, c, t, g, unknown, or other
  misc_feature (369)..(369): n is a, c, t, g, unknown, or other
  misc_feature (370)..(370): n is a, c, t, g, unknown, or other
  misc_feature (468)..(468): n is a, c, t, g, unknown, or other
  misc_feature (515)..(515): n is a, c, t, g, unknown, or other
tggagctccccgcggtggcggccgctctagaactagtggatcccccgggctgcaggaattcgcacgagaccattacctagaacatcctaatcgaaaagcatcgcgtctaaacccttgtctccttcttatccccacctccctcgcggatcactcgccgccgccgccggccgcagccatcgccgtgatgctgtccctgtcgagggcgatcgggaggcggctcttctcgtccgccgaggccgcgtcgacggctgcggtgaggacggcgcagaacccgctcgaggagttcttcgaggtcgagcggagcaccgaggagggcaagcctcctcccccactancgtcgcagctggaaggcttctgaactgcgactannatcttgggatgaccttcagaaattgtggtatgttcttctaaaggaaaagaacatgctaatgacacagcgtcaaatgctgcattcagagagcatgaggntccccaaatccagaccgaattcccaggtaaagaaaatcatgtgccgnataaagcatgtcttgactgaaagggctatagcgaagcccgatccagggaaatcttccgaaatgaagcgaatgaaaaaggccccggggattcactccagggattcccccctgggatttttgaggggactataaaaaaaaactggtgccttcttgttt

SEQ ID NO: 11580 - DNA, 681 bp, Zea mays
  misc_feature: Ceres CLONE 1362692-F
  misc_feature: Encodes the peptide sequence at SEQ ID NO. 11581
  misc_feature (411)..(411): n is a, c, t, g, unknown, or other
aaagctggagctccccgcggtggcggccgctctagaactagtggatcccccgggctgcaggaattcgcacgagaccattacctagaacatcctaatcgaaaaaaagcagcagcagcacagtcatccacactaacgaacgaactcttgctccgatcacgagctagctgaggtcgacgatggcggctgtgctgaacagcaggaagacggcgcaggcggtggtggccgtgctggtggcggcggcgctgctggcttcgtccacttcggcggcgatcacctgcgggcaggtggggtcgtcgctggcgccgtgcatcccgtacgcgacggggagggccagcgcactccccgcgtcgtgctgcagcggcgtcaagagccctcacagcgcggcgcggaccagcgcggacccgcaggcgncgtgccgctgccctcagagcctcggccacagcgtcaagagcgtcaacatggggcaccgtcgcccacatccccgggaagtgcggcgtctccgtcggattcccatcagcatgtcccacgactggcacagatccgctaagtacgaccgaccagctaatagcctaccgaacgtacccaaccgtcccgggcctggccaagtggtgaaacccggggaaaaaaaaaaaagcccctgaatggccggaccccggcttattttcccccatataatacggg

SEQ ID NO: 11581 - protein, 154 aa, Zea mays
  misc_feature: Ceres CLONE 1362692-F
  misc_feature (34)..(119): Pfam Name: Tryp_alpha_amyl Pfam Description: Protease inhibitor/seed storage/LTP family
  misc_feature (79)..(79): Xaa is any aa, unknown, or other
MAAVLNSRKTAQAVVAVLVAAALLASSTSAAITCGQVGSSLAPCIPYATGRASALPASCCSGVKSPHSAARTSADPQAXCRCPQSLGHSVKSVNMGHRRPHPREVRRLRRIPISMSHDWHRSAKYDRPANSLPNVPNRPGPGQVVKPGEKKKSP

SEQ ID NO: 11582 - DNA, 732 bp, Zea mays
  misc_feature: Ceres CLONE 1362693-F
  misc_feature: Encodes the peptide sequence at SEQ ID NO. 11583
  misc_feature (600)..(600): n is a, c, t, g, unknown, or other
aaagctggagctccccgcggtggcggccgctctagaactagtggatcccccgggctgcaggaattcgcacgagaccattacctagaacatcctaatcgaaaattttttcacagctgaaagcagccaaaacgcacaagctgcactgcatacatcgagctaactatctgcagcgatgtctcgctcctgctgcgtcgccgtgtcggtgcttctcgctgtcgccgcgacagccagcgccaccgcgccggcatggctgcacgaggaggccatggtcacgggcccgctggtcgcagagggtagcagggtggcgccctccagcgtcacctgagctgcagacaaggcgtctccggcgaggacgagcgggggatggccacgcagggcgacgaccatagctcgtcgggcggcagtggcagcaccggtgaacacgccaagtaggagggcgaaaagcaaggcaagagctgcctcaccaaggaggatggcccccaaaaaaaatgatctgggggaaggtttggccttttccgggccaaaaaaagggcgcccccagaggccccaagtcctgggtcccccctggttaagaacccgagccccgatttttccccgggnaaaacccccaaaggaggagggggttcccttcccttttttgaaaaaaacttttgggggggcccccctcccctgggggggaaaacaaaaaagggaataaggggggggtgtttgtaccccccgcccccacctcgc

SEQ ID NO: 11583 - protein, 50 aa, Zea mays
  misc_feature: Ceres CLONE 1362693-F
MSRSCCVAVSVLLAVAATASATAPAWLHEEAMVTGPLVAEGSRVAPSSVT

SEQ ID NO: 11584 - DNA, 749 bp, Zea mays
  misc_feature: Ceres CLONE 1362698-F
  misc_feature: Encodes the peptide sequence at SEQ ID NO. 11585
  misc_feature (258)..(258): n is a, c, t, g, unknown, or other
  misc_feature (282)..(282): n is a, c, t, g, unknown, or other
  misc_feature (283)..(283): n is a, c, t, g, unknown, or other
  misc_feature (359)..(359): n is a, c, t, g, unknown, or other
  misc_feature (689)..(689): n is a, c, t, g, unknown, or other
aaagctggagctccccgcggtggcggccgctctagaactagtggatcccccgggctgcaggaattcgcacgagaccattacctagaacatcctaatcgaaaacaccgaggccaaaggccaccaccattccttccccaactctgcaggctgatcgtcgccctccctccacgccggacgcgccccgatccagatccaggggcgtaacatgacatcaaaacgtatcctcagggaattaaagggactgcaaaaggaccctcnacgtcatgcagtgcaggtcctgcnntgtgacgatatgtccactggcaggcaaccatcatggcccctcctgataatccatatgctggaggtgttttctaagngaacatccattcccgcgcggactaccctttcaggctccaaaaggtatctttaaagacgaagggcctccatcccaacatcaataggatgggaagcttttgcctccacatcttaaagaacaggggagcccctggtttgacaatccccaaggttttgttttcaaagggggcgggggtaaaggaacccaacccagaacaccctcttggcgctggaattgcgccaagggaaaaaaggggctccgctaaaataaggggcaccagcccccggtggggccccaaaaattttcctgggggggagaaataaaatatagaggaacaacccctcttttcccntttttgtgtaaaaaaacaaaaaggggggggtgtccccacaaaaaaattgtttgggagaaa

SEQ ID NO: 11585 - protein, 71 aa, Zea mays
  misc_feature: Ceres CLONE 1362698-F
  misc_feature: SWISSPROT Homolog: EC 6.3.2.19 Ubiquitin--protein ligase
MGSFCLHILKNRGAPGLTIPKVLFSKGAGVKEPNPEHPLGAGIAPREKRGSAKIRGTSPRWGPKNFPGGEK

SEQ ID NO: 11586 - DNA, 683 bp, Zea mays
  misc_feature: Ceres CLONE 1362701-F
  misc_feature: Encodes the peptide sequence at SEQ ID NO. 11587
aagctggagctccccgcggtggcggccgctctagaactagtggatcccccgggctgcaggaattcgcacgagaccattacctagaacatcctaatcgaaaactctcgctccgttgctcgcctcgggtcaaaccctaagcagggagttgatttatccgctgcagccatgagtaagttgcagtctgagtctgccaaggatgccatctcccagattgttggggatgccaaggagaagaataggaagttcactgagactgtggaacttcatattggtctgaagaattatgatccacagaaggacaagcgtttcagtggctctgttaagttgccccatatccctcgtcccaagatgaaggtgtgcatgcttggtgatgcccagcatgttgaggaggccgagaagatgcgacttgactacatggatgttgaggctctcaagaatatgaacaagaacaagaagcttgttacgaggcttgccaagaagtaccatgctttcttggcatcagaggccatcatcaagcagattccacgtctccttggtcctggtctcaagcaggtaggcaagatcccgacgcctggtactcaccaggaatccctcgaatcgaaggggaacgagactaaggcaaccgacaagatccagctcaagaacgttctttgcatgggcgtcgacgacggcaacttgacgag

SEQ ID NO: 11587 - protein, 172 aa, Zea mays
  misc_feature: Ceres CLONE 1362701-F
  misc_feature (10)..(167): Pfam Name: Ribosomal_L1 Pfam Description: Ribosomal protein L1p/L10e family
MSKLQSESAKDAISQIVGDAKEKNRKFTETVELHIGLKNYDPQKDKRFSGSVKLPHIPRPKMKVCMLGDAQHVEEAEKMRLDYMDVEALKNMNKNKKLVTRLAKKYHAFLASEAIIKQIPRLLGPGLKQVGKIPTPGTHQESLESKGNETKATDKIQLKNVLCMGVDDGNLT

SEQ ID NO: 11588 - DNA, 664 bp, Zea mays
  misc_feature: Ceres CLONE 1362702-F
  misc_feature: Encodes the peptide sequence at SEQ ID NO. 11589
  misc_feature (511)..(511): n is a, c, t, g, unknown, or other
  misc_feature (571)..(571): n is a, c, t, g, unknown, or other
  misc_feature (572)..(572): n is a, c, t, g, unknown, or other
ctggagctccccgcggtggcggccgctctagaactagtggatcccccgggctgcaggaattcgcacgagaccattacctagaacatcctaatcgaaaaaccaatcccatcctccacccaatcgaaggacctagcgagcggcagcggcggcggcgatcggagaagatggtgcgcaaggcgaaggttgagttcgacgagcagccgccggataacttcgacccgaagaacccgtatgccgacccggtggcgatgctcgagtaccgggaacacctggtgcgagagaagtggatccatatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgccctgactccacgagccccagaagacccgtcaggcggagtagcggcgctgctgccttgcttctcgtgctgctgntcctggattgaagagtgatctgacccttccatgagttgaatgaagtacctggaactgggnnagtccgtcttttacatcttaggctggtgataaacttccaataaatcttggtcaagaaaacttttctgtggcggtaaatgttgccccccaaat

SEQ ID NO: 11589 - protein, 92 aa, Zea mays
  misc_feature: Ceres CLONE 1362702-F
MVRKAKVEFDEQPPDNFDPKNPYADPVAMLEYREHLVREKWIHIETAKIIRERLRWCYRIEGINHHQKCRHLVDQYLEATRGVGWGKDARPP

SEQ ID NO: 11590 - DNA, 730 bp, Zea mays
  misc_feature: Ceres CLONE 1362712-F
  misc_feature: Encodes the peptide sequence at SEQ ID NO. 11591
  misc_feature (284)..(284): n is a, c, t, g, unknown, or other
  misc_feature (348)..(348): n is a, c, t, g, unknown, or other
  misc_feature (353)..(353): n is a, c, t, g, unknown, or other
  misc_feature (354)..(354): n is a, c, t, g, unknown, or other
  misc_feature (367)..(367): n is a, c, t, g, unknown, or other
  misc_feature (397)..(397): n is a, c, t, g, unknown, or other
  misc_feature (476)..(476): n is a, c, t, g, unknown, or other
aagctggagctccccgcggtggcggccgctctagaactagtggatcccccgggctgcaggaattcgcacgagaccattacctagaacatcctaatcgaaaactgtttgttgtttttcttctcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagatagggctgatnaagctaattactccctacaatatgatggagagaaagagcatgttccttcattaaagaacctccntccanntgtcatcatgaancattcttcaggcatggtcagaatgactacnatcaaacaggattagtggcttttggagggatgtctgccagggaggcctccccagcttctcaggggatcgctggactgcntgcaatcacttggtccatgacccaaacattgggcccctacaaaaaaccgggaatggatttcgggattaagcagcttcctctgggggcccctggaacctccccccccaaatgaccttcccccaaggatttcccccgggggggggcccctcataacaaattttgggcccccggggccccccgggaaaataataaaaaccggccctcgggccttttttgggggtgagcaaaattttcaagaaaccgcctttcccttt

SEQ ID NO: 11591 - protein, 71 aa, Zea mays
  misc_feature: Ceres CLONE 1362712-F
  misc_feature (30)..(30): Xaa is any aa, unknown, or other
  misc_feature (51)..(51): Xaa is any aa, unknown, or other
  misc_feature (53)..(53): Xaa is any aa, unknown, or other
  misc_feature (57)..(57): Xaa is any aa, unknown, or other
MSSSGPLPAGTHQTRNRAGNRRKSGDRADXANYSLQYDGEKEHVPSLKNLXPXVIMXHSSGMVRMTTIKQD

SEQ ID NO: 11592 - DNA, 656 bp, Zea mays
  misc_feature: Ceres CLONE 1362778-F
  misc_feature: Encodes the peptide sequence at SEQ ID NO. 11593
  misc_feature (267)..(267): n is a, c, t, g, unknown, or other
  misc_feature (656)..(656): n is a, c, t, g, unknown, or other
tggagctccccgcggtggcggccgctctagaactagtggatcccccgggctgcaggaattcgcacgagaccattacctagaacatcctaatcgaaaaactcacagctcaaaagcagccaaaacgctagctagctgcagcgatgatgtctcgctcctgctacctcgccgtgtcggtccttctcgcggtcgccgcgacagccagcggcgccatcgcgccggcgttgctgcacgaggtgcgcctcgaggaggagggcctgctggtcgcgnagggcgcgagggtggcgtccacctgggcgggcaacaggtctcgcgggcgcagccgatggaagcgtgcccgagcggcgccgtgccacgcagggcgacgacagagctcgtcgggcggccgccacccccccaaggaggaggggaccaccaggagggcgaaaacagggcagaatttgcccccccaaggagggtggcccaaaaaaaagggggcttgcgggaaagcctgccccccctcccggaaaaaaaaggggcccccaaagggccccaagcccggggcccccccccggaaggcccccccaacaagaaaaaaatttccgggggggctttcccaaaaaggtttgagaaaagggggggactcttttgggggcgcgccctcgggaaaaggggccctn

SEQ ID NO: 11593 - protein, 172 aa, Zea mays
  misc_feature: Ceres CLONE 1362778-F
  misc_feature (43)..(43): Xaa is any aa, unknown, or other
MMSRSCYLAVSVLLAVAATASGAIAPALLHEVRLEEEGLLVAXGARVASTWAGNRSRGRSRWKRARAAPCHAGRRQSSSGGRHPPKEEGTTRRAKTGQNLPPQGGWPKKKGACGKACPPSRKKKGPPKGPKPGAPPRKAPPTRKKFPGGLSQKGLRKGGDSFGGAPSGKGAL

SEQ ID NO: 11594 - DNA, 693 bp, Zea mays
  misc_feature: Ceres CLONE 1362779-F
  misc_feature: Encodes the peptide sequence at SEQ ID NO. 11595
  misc_feature (407)..(407): n is a, c, t, g, unknown, or other
agagctggagctccccgcggtggcggccgctctagaactagtggatcccccgggctgcaggaattcgcacgagaccattacctagaacatcctaatcgaaaactccgaatttactgatccatccatctccatccccatcccgtgacccgtgcacgccgccgcttcaagtcctaacaagccgcatcgcatcgcatgcgtgtgctgtccgaccgccatctccgcagccggctggcctagctacctcacctcacctcacgcaggcacactgcacacacacccatggtggtggcggcgatgcggcggccgtgcgctgtgccagcgctgctggtggcggcggcgacggcgacgctagtgcttctgctgctgctgtcaccgtcgagcgcgcagccggtgccgtcccccggcgncgcgccggggccccgcgggcgggacccgggatcgactcggcgtgcctgaactcgctgctcaacatgtcggactgcctcccgaacgtgagccagggaagcacggggcggggccccgaaccgccctgctgcccggagttgggggccctgtcggttcaaacccggctgcctctggaaattcctttcggggccgcgaatcccaagggatccccgggaaataggggcgggggttccgtttcccggggtttgccggggtccccaacggcccgttcccactggaaagccttgg

SEQ ID NO: 11595 - protein, 74 aa, Zea mays
  misc_feature: Ceres CLONE 1362779-F
MSDCLPNVSQGSTGRGPEPPCCPELGALSVQTRLPLEIPFGAANPKGSPGNRGGGSVSRGLPGSPTARSHWKAL

SEQ ID NO: 11596 - DNA, 692 bp, Zea mays
  misc_feature: Ceres CLONE 1362780-F
  misc_feature: Encodes the peptide sequence at SEQ ID NO. 11597
  misc_feature (396)..(396): n is a, c, t, g, unknown, or other
  misc_feature (446)..(446): n is a, c, t, g, unknown, or other
  misc_feature (466)..(466): n is a, c, t, g, unknown, or other
  misc_feature (495)..(495): n is a, c, t, g, unknown, or other
aaagctggagctccccgcggtggcggccgctctagaactagtggatcccccgggctgcaggaattcgcacgagaccattacctagaacatcctaatcgaaaaattctcatttcttgcacactgacaccagcccctcctgctggctgccccttgctccctcccatggggctccccctggatccctctccatggcgtggatcagccccagcttcccatggatgtcgccctcctctccctgatggctggcgtctccactccctgcagcaaggacgctttcctctgctccctgctcttcctcccatggccccccatgtagcagtaaccatggaaacccctctgggacgcgccctcagcatgctcaatgatatgctgcagcgagctccaccttgatctatngcaacccggccgcaaatcatcgaaccttggggaaaccttgggaccgatgntgaagaggtgagcccatccnacgtttgttaaatggtcgataaaaggttnaaacaaaagccatcggcgatcttgggattaaaggttggtttagttatggggatctcctcccaaaccatgtaaataaactggaatggggggatgaaaaaaaggattgggtggaagggccatcttgttaatggcaaggtgggaagggaggggcaaaaattgaaaaaaggcccaaatgggggcaaaacattattggggag

SEQ ID NO: 11597 - protein, 75 aa, Zea mays
  misc_feature: Ceres CLONE 1362780-F
MGLPLDPSPWRGSAPASHGCRPPLPDGWRLHSLQQGRFPLLPALPPMAPHVAVTMETPLGRALSMLNDMLQRAPP

SEQ ID NO: 11598 - DNA, 666 bp, Zea mays
  misc_feature: Ceres CLONE 1362783-F
  misc_feature: Encodes the peptide sequence at SEQ ID NO. 11599
aaagctggagctccccgcggtggcggccgctctagaactagtggatcccccgggctgcaggaattcgcacgagaccattacctagaacatcctaatcgaaaaagattcagcccacaaggccataacaaaatagccccgccccccctcccctagggtttcactacatatgtaaccctctcgcgcaaacactcctctttccgcgccgcctcccctcccgccctcttgctccgccggcgcggccaccgccaccgccaccgcaacagctagtcagcagatcgtaaccatggcggattcgaaggccgctgcggcggtgacgctccgcacacgcaagttcatgaccaaccgtcttctctcccgcaagcagttcgtgctcgaggtcatccaccccggccgccccaacgtctccaaggcggagctcaaggagaggctggcgaagatctacgaggtgaaggacccaaactgcatcttcgtgttcaagttccgaaccaacttcggaggcggcaagtccaccggcttcggtctcatctacgacaaccttgaggccgccaagaagttcgagcccaagtaccgcctcatcaggaacggccttgctaccaaggtagagaagtcacgaaagcagatgaaggaacgtaagaacagggcgaagaaaatccgtggtgtgaagaa

SEQ ID NO: 11599 - protein, 127 aa, Zea mays
  misc_feature: Ceres CLONE 1362783-F
  misc_feature (28)..(111): Pfam Name: Ribosomal_S24e Pfam Description: Ribosomal protein S24e
MADSKAAAAVTLRTRKFMTNRLLSRKQFVLEVIHPGRPNVSKAELKERLAKIYEVKDPNCIFVFKFRTNFGGGKSTGFGLIYDNLEAAKKFEPKYRLIRNGLATKVEKSRKQMKERKNRAKKIRGVK

SEQ ID NO: 11600 - DNA, 671 bp, Zea mays
  misc_feature: Ceres CLONE 1362784-F
  misc_feature: Encodes the peptide sequence at SEQ ID NO. 11601
  misc_feature (385)..(385): n is a, c, t, g, unknown, or other
aaagctggagctccccgcggtggcggccgctctagaactagtggatcccccgggctgcaggaattcgcacgagaccattacctagaacatcctaatcaaaaaatcacagctagctagcatacagacgaataatctcttcttcacctcactaacaccagatagcaactctttctctcctgcaataatggccgctcgctcctcctcctcccagccgcagctggtcgcggcggcggcggtcctggcagcggcgctgctgctgctggcggcgggggccggaacggcgtcgacggcggtgagctgcggcgaggtgacgtcgacggtggggccgtgcctcgggtacgcgatgggcagcgcggcgtcgccctccacggcgtgctgcagcggngtgcgctcgctcaacagccgcgcgtcgtcggcggaggaccggcaggccacctgcaactgcctcaagagcatgacggaccgtctcggcggcggcgtcatacatgaccaacgccgccaacatccccggcaagtgcggcgtctccgtcggggtgcccatcagccccaacgacgactgcaccaagatcaactgatcgatgggaccatagaggaggcagttcactcgttggatggcagcggacgagcccatcaccagcatgcaggcccccctctgaccacagatggcctaa

SEQ ID NO: 11601 - protein, 162 aa, Zea mays
  misc_feature: Ceres CLONE 1362784-F
  misc_feature (39)..(124): Pfam Name: Tryp_alpha_amyl Pfam Description: Protease inhibitor/seed storage/LTP family
MAARSSSSQPQLVAAAAVLAAALLLLAAGAGTASTAVSCGEVTSTVGPCLGYAMGSAASPSTACCSGVRSLNSRASSAEDRQATCNCLKSMTDRLGGGVIHDQRRQHPRQVRRLRRGAHQPQRRLHQDQLIDGTIEEAVHSLDGSGRAHHQHAGPPLTTDGL

SEQ ID NO: 11602 - DNA, 693 bp, Zea mays
  misc_feature: Ceres CLONE 1362786-F
  misc_feature: Translation starting site: 167
aaagctggagctccccgcggtggcggccgctctagaactagtggatcccccgggctgcaggaattcgcacgagaccattacctagaacatcctaatcgaaaaatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagaacgtcgccaagaaccgggagctggaggtgatccactcccgctgggccatgctgggcgcgctcgggtgcgtcttccccgagctgctcgcccgcaacggcgtcaaagttcggcgagggcgggtggttcaaggcccgctcccagatcttcagggagggcgggctggactacctcggaaaccccgacctcatccaccggcaaaacatctttcttatttgggcctggccagtcctgttcatgggccccgtcaagggttacc

SEQ ID NO: 11603 - DNA, 753 bp, Zea mays
  misc_feature: Ceres CLONE 1362788-F
  misc_feature: Encodes the peptide sequence at SEQ ID NO. 11604
aaagctggagctccccgcggtggcggccgctctataactagtggatcccccgggctgcaggatttcgcacgagaccattacctagaacatcctaatcgaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgtcttcagcacctacggcgaggtcctcgagtccaagatcatcctcgatcgggagacgcagaggtcccgcggcttcgggtttgtcaccttctccacggaggaggcgatgccgaacgccatcgagggtatgaacggcaagggagctggacgggccgtaacatcaccgtcaaaggaggcccagtcccgctgctggccgtgaaagggcggcgggcggggcggtctggtgatgggccgctgcaggacatcgcgatatcgctttaggcgcggcgtcccgcgatgggattcggacggcttagggccttaggctggccggcctcaggcgggcgggcggccggcctaacggaggggtttggaggatagtttacgaacgaggggcaaaccgggggcggccggcttaagcgaaagttcgcgcaatttaaagtctgtatgcaaatcgggacgcggggtcgcccttgaggaggaccaagggtattcc

SEQ ID NO: 11604 - protein, 91 aa, Zea mays
  misc_feature: Ceres CLONE 1362788-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNVFSTYGEVLESKIILDRETQRSRGFGFVTFSTEEAMPNAIEGMNGKGAGRAVTSPSKEAQSRCWP

SEQ ID NO: 11605 - DNA, 734 bp, Zea mays
  misc_feature: Ceres CLONE 1362789-F
  misc_feature: Encodes the peptide sequence at SEQ ID NO. 11606
  misc_feature (415)..(415): n is a, c, t, g, unknown, or other
aaagctggagctccccgcggtggcggccgctctagaactagtggatcccccgggctgcaggaattcgcacgagaccattacctagaacatcctaaccgaaaaatccaacccacacacaggctgaccccaccaacagcaagcgaaaatctcccgatcccctctagtctccgcggcgaagatgtcggggcgcggcaagggcgggaagggcctgggcaagtgcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgccgcgnaaggacgtcacagccatggacgtcgtctacgcactcaagcgccagggccggaccctctacgggttccgcgggttagcttaagccggtcgccccccattggcccgccctggcctccttttgtttttgcaatttccaaggttggggctggggggccaaaaaagctgggttattggacccaaaaaaaaaagaatgggtgggcgggggctgaaaaaaaagcgcccttggggcctttggaaaaaaaaaaaaaaaaaagagtttttgggttcccgcccaccccccggagggggggccggcgggccccatattctccccctatagg

SEQ ID NO: 11606 - protein, 105 aa, Zea mays
  misc_feature: Ceres CLONE 1362789-F
  misc_feature (25)..(94): Pfam Name: Histone Pfam Description: Core histone H2A/H2B/H3/H4
MSGRGKGGKGLGKCGAKRHRKVLRDNIQGITKPAIRRLARRGGVKRISGLIYEETRGVLKIFLENVIRDAVTYTEHAPRKDVTAMDVVYALKRQGRTLYGFRGLA

SEQ ID NO: 11607 - DNA, 708 bp, Zea mays
  misc_feature: Ceres CLONE 1362790-F
  misc_feature (400)..(400): n is a, c, t, g, unknown, or other
  misc_feature (438)..(438): n is a, c, t, g, unknown, or other
  misc_feature (439)..(439): n is a, c, t, g, unknown, or other
  misc_feature (476)..(476): n is a, c, t, g, unknown, or other
  misc_feature (505)..(505): n is a, c, t, g, unknown, or other
  misc_feature (554)..(554): n is a, c, t, g, unknown, or other
agagctggagctccccgcggtggcggccgctctagaactagtggatcccccgggctgcaggaattcgcacgagaccattacctagaacatcctaatcgaaaataacttccctgaggaactctttgccgacgctggcatacttgcaattgagcatgctgactttgagggcattgaacggttagctcttgttactggtggtgagatcgcatcaacttttgataatccagagtctgttaagcttgggcaatgcaaggtcattgaagagattatgattggggaggacaggctaatccatttctctggggttgcgatggggcaggcttgcaccattgtcctaaggggggctagtgagcatgtgctcgatgaggctgagaggtccttgcatgatgccttgtgcgtngtgtcccagacggtaaatgatacccgtgtcttgtttgnnagcggatgggctgagatggtgatggcccaagaagtgnatgaacttgcaaggaagacccctgggaangaatcccatgctatcgatgctttctcacatgctctgcaagccatcccancaatcatagctgacaatgctggtttggataacgctgatttgacctctcagctacgagctgagcaccccaaaaaaacctcactggctggaattgaggctcccccgcactggtgggggcatgcaaaatttgggatttcaaaatccttcaaggggaa

SEQ ID NO: 11608 - DNA, 707 bp, Zea mays
  misc_feature: Ceres CLONE 1362793-F
  misc_feature: Encodes the peptide sequence at SEQ ID NO. 11609
  misc_feature (410)..(410): n is a, c, t, g, unknown, or other
  misc_feature (420)..(420): n is a, c, t, g, unknown, or other
caaagctggagctccccgcggtggcggccgctctagaactagtggatcccccgggctgcaggaattcgcacgagaccattacctagaacatcctaatcgaaaaactgacgagctcgccatgacctccctctcctctgccgccggcaccgccccttcgttcaccgtgccagcgccagcccgcggcgtggacagaaggaggcccttcaccgtgcgcgcctctctccgcaaggccaccggcaccgccaccgtgggaatggctgccagcggcctgattgccgactgtgccatggcccagtaggtgatgctgaccgcatgcgacggcggactcatcttctagccagacaggtaacatcaaagacgacgacacttcacatgcaagagctacgctgcatcccgtacacgtcggatcnactaaaaatnagtagcgagctgcgtccacgccccagcactcgcgggaggaatacctgcacgggcaggggaaaactaatcctctccatgaacggccgggaacttaatgcttttatggagagccccttaaggcccgggaggtccggttaaaaacccgcaaaaaaaaaaaagagggcttccggggaaaaccctttggggaaaaacccggggactccccggttttaaacccgcgcggagggtcccctcctcccggggttttttgggcccccccaaaaaaaaaaaaaaaaaagttttttccc

SEQ ID NO: 11609 - protein, 59 aa, Zea mays
  misc_feature: Ceres CLONE 1362793-F
MTSLSSAAGTAPSFTVPAPARGVDRRRPFTVRASLRKATGTATVGMAASGLIADCAMAQ

SEQ ID NO: 11610 - DNA, 673 bp, Zea mays
  misc_feature: Ceres CLONE 1362795-F
  misc_feature: Encodes the peptide sequence at SEQ ID NO. 11611
aaagctggagctccccgcggtggcggccgctctagaactagtggatcccccgggctgcaggaattcgcacgagaccattacctagaacatcctaatcgaaaagattatctgattctgtgatcgagatcgaggccgatcggccaggtttcttgtgcgtgcgctctgctactgccatggcggtagctcaccttcttctccaactctctgccggagtcaatggagctagcaggaacaggatgctcattccagccattctttcgattcttcagcttattcacctcgcagcgctaggcgtggacggagcggcgtcgttcaggttcaccaacgcttgccagcacccggtgtgggtgggcgcgctccacggcgccagctcgccgccgctcgcaagctcgggcttctacctggcgcggtcccgcacgtcccgcctggacgcgccgtcgtcagggacatggtccggcacggtctgggcgcgcacgggctgcgcggtcgattccgcaacggcgctttctctgcgccacgccgactgcggacgggcgacttcccctggccaggccgcgggccgggcccccgttctccttcggcaaggtcccctcccaacgccgggaagcgggggaaagacttcaacaatttaccccccccaagggttaaagggccgggggcgggggcccccggg

SEQ ID NO: 11611 - protein, 166 aa, Zea mays
  misc_feature: Ceres CLONE 1362795-F
MAVAHLLLQLSAGVNGASRNRMLIPAILSILQLIHLAALGVDGAASFRFTNACQHPVWVGALHGASSPPLASSGFYLARSRTSRLDAPSSGTWSGTVWARTGCAVDSATALSLRHADCGRATSPGQAAGRAPVLLRQGPLPTPGSGGKTSTIYPPQGLKGRGRGPP

SEQ ID NO: 11612 - DNA, 732 bp, Zea mays
  misc_feature: Ceres CLONE 1362796-R
  misc_feature: Pfam Name: TFIID-18kDa Pfam Description: Transcription initiation factor IID, 18kD subunit
  misc_feature (1)..(1): n is a, c, t, g, unknown, or other
  misc_feature (619)..(619): n is a, c, t, g, unknown, or other
  misc_feature (732)..(732): n is a, c, t, g, unknown, or other
ncaattgggtaccgggccccccctcgaggtcgacggtatcgataagcttttttttttttttttttgaaaaaaaactgtgcatttttacattgccgaatgtgtggaaacagctgacttcttcactcagcatggcatacagccattaacgcaggaactgtcaagaaaatagataaagtctgtatcggaacagttacaagtcgacaccaaacaattgtccgacacatgcagtgcattgtacaactggttacagtaacacgcagattctacgactaggaaaacatcatatgttagtcgtagccagcgtctcttcatccacgtcaaaagctttccttgcttgcttgagctcttcattcatggacagtagttcagtatcacggtgcacttcccgtaaatccttgcgtataatataaagaaaatcctctgtcacgagcttccccctctttgaggcaacgttctgcgccttgtgcaccaggtcagtgacatattccacaacaatgtcttccacaagtgcaactgtttctggaagtggatttggatcatccccaaagccatacatcatgtgttgaaagtctttctggaagacgccgcgcttgcgcttgagggtggtggcggacgcatnatgtgtggtgttgacaaaatcatcatctgctctgcaccatcagtcgtcgtcaacctacgttcgatctgttgtgagcctgactttttcaataacgacattctaggtaatgatcn

SEQ ID NO: 11613 - DNA, 729 bp, Zea mays
  misc_feature: Ceres CLONE 1362797-F
  misc_feature: Encodes the peptide sequence at SEQ ID NO. 11614
  misc_feature (393)..(393): n is a, c, t, g, unknown, or other
  misc_feature (441)..(441): n is a, c, t, g, unknown, or other
  misc_feature (445)..(445): n is a, c, t, g, unknown, or other
  misc_feature (457)..(457): n is a, c, t, g, unknown, or other
  misc_feature (563)..(563): n is a, c, t, g, unknown, or other
caaagctggagctccccgcggtggcggccgctctagaactagtggatcccccgggctgcaggaattcgcacgagaccattacctagaacatcctaatcgaaaaacacagcaagccagcagagcagaaagcagccgcagccccagcccccacaagacgaggcaacaatggcgctagaagcagccaccgccccccgcgcactcctcgccgcgtgcctcgtcctgctggtcctcggcggcggcaccggcccgtcgtcggtgctgcgcggcgccggggcgcaggccggcgggcagtgcctgccgcagctgaaccgcctcctggcgtgccgcgcgtacctgatgcccggcgcgccggaccccagcgcggactgctgcagcgcgctgagcgccgtgtcncacgagtgcgcctgcagcaccatgggcatcatcaacagcctgcccggncggntgcacctcgccnaaggcaactgctccgcttgaagcagggacctggcacgcctgctgcattggatgggcaggaggggaaaagaaataaaaaaaggtttccatttccaagggagaacaanccaactcccaacgtgggcccccgccgccccttcttcttttaaattcaaaaccttggttggggggttatttttccggtttttaataaaaaaaggggaacccaaaaaaaaaaaaaagtttttttaaccccccccccccggggggggcccggaccaaatttcccaaatg

SEQ ID NO: 11614 - protein, 103 aa, Zea mays
  misc_feature: Ceres CLONE 1362797-F
  misc_feature (43)..(101): Pfam Name: Tryp_alpha_amyl Pfam Description: Protease inhibitor/seed storage/LTP family
  misc_feature (94)..(94): Xaa is any aa, unknown, or other
  misc_feature (98)..(98): Xaa is any aa, unknown, or other
MALEAATAPRALLAACLVLLVLGGGTGPSSVLRGAGAQAGGQCLPQLNRLLACRAYLMPGAPDPSADCCSALSAVSHECACSTMGIINSLPGRXHLAXGNCSA

SEQ ID NO: 11615 - DNA, 699 bp, Zea mays
  misc_feature: Ceres CLONE 1362800-F
  misc_feature: Encodes the peptide sequence at SEQ ID NO. 11616
  misc_feature (373)..(373): n is a, c, t, g, unknown, or other
  misc_feature (471)..(471): n is a, c, t, g, unknown, or other
  misc_feature (498)..(498): n is a, c, t, g, unknown, or other
  misc_feature (507)..(507): n is a, c, t, g, unknown, or other
  misc_feature (548)..(548): n is a, c, t, g, unknown, or other
cagagctggagctccccgcggtggcggccgctctagaactagtggatcccccgggctgcaggaattcgcacgagaccattacctagaacatcctaatcgaaaaatcgcgtctaaacccttgtctccttcttatccccacctccctcgcggatcactcgccgccgccgccggccgcagccatcgccgtgatgctgtccctgtcgagggcgatcgggaggcggctcttctcgtccgccgaggccgcgtcgacggctgcggtgaggacggcgcagaacccgctcgaggagttcttcgaggtcgagcggagcaccgaggagggcaagcctcctccccactacggtcgcagctggaaggcttctgaactgcgactaanatcttgggatgaccttcagaaaatgtggtatggtctttctaaggaaaagaacatgctaatgacacagcgtcaaatgctgcattcagagagcatgaggntccccaatcaagacgaaatttccaggntaagaaatncatgtgccggataaagcatggcttgactgaaaaggctatancggagccgatcccaaggaaaccttccgaaatggaacggatgaaaaggcctggggatcccttccaggaatctcccctggggactttggagggcctttataaaaaaatcggcggcttctgggggaactttttcccccaaaaaacggggaacca

SEQ ID NO: 11616 - protein, 110 aa, Zea mays
  misc_feature: Ceres CLONE 1362800-F
  misc_feature (31)..(105): Pfam Name: MRP-L47 Pfam Description: Mitochondrial 39-S ribosomal protein L47 (MRP-L47)
  misc_feature (62)..(62): Xaa is any aa, unknown, or other
  misc_feature (95)..(95): Xaa is any aa, unknown, or other
  misc_feature (104)..(104): Xaa is any aa, unknown, or other
  misc_feature (107)..(107): Xaa is any aa, unknown, or other
MLSLSRAIGRRLFSSAEAASTAAVRTAQNPLEEFFEVERSTEEGKPPPHYGRSWKASELRLXSWDDLQKMWYGLSKEKNMLMTQRQMLHSESMRXPNQDEISRXRNXCAG

SEQ ID NO: 11617 - DNA, 670 bp, Zea mays
  misc_feature: Ceres CLONE 1362801-F
  misc_feature: Translation starting site: 159
  misc_feature: Pfam Name: Bet_v_I Pfam Description: Pathogenesis-related protein Bet v I family
aaagctggagctccccgcggtggcggccgctctagaactagtggatcccccgggctgcaggaattcgcacgagaccattacctagaacatcctaatctaaaagacacactatataccacagccagtcagccacatcactatatatctgtgcacaggcaatggagtccaaggttgagctggtggtggacgtcaagtccccggctgacaagctgtgcacgacgctccccgactcgacgaagctgttccccaagatcttccccgagcactacaagagcatcgagaccgtcgagggcgacggcaagtccagcggcaccgtccgcctcctcatgacaccgaggcggcgccgatgctgacgctcaccaaggagaagcttgagacggcggacgaccacaacaaggcggagtcatacagcctgtagtacgtagagctgacggacttctacaagaacttcaagatcacgctgaatgtgactccgtccaaggcgtatgtggaagtcggcgccaacttcacctgactcatggagttcgacgaggccaacgaccaggtgcctgacccggacgtcatctaagagacgtgcaccaagacgttcctgcgactctacgactacctcttcaagtatctttatggaccgacaactggaagatggtccaggacacgcacagtttcccga

SEQ ID NO: 11618 - DNA, 572 bp, Zea mays
  misc_feature: Ceres CLONE 1362802-F
aaagctggagctccccgcggtggcggccgctctagaactagtggatcccccgggctgcaggaattcgcacgagaccattacctagaacatcctaatcgaaaaagtgaaagagaggtaggtggccggacggtggtggcatcgccaattcaactccgcatctgaatcggcactcggcagcgcgccagctccataggaggagatggcgctcacaagaaatccgggccttggtggccttggggggcatgggggaaaacctggccccacttggaaaaagggtccccactcttgaaaaaaggaacccccaaggggaaaaacctgaaggggccaagaaaaaaaaacctccccaaaggtttcaaggccccggggctttggaaaacctctaaaaaccccgggggggtaatttttcaaaagggggggcccccttaaaacaaaaaccgggctttttttttttttggggggggggggctctcctcttcgtggggggaaaaagtgtcccacaaacccccgggggggggaaaaaaacctccggggggggcccccccccccccctttttgagagggggcccccgaaa

SEQ ID NO: 11619 - DNA, 680 bp, Zea mays
  misc_feature: Ceres CLONE 1362803-F
aaagctggagctccccgcggtggcggccgctctagaactagtggatcccccgggctgcaggaattcgcacgagaccattacctagaacatcctaatcaaaactgaagtgtccgcgccggctcacggatcggggaactcgaccccaggagagctcggctccggtcacccgtcgatccacgtaaccatgtcgaggaggaagaccagggagcccaaggaggagaacgatacccttgcacccactgtccgtgaacgatagttagactttggtgttgctcacatctttgcatactacaatgacaccttcattcatgacactgatttggctgggaggtaaactttgcatcggataactgatggcatgaacgcaaccgctgatcgtgacgataacgctccttatgctgctatgctatgctgctcaagatgttgcacagcgttgcatagacctcgctatcaccgcactgcacattagacttctggcaactgtaggcatcaagaccaagatgcctgtaccttgctgctatatctgctctcagggctactgctcgttcatgaatgcagattgaacgcatcgacgatgtgaccccggatccaactgacattactcgcataaagtgctgtagtaaggacaagatgcctttagacgttcacccttgctattttgcatcacatagcactggcct

SEQ ID NO: 11620 - DNA, 700 bp, Zea mays
  misc_feature: Ceres CLONE 1362805-F
  misc_feature: Encodes the peptide sequence at SEQ ID NO. 11621
  misc_feature (519)..(519): n is a, c, t, g, unknown, or other
agagctggagctccccgcggtggcggccgctctagaactagtggatcccccgggctgcaggaattcgcacgagaccattacctagaacatcctaatcgaaaacccctctccgatctcgacgcgcaccgatgcgggcgatgtcgtcggcggttaatggtatgctgcgggcacggctgcgcggggcagcgcgcgttcgcggcggcggcggcgagggggccgggcggtggacgaccccaggtcacgaggagcgccccaaggggtacctcttcaaccggccgccgccgcctccgggggaatctcgcaagtgggaggattgggagctgccctgctacgtgacctccttcctcaccgtcgtcatcctcggcgtcggcctcaacgcgaagcccgaccttacaatcgagacgtgggcgcaccagaaggcgctcgagcgcctccagcagcaggagctcgccgctgccgacaccccagccgagtgatccgcgcgtctcaggtcctctcgaactctcggctgcctctganttggttcccatagatggccacaatgtgcggtcctgaatggtctggacttctggtattgatggaacacgagctgaacactatgctgctgttttttctggttccggttggaatttgccggtgatgatggcaatgtcctgaatatcctgatattttgaaggggttgcctgtgaattacctctta

SEQ ID NO: 11621 - protein, 115 aa, Zea mays
  misc_feature: Ceres CLONE 1362805-F
MRAMSSAVNGMLRARLRGAARVRGGGGEGAGRWTTPGHEERPKGYLFNRPPPPPGESRKWEDWELPCYVTSFLTVVILGVGLNAKPDLTIETWAHQKALERLQQQELAAADTPAE

SEQ ID NO: 11622 - DNA, 684 bp, Zea mays
  misc_feature: Ceres CLONE 1362806-F
  misc_feature: Encodes the peptide sequence at SEQ ID NO. 11623
agagctggagctccccgcggtggcggccgctctagaactagtggatcccccgggctgcaggaattcgcacgagaccattacctagaacatcctaatcgaaaactcgagcctgacccttacgccttcgctcgggccgccgccggcgccgtcgctacgccccgcacctcgcttcatttcgtgtcgccgagatgacgaaccgcactaagaaggaaggaattgttggcaaatatggaaccgggtatggtgctagcttgcgtaagccaatcaagaagatggaggtatctcaacattccaagtacttttgccagttctgcgacaagcttgctgggaagatgaaagcattcgtaatttgggggcgcacggactgtgagaagcgtgaaggctggtgccgcttacaccatgaacactgctagcgcgggcaccgtcaggaccacgatccgccgtctgatggagcacactgaagcatgatatagctcttcatatcatgtgcggtttcctgtaagtgctctggtcatgcatgctgtcgaggccttatctattggaaatgtggaatcactgcactgggtgctttgtctggacaatgctccttatatttggtttatgctcgatgatctcaaagatgcgtgaagacttgcccttgattaccgctctgcatctgacaagtgatatctccagtgaccatca

SEQ ID NO: 11623 - protein, 74 aa, Zea mays
  misc_feature: Ceres CLONE 1362806-F
  misc_feature (2)..(74): Pfam Name: Ribosomal_L37ae Pfam Description: Ribosomal L37ae protein family
MTNRTKKEGIVGKYGTGYGASLRKPIKKMEVSQHSKYFCQFCDKLAGKMKAFVIWGRTDCEKREGWCRLHHEHC

SEQ ID NO: 11624 - DNA, 683 bp, Zea mays
  misc_feature: Ceres CLONE 1362808-F
  misc_feature (233)..(233): n is a, c, t, g, unknown, or other
  misc_feature (322)..(322): n is a, c, t, g, unknown, or other
agagctggagctccccgcggtggcggccgctctataactagtggatcccccgggctgcaggaattcgcacgagaccattacctagaacatcctaatcgaaaaagaccaaccaacctcacacctatgtaaccaactgcgtcctaggagtgctggttgatctgctattagagcccgtgtgctaacggaaacgaagaaccagaacatggatggcctgctgccgttcctgtacctgntgatgctccacctcttccagcggcgatcagtcgcccatcggcaaccccttcttccgatacgactccccgcaggagacgccgctggccangcactactacgtccccctctccaccggcgtcgagatgctggacttcctctcctggacggcgcgcggctactacaagccgtgctgatacctcggacgccaccacaaaagactctggacctgcacgtgcgaacaggaagaatcctcgcgcgctccttcagttggctgttcagagttctgcagtctcctcccctcttcttgtggcttcatgaagattctcctacccctacccctcctatgatcctagcaataaaagcatgaacggatgaggtcctgccatacaggtgaacccgggcattatctccattagattaggtccatatatgacgagaccaatgaaaaaagaaacaattttatcctggcc

SEQ ID NO: 11625 - DNA, 682 bp, Zea mays
  misc_feature: Ceres CLONE 1362814-F
  misc_feature: Encodes the peptide sequence at SEQ ID NO. 11626
aaagctggagctccccgcggtggcggccgctctagaactagtggatcccccgggctgcaggaattcgcacgagaccattacctagaacatcctaatcgaaaaatccagattcggacccgaccggcgatccatccaaatcacccttcgccttccccttccaccaccaccagggcggcgcctcgtgacctcaattctcctttcgaatttagaatccccgtgctgagagctgagtgccgccttggttgctccgaactggactcgattcctcatcgcagtagaagaatcccgtcccctccgcttctccttgctctgctctgctaacacgcagacaaaaaaaatagcagcatgtcggaggtgaaggactccaatgcgcctgctgcactggatggaaatcctcaagctatggaccaaactgaagacaattctatgccctcagcacagcaacgggaagaagcaatcaagaataaggttggaggagtaatgcccaaaaagcccccactcatctcataggatcctgagcgggcctactatgattctgctgactgggctctagggaagcaaggtgttgccaaaccaaaaggaccgctgcaggcacttaggcccaagcttcggccaacacgccaacaacagcaacaacgtgcaaggcgccctatttacacttcgtcagaagacgaggacggag

SEQ ID NO: 11626 - protein, 54 aa, Zea mays
  misc_feature: Ceres CLONE 1362814-F
MSEVKDSNAPAALDGNPQAMDQTEDNSMPSAQQREEAIKNKVGGVMPKKPPLIS

SEQ ID NO: 11627 - DNA, 751 bp, Zea mays
  misc_feature: Ceres CLONE 1362815-F
  misc_feature: Encodes the peptide sequence at SEQ ID NO. 11628
  misc_feature (308)..(308): n is a, c, t, g, unknown, or other
  misc_feature (364)..(364): n is a, c, t, g, unknown, or other
  misc_feature (717)..(717): n is a, c, t, g, unknown, or other
aaagctggagctccccgcggtggcggccgctctagaactagtggatcccccgggctgcaggaattcgcacgagaccattacctagaacatcctaatcgaaaaatcgccatcgacctcctcgatccagacagcgggcagcagccatgtccaaggtcttcaccctcgacgcggtcgccaagcacaactccaaggaggattgctggctcatcatcggcggcaaggtgtatgatgtgacgaagtttttggtagaccacccaggaggtgatgatgttctgttgtcctcaactggcaaggatgcgactgatganttcgagggatgtcgtcacagcaacactgcccgcgcgatgatggatgagtacttggntgggtgaatcgacggcggcgacgatccccttcaggacgaaataatgcccccccgaaaaacccggcctaaaaacggggcaaaaattccccaagttttgcatccaaaatccccccagtttttggttccccccgggaaacccggggttttgggttgttcccctaaaaaagaaccccaaagcgggagcccgtttaaatttttttggcccatttttcctttgcccccctccggggttggggacagcaaaattttgtaaaaaaaacaaacaaaaagttgtggggggggttttataaaggggggaagtggcccccaaaaactcccgaagattttcccccgcgggggggggtctttgtggnaaaaaggggggcggaaaactttccccctcgttaa

SEQ ID NO: 11628 - protein, 75 aa, Zea mays
  misc_feature: Ceres CLONE 1362815-F
  misc_feature (4)..(74): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
  misc_feature (55)..(55): Xaa is any aa, unknown, or other
  misc_feature (74)..(74): Xaa is any aa, unknown, or other
MSKVFTLDAVAKHNSKEDCWLIIGGKVYDVTKFLVDHPGGDDVLLSSTGKDATDXFEGCRHSNTARAMMDEYLXG

SEQ ID NO: 11629 - DNA, 737 bp, Zea mays
  misc_feature: Ceres CLONE 1362817-F
  misc_feature: Encodes the peptide sequence at SEQ ID NO. 11630
  misc_feature (737)..(737): n is a, c, t, g, unknown, or other
agagctggagctccccgcggtggcggccgctctagaactagtggatcccccgggctgcaggaattcgcacgagaccattacctagaacatcctaatcgaaaaatcctgtagctcaaacacacgaagcgccccaagaagcagcagcgtaggagcgcgggatcgctatggctcagggaagaggcagtgcgacgcgggggcttgccctcggcgccctactcgccgccgctttcctcctcctcctcggcgtctccgacgcggccacccacaggggcgactggtccttcaacgcggacagctggcccaacgtcaagagcttccgcgccggcgacgtcctcgagtacaactacgacccctccgtgcacaacgtgatggccgtggacggcggggggtacaaccgctgccggcccgccggcacgtcgtacggttctcgggagcggacggatcacgatccggccccggaaccaggtaattcctctgaagccttcacccgccctgccggaaaggggattaacatggtcctcaatgcccgcaggccaacaaccccttaaaggttgggacacgccaaaaaaatttgggctcaaaagggggcccgggccattcccggctaaaaaacccaaccggggggggaaaacccccccacccaggaggtccaaaggaaacccggccccctggggggggggaaaacgaaatatgcaaactgccgtgaaaaacacccgcggtttctcccccggggggcn

SEQ ID NO: 11630 - protein, 127 aa, Zea mays
  misc_feature: Ceres CLONE 1362817-F
  misc_feature (38)..(117): Pfam Name: Cu_bind_like Pfam Description: Plastocyanin-like domain
MAQGRGSATRGLALGALLAAAFLLLLGVSDAATHRGDWSFNADSWPNVKSFRAGDVLEYNYDPSVHNVMAVDGGGYNRCRPAGTSYGSRERTDHDPAPEPGNSSEAFTRPAGKGINMVLNARRPTTP

SEQ ID NO: 11631 - DNA, 678 bp, Zea mays
  misc_feature: Ceres CLONE 1364035-F
  misc_feature: SWISSPROT Homolog: EC 3.4.25.1 Proteasome endopeptidase complex
  misc_feature (476)..(476): n is a, c, t, g, unknown, or other
  misc_feature (503)..(503): n is a, c, t, g, unknown, or other
  misc_feature (515)..(515): n is a, c, t, g, unknown, or other
  misc_feature (588)..(588): n is a, c, t, g, unknown, or other
tggagctccccgcggtggcggccgctctagaactagtggatcccccgggctgcaggaattcgcacgagaccattacctagaacatcctaatcgaaaaacccttttcattttttcttccccatcttggagaagaagaaggcccgacgccctcgccgctgccaccaaaatcgcacgcgagccccaaagatccccaaaccctacacccgcccgccggcgcactcggggaccgtcgaatcgagcaggttgacggaggagaggaagcctcgaagatgttccggaaccagtacgacaccgacgtgacgacatggagcccccaggggcggctgttccaggtggagtacgccatggaggccgtcaagcagggctcagcctgcgtcgggctccggtccagcactcacgccgtcctcgccgccgtcacaagcccgtctccgagctctcctccctacagcggaaggtgtccgcgtcgctgaccacgnccgggtcgcgctcgccgggctcaccgncgacgggcgcgntctctcgcgcttcctccggacgagtggatcaaccactccttcgtctacgaaggcgcgctccccgtctccaggntcggggtcaagtcgccgacaggggcaggtttgcacccagcggtcatggaaaaggcccatgggggtggccccctaattgctggactggaca

SEQ ID NO: 11632 - DNA, 794 bp, Zea mays
  misc_feature: Ceres CLONE 1364042-F
aatataatatccctattcccccctttttcttacgttcccccctgttttcccttcaaagctggagctccaccgcggtggcggtcgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggtatctacggcggcgcccacgccacctacgggcagcagcagtagcagggaggaggcggccgcccgatgggtgagcacgtgaagggcatgctctacgacaaggcgtcgacggtgttttattgtgctgacggtggtgaatttgttcccgctgggagggtttgatgctggtgctgtcgcggcctggcgctgaacggcctccgtgctgggcgtgcccgcggccacgccggtggtcccgatcttcacccccgcgtttcttcccccctcgagttgctccactcttcaccgatattccccgggcgctccctcaacccccggtagagatttcccccatcacggtttctgctactcgttttaccccgtaatctgcatacacccctgtcgttcaccccctgtttatcccgaactctcgtgtattaccccccccggtcggctgtaacccctctagcccggtgttgaacccccctccccccccccccttgtcttttcctacatatcccccccccccccctgttc

SEQ ID NO: 11633 - DNA, 686 bp, Zea mays
  misc_feature: Ceres CLONE 1364063-F
  misc_feature: Encodes the peptide sequence at SEQ ID NO. 11634
  misc_feature (419)..(419): n is a, c, t, g, unknown, or other
  misc_feature (427)..(427): n is a, c, t, g, unknown, or other
  misc_feature (429)..(429): n is a, c, t, g, unknown, or other
  misc_feature (463)..(463): n is a, c, t, g, unknown, or other
  misc_feature (478)..(478): n is a, c, t, g, unknown, or other
tggagctccccgcggtggcggccgctctagaactagtggatcccccgggctgcaggaattcgcacgagaccattacctagaacatcctaatcgaaaaaccttcctccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggttcgagaaggaggctgctgaaatgaacaagcggtccttcaagtacgcgtgggtgctcgacaagctcaaggctgagcgtgagagaagtatcaccattgatatcgctctgtgggagttngagaccancnagtactactgcacggtcattgatggccctggacnacgtgacttcatcanggccatgatcactggtacctccagggctgactgggctgccctaatcattgactccaccacgggggtttttgaggtggaatttcaagggtgggcaaacccggaaaatggtttccttggtttaccctttggaggaaccaaaagatttcttgtgtcacaaatgggtggcaccctccccaaatccccaggggcttttttaaaaaatttggaa

SEQ ID NO: 11634 - protein, 169 aa, Zea mays
  misc_feature: Ceres CLONE 1364063-F
  misc_feature (5)..(159): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (80)..(80): Xaa is any aa, unknown, or other
  misc_feature (83)..(83): Xaa is any aa, unknown, or other
  misc_feature (84)..(84): Xaa is any aa, unknown, or other
  misc_feature (95)..(95): Xaa is any aa, unknown, or other
  misc_feature (100)..(100): Xaa is any aa, unknown, or other
MGKEKSHINIVVIGHVDSGKSTTTGHLIYKLGGIDKRVIERFEKEAAEMNKRSFKYAWVLDKLKAERERSITIDIALWEXETXXYYCTVIDGPGXRDFIXAMITGTSRADWAALIIDSTTGVFEVEFQGWANPENGFLGLPFGGTKRFLVSQMGGTLPKSPGAFLKNLE

SEQ ID NO: 11635 - DNA, 696 bp, Zea mays
  misc_feature: Ceres CLONE 1364065-F
  misc_feature: Encodes the peptide sequence at SEQ ID NO. 11636
  misc_feature (330)..(330): n is a, c, t, g, unknown, or other
  misc_feature (475)..(475): n is a, c, t, g, unknown, or other
tggagctccccgcggtggcggccgctctagaactagtggatcccccgggctgcaggaattcgcacgagaccattacctagaacatcctaatcgaaaaagtttctatcttgctccccaaaccagcgcaaaccctgccctgacaccggcagcgacacgtccaccggcggcgccatggtgctcgaggcaacgatgatctgcatagacaattcggaatggatgcggaacggcgactacgctccgtcgcggttccaggcgcaggccgatgccgtcaacctcatctgcagcgccaagacccagtcaaacccggagaacacggtaggcgtgatgacnatggccgggaagggtgttcgcgtgcttgtcactcccaccagcgacctcgggaagattctcgcctgtatgcacgggttagaaagttgcgctgaggcaaacttgggctgcgcaatccaggtgcccagctggctctaaagcatcgccngaccaagagcagcagcagaggatatagctttcatgggaggtctgggagaacaacaagaaagttttgaaacccttgggaaaaaactgaaaaaaaacaggtggccctggaaattttgaactttgggggaaccccaggagaaaaacctgaaaaacggaaacttggttttgggttgttaaccccggggaaaccccccctttgtttatcccccccgggggaaaaag

SEQ ID NO: 11636 - protein, 97 aa, Zea mays
  misc_feature: Ceres CLONE 1364065-F
MVLEATMICIDNSEWMRNGDYAPSRFQAQADAVNLICSAKTQSNPENTVGVMTMAGKGVRVLVTPTSDLGKILACMHGLESCAEANLGCAIQVPSWL

SEQ ID NO: 11637 - DNA, 673 bp, Zea mays
  misc_feature: Ceres CLONE 1364085-F
  misc_feature: Encodes the peptide sequence at SEQ ID NO. 11638
  misc_feature (626)..(626): n is a, c, t, g, unknown, or other
  misc_feature (644)..(644): n is a, c, t, g, unknown, or other
aaagctggagctccccgcggtggcggccgctctagaactagtggatcccccgggctgcaggaattcgcacgagaccattacctagaacatcctaatcgaaaagttccgcaccccacggcaggcgcttgagagtacttgactactaccctcccacctgcgagactgcaacgccgttgcttcaactcgactccagcatccctcgtccccgcatcaccgcgccgccgacactccgctcgctttcgctcccgagacccgggcctgccgagccgccgccatggacgaggagtacgacgtgatcgttctgggcacggggctcaaggagtgcatcctcagcggtctcctctctgtcgacggcctcaaggttctacacatggatagaaatgattactacggaggagattccacctccctaaacctgaaccagctctggaagaggtttaggggggaagacaagccaccggcacatctaggtgcaagcagagattacaatgtagacatggtttcaaagtttatgatggcaaacgggactttggttcgcactctcattcacactgatgtgacaaaatatttgtcatttcaagctggtgatggaagctatgtcttcagcaaacggaaagatcacaggntcctgcccacgatatggnagctctaaatctccctttgatggtctatt

SEQ ID NO: 11638 - protein, 125 aa, Zea mays
  misc_feature: Ceres CLONE 1364085-F
  misc_feature (1)..(123): Pfam Name: GDI Pfam Description: GDP dissociation inhibitor
  misc_feature (118)..(118): Xaa is any aa, unknown, or other
  misc_feature (124)..(124): Xaa is any aa, unknown, or other
MDEEYDVIVLGTGLKECILSGLLSVDGLKVLHMDRNDYYGGDSTSLNLNQLWKRFRGEDKPPAHLGASRDYNVDMVSKFMMANGTLVRTLIHTDVTKYLSFQAGDGSYVFSKRKDHRXLPTIWXL

SEQ ID NO: 11639 - DNA, 707 bp, Zea mays
  misc_feature: Ceres CLONE 1364087-F
  misc_feature: Translation starting site: 261
aagctggagctccccgcggtggcggccgctctagaactagtggatcccccgggctgcaggaattcgcacgagaccattacctagaacatcctaatcgaaaaaatccctcgtgtccctccccagatccaatatcgccgcaggaccaagcatcccatccatgcggtgattgatcttcttgcgggacgacagataagccctctccctctctcactcctctgagtgatgcctttttttttcgatcccagcggtaggccgagagaatgtcccctgggaaaagggactactcgatccaggatatggctcgcctgccaggaccaacaatagtactcgacccccaaatacagagtggcctgtgccagacaccaacaaggacatcacaccacaaatcatctctggtagcatactaggcgatacgtcccttgctactgcttacacccatgagccgccacgagatggtcttgaagttgctctgaccaactatgcagctgcctactggactgtacttctgctgcttcaccgagtgctcaacacccgtggattatataaggaatatgacgccaatgctgagggcactgtggaggatttctctgtccagacagctgatgagagcaggcctctccgtgatctcttgtatggtgcgcttattaggactactactggcaaccgcgtcttcgctgccctccaggtagctgtggatggagttctga

SEQ ID NO: 11640 - DNA, 688 bp, Zea mays
  misc_feature: Ceres CLONE 1364088-F
  misc_feature: Encodes the peptide sequence at SEQ ID NO. 11641
  misc_feature (517)..(517): n is a, c, t, g, unknown, or other
aaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggtggaaaacaccacggagtgccggaggagctgatgggcggcatgctccgcggggtgcgccagttcaaaggnccccccggggagagggaaaaaaagcgtccttactccgagggacctcgctcgcaacctgcggcttcgcctccaacttcgacctcttcaaggctgctggcggccgactggcgcgacacgctcctttttgcgaggtggctccgaacccgcccgccccggggagggagctgccgg

SEQ ID NO: 11641 - protein, 180 aa, Zea mays
  misc_feature: Ceres CLONE 1364088-F
  misc_feature: SWISSPROT Homolog: EC 1.14.11.20 Desacetoxyvindoline 4-hydroxylase
  misc_feature (124)..(124): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWWKTPRSAGGADGRHAPRGAPVQRXPRGEGKKASLLRGTSLATCGFASNFDLFKAAGGRLARHAPFCEVAPNPPAPGRELP

SEQ ID NO: 11642 - DNA, 694 bp, Zea mays
  misc_feature: Ceres CLONE 1364097-F
  misc_feature: Encodes the peptide sequence at SEQ ID NO. 11643
  misc_feature (306)..(306): n is a, c, t, g, unknown, or other
  misc_feature (421)..(421): n is a, c, t, g, unknown, or other
  misc_feature (431)..(431): n is a, c, t, g, unknown, or other
tggagctccccgcggtggcggccgctctagaactagtggatcccccgggctgcaggaattcgcacgagaccattacctagaacatcctaatcgaaaaaatctgacggtggcagtgacgactccaacgaccaggcgcggaggctgcactgctccagcgaaggcaccatgtcattcatgtctccattcccggggatggatctaagtaaaatggatcccgggactctgaccctccttggggcagctggttgtgtaatgctgactatgcatttcactgtgcaattggtgtcacaacatctcttctattgnaaaacccccaggagcagaaagccatacttattattgtgctgatggctccactatacgctatctcttccgtcgggggtcttcttgatatccaggtagcaagacatttttcacattnctagatgctngtaaagaatgctatgagggactggggaatgctaagttaatggcatggagaaccgctacttggaaatatctttcaccaaaaacttagccccctgaggaatcaaggggaaggggttcaacatttccctcccgggtttccttttcccggcccgaagggcccaatggggacaaaaaaattgaatttttgaaaatttgcccccggaaattttttttttaaggcccaatttccccttctaaaattggccccccctttttgggggggccc

SEQ ID NO: 11643 - protein, 60 aa, Zea mays
  misc_feature: Ceres CLONE 1364097-F
  misc_feature (47)..(47): Xaa is any aa, unknown, or other
MSFMSPFPGMDLSKMDPGTLTLLGAAGCVMLTMHFTVQLVSQHLFYXKTPRSRKPYLLLC

SEQ ID NO: 11644 - DNA, 669 bp, Zea mays
  misc_feature: Ceres CLONE 1364117-F
  misc_feature: Encodes the peptide sequence at SEQ ID NO. 11645
  misc_feature (651)..(651): n is a, c, t, g, unknown, or other
  misc_feature (652)..(652): n is a, c, t, g, unknown, or other
caaagctggagctccccgcggtggcggccgctctagaactagtggatcccccgggctgcaggaattcgcacgagaccattacctagaacatcctaatcgaaaagtccttgtgcgttccttgtagccatctccgactccgcgcctccgctgcctcccgaaagcattgccagttcctccgcacaacatgacgcgcatccaccgcctccgccccctcttcctcttcgttctcttggcgtcgctgcaatgcggtgcggcgacggcggcggctggatacggaggtggcgccgaggggttctgctcggcggagccgtccagcaagtgctccggggatcagccgctctactggaaggtcacccatcccaccctcgcgcccgcgcacctccaagatttacctggcttcacacgtagtgttttcaaaagggatcatgctttaataacaccagagagtcatgtattcagtcctttgcctgattggatcaatacagtaggagcatatttgatcagtccagctattggtgcacacttcattatgtatctagcaaacatgcaagatggttcaaaatcagccctaccaccgaaagatgtttgaaaggtttgtttttgtactacaaggggagcatttcattgactgtggggactggaactatcatnntctctgctggtggattt

SEQ ID NO: 11645 - protein, 134 aa, Zea mays
  misc_feature: Ceres CLONE 1364117-F
MTRIHRLRPLFLFVLLASLQCGAATAAAGYGGGAEGFCSAEPSSKCSGDQPLYWKVTHPTLAPAHLQDLPGFTRSVFKRDHALITPESHVFSPLPDWINTVGAYLISPAIGAHFIMYLANMQDGSKSALPPKDV

SEQ ID NO: 11646 - DNA, 686 bp, Zea mays
  misc_feature: Ceres CLONE 1364131-F
  misc_feature: Encodes the peptide sequence at SEQ ID NO. 11647
aaagctggagctccccgcggtggcggccgctctagaactagtggatcccccgggctgcaggaattcgcacgagaccattacctagaacatcctaatcgaaaactaccgagttttccttccccacctccccgccccacccgtcgccgaatcggagtcccgctcgcgtccacccttgccagagctcaagagctacctcctggtccggttggacagatcccttcgggcgctgcgtccaccgggattcaggcaaagtggtgtaacataagatgcaagggggaagaggcgccaggcagggtttgttcggctttggggacccttttggtggtttcggcggctttggacagccagggaacataatgtccggtttctttggtggcgcatatccctttgatgaccctttcttcacaaacccctttggtggaatgatgcaacctagtttctcaacccctttcagcggcatgatgcaacctagcttcatgaacccctttggcagcatgatgcaacctagcttgcttggatcaagtatgtttgcagcccatggcaatctcaatggaggtacttttgcaagccagacacatctcattcgaggcatgagcaatgccagtggtttcattcagcaagcctctgaatcgagcaggcctagagggccaattatcaaggagttgtcttcttatgacgaggataat

SEQ ID NO: 11647 - protein, 140 aa, Zea mays
  misc_feature: Ceres CLONE 1364131-F
MQGGRGARQGLFGFGDPFGGFGGFGQPGNIMSGFFGGAYPFDDPFFTNPFGGMMQPSFSTPFSGMMQPSFMNPFGSMMQPSLLGSSMFAAHGNLNGGTFASQTHLIRGMSNASGFIQQASESSRPRGPIIKELSSYDEDN

SEQ ID NO: 11648 - DNA, 622 bp, Zea mays
  misc_feature: Ceres CLONE 1364131-R
  misc_feature (235)..(235): n is a, c, t, g, unknown, or other
  misc_feature (309)..(309): n is a, c, t, g, unknown, or other
  misc_feature (361)..(361): n is a, c, t, g, unknown, or other
caattgggtaccgggccccccctcgaggtcgacggtatcgataagcttttttttttttttttttagaagtaagaaaattcagttatcaaagctggaaataccacaagccacaacagatgataccacaacaatccagacacatcttgtcttctactaacactctttaactcatagaagaatcggtcttgaaccaactaacttgacggcgtcagcctagttagtttgactccatccnagattagcagtgattccccagcattttttgcgcttccctccctctctgcttatatcctccaatggtcccctgcngtgccaaatttgctctcaagctgtggaaccatggggcccctgcccgatgagnccctatggaattggaaaaatgttaggtccttgaaattagcctatatcctctaccccccaagacaatgagaaaggggctccaccataaatcctcccgccccccaaaattgactttaaaacctctctgaaagaggccaaaaccctccttgaaaacacatttgggagccctttgtttaaacctgccggaaattttttcccccccccacctgggggtgacaacaacatccccctgggatttaaaccccaggggttttgtatgggg

SEQ ID NO: 11649 - DNA, 712 bp, Zea mays
  misc_feature: Ceres CLONE 1364136-F
  misc_feature (347)..(347): n is a, c, t, g, unknown, or other
  misc_feature (375)..(375): n is a, c, t, g, unknown, or other
  misc_feature (393)..(393): n is a, c, t, g, unknown, or other
aaagctggagctccccgcggtggcggccgctctagaactagtggatcccccgggctgcaggaattcgcacgagaccattacctagaacatcctaatcgaaaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcanccacccgcagctagcccgtgccagcagntcggatcctgcggcgtcngcagcgtcggcagcccgttcctggggcagtgcgtcaagtccctgaggaccatggaagccgggggggaacccctacggttcgccaaagggcaaggggttgaaaaacggggttcccccaaaaagggaagggggacccgttgccccggaacaggggaaaaagagggggggccctggaacctttccgggaaaaaaaccccgggggagatttccgggttttttggggccccccaaaggcaaaattttaccggaatggtgggttttaaaattaaaaaacaaatcccctccctttgaaaaaattgggggggggggatataatgaaa

SEQ ID NO: 11650 - DNA, 691 bp, Zea mays
  misc_feature: Ceres CLONE 1364138-F
  misc_feature: Encodes the peptide sequence at SEQ ID NO. 11651
  misc_feature (394)..(394): n is a, c, t, g, unknown, or other
  misc_feature (411)..(411): n is a, c, t, g, unknown, or other
  misc_feature (447)..(447): n is a, c, t, g, unknown, or other
tggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtncgggctggcgctgacgnccctcgtggtggggctggccgttgccacgccggtgntcctgatcttcagccccgtggtcgtcccccgcgggctgctcatcgggacgcccggcatggggtccctcccgtcggggggcctggggtctcggggcctgtcctcccttcaggggccccccaaaacggggggggagggggttccaggggcccccgaataagggggggggggccccccaagattggggaggccccgggaccccgggccccaaaaaccgcgaggagggccggcccccccggggggggg

SEQ ID NO: 11651 - protein, 134 aa, Zea mays
  misc_feature: Ceres CLONE 1364138-F
  misc_feature (44)..(135): Pfam Name: Oleosin Pfam Description: Oleosin
  misc_feature (65)..(65): Xaa is any aa, unknown, or other
  misc_feature (71)..(71): Xaa is any aa, unknown, or other
  misc_feature (83)..(83): Xaa is any aa, unknown, or other
MADRDRSGIYGGAHATYGQQQQQGGGGRPMGEQVKGMLHDKGPTASQALTVVTLFPLGGLLLVLXGLALTXLVVGLAVATPVXLIFSPVVVPRGLLIGTPGMGSLPSGGLGSRGLSSLQGPPKTGGEGVPGAPE

SEQ ID NO: 11652 - DNA, 668 bp, Zea mays
  misc_feature: Ceres CLONE 1364148-F
  misc_feature: Encodes the peptide sequence at SEQ ID NO. 11653
  misc_feature (553)..(553): n is a, c, t, g, unknown, or other
  misc_feature (554)..(554): n is a, c, t, g, unknown, or other
  misc_feature (596)..(596): n is a, c, t, g, unknown, or other
  misc_feature (597)..(597): n is a, c, t, g, unknown, or other
aagctggagctccccgcggtggcggccgctctagaactagtggatcccccgggctgcaggaattcgcacgagaccattacctagaacatcctaatcgaaaaacacgatctctcctcgacggctaacccggattgccgtctcaagctcgggatccgggcgctcgcggcgatggacggcggcggcggcgctggcggcgcggagggggagctcacggcgcaggagacagcgctctacgaccgccagatccgcgtctggggcgtcgatgcccagaagagactaagtaaggcgcacgtgcttgtttgtggcatgaacggaaccaccatcgagttctgcaagaatattgttctagctggagttggaagtttatccttgatggatgataatgtagtcacagaggaggatctgaatgcaaatttcttaattcctcctgatgagagcatatatggtggtagatctcgagcccaagtttgctgcgagtctttgatagatttcaatcctatggttagagtttctgttgaaaagggtgatccatcattaattgatggagaatccnntgacaagttcgacatttgtgtacttagccgtgcatctcttannaacaaagtgtgattaatgaaactgtcgaaagagagcaacatattgcatttatactatagattggcaggatc

SEQ ID NO: 11653 - protein, 146 aa, Zea mays
  misc_feature: Ceres CLONE 1364148-F
  misc_feature (129)..(129): Xaa is any aa, unknown, or other
  misc_feature (143)..(143): Xaa is any aa, unknown, or other
MDGGGGAGGAEGELTAQETALYDRQIRVWGVDAQKRLSKAHVLVCGMNGTTIEFCKNIVLAGVGSLSLMDDNVVTEEDLNANFLIPPDESIYGGRSRAQVCCESLIDFNPMVRVSVEKGDPSLIDGESXDKFDICVLSRASLXNKV

SEQ ID NO: 11654 - DNA, 605 bp, Zea mays
  misc_feature: Ceres CLONE 1364150-F
  misc_feature (422)..(422): n is a, c, t, g, unknown, or other
  misc_feature (503)..(503): n is a, c, t, g, unknown, or other
ccccgcggtggcggccgctctagaactagtggatcccccgggctgcaggaattcgcacgagaccattacctacaacatcctaatcgaaaagctcttaaacgtttctccagagcctgaaccccaatctagggggcttgcttcatctgctgtccgagggtggatagatttctcggagctgccgacgttgcaacgagctcaccatgagattccagccgaaatctgccacggtagctcttgcctatgggaggcgctgcggtgagacccttgcgtattttcgttgtttcttttgagctgcgatcttgtgcggggtagactcccccccaatccggaatcatccggcgtctatgatatcgccaccccgtttgcttatgtgatcgactagtgtcttctcaccatcctgggtagaaagaatatcagaaggngcgatctttttttctctgcctgtgcgcctactacgcctgcagacataatgagtgcaactgatagagctcgagcgatagacnatgaaatactatgaaatgtgcatgcccctggccgcccgttttctgatgcgaaaacccatgggggcatgggccctgtagtggaccagttaggtcgagtcaact

SEQ ID NO: 11655 - DNA, 656 bp, Zea mays
  misc_feature: Ceres CLONE 1364165-F
  misc_feature (587)..(587): n is a, c, t, g, unknown, or other
  misc_feature (594)..(594): n is a, c, t, g, unknown, or other
tggagctccccgcggtggcggccgctctagaactagtggatcccccgggctgcaggaattcgcacgagaccattacctagaacatcctaatcgaaaaattggatttgccccagtgtactacagactcgacaggtgagcataaaagaggagagccgataagcacaatggcgcctgaggaaaggatgaagcagacagagggcagtcacaaggtggtaacagcagcaggtggcaagatggcggtcggagtgaggagcatcgtgacctcccttggctttcttcatcctagccagctccgtcgtgttcctcctcctcgacagagaagccgggctccaagaagaacaggcgataagagccggcggcggcgacgaggagtgcagctggtctcgggggcgctgggtgtacgacaacgtgtcccggccgctgtacgacgggctcaagtgcgccttcatcttccccgaggtggcctgtgacaagtatgggcaggaaggatgtcatgtaccagcactggagatggcagcctcatggtcatggatgcgacctcccaagattcgatggcatcaagctgcttgaggagctgagaaaagagnaactggntgtttgtggggcgactcggtgaaaggaaaccaatgggtctctctcgtgggggcagtggtgga

SEQ ID NO: 11656 - DNA, 648 bp, Zea mays
  misc_feature: Ceres CLONE 1364180-F
  misc_feature: Encodes the peptide sequence at SEQ ID NO. 11657
  misc_feature (382)..(382): n is a, c, t, g, unknown, or other
  misc_feature (400)..(400): n is a, c, t, g, unknown, or other
  misc_feature (436)..(436): n is a, c, t, g, unknown, or other
  misc_feature (437)..(437): n is a, c, t, g, unknown, or other
  misc_feature (461)..(461): n is a, c, t, g, unknown, or other
tccccgcggtggcggccgctctagaactagtggatcccccgggctgcaggaattcgcacgagaccattacctagaacatcctaatcgaaaacagttcgccaccatcgtgctccgtacacgctccgctccggccatggccgccgccgcggcctccttttcggccctgccgttccttctacttttgctgctggtgccgtcgctcgacggcgcctccaatgtgacgtacgaccaccgctccctcatcatctccggccgccgccgcctcgtcatctccacctccatccactacccccgcagcgtccccgagatgtggcccaagctggtggctgaagccaaggacggcggcgccgactgcatcgagacctacgtcttctggaacggncatgagatcgccccaggncagtactacttcgaggaccggtttgacctggtgcgnntcgtgaaggtcgttagagacgctnggctgctcttgatcctgcgcatcgggccctatgtcgcccgcgagtggaatatggaggccctgccggtgtggttgccctacgtgccaagaaacggttttcagacaaacaccgagccattcagaaccttattgagagttcccgacttactccgggaaatgatgaaaaaaaccattcttcctttccagga

SEQ ID NO: 11657 - protein, 171 aa, Zea mays
  misc_feature: Ceres CLONE 1364180-F
  misc_feature (35)..(166): Pfam Name: Glyco_hydro_35 Pfam Description: Glycosyl hydrolases family 35
  misc_feature: SWISSPROT Homolog: EC 3.2.1.23 Beta-galactosidase
  misc_feature (102)..(102): Xaa is any aa, unknown, or other
  misc_feature (110)..(110): Xaa is any aa, unknown, or other
MAAAAASFSALPFLLLLLLVPSLDGASNVTYDHRSLIISGRRRLVISTSIHYPRSVPEMWPKLVAEAKDGGADCIETYVFWNGHEIAPGQYYFEDRFDLVRXVKVVRDAXLLLILRIGPYVAREWNMEALPVWLPYVPRNGFQTNTEPFRTLLRVPDLLREMMKKTILPFQ

SEQ ID NO: 11658 - DNA, 703 bp, Zea mays
  misc_feature: Ceres CLONE 1364184-F
  misc_feature: Encodes the peptide sequence at SEQ ID NO. 11659
  misc_feature (1)..(1): n is a, c, t, g, unknown, or other
  misc_feature (492)..(492): n is a, c, t, g, unknown, or other
  misc_feature (673)..(673): n is a, c, t, g, unknown, or other
  misc_feature (682)..(682): n is a, c, t, g, unknown, or other
  misc_feature (683)..(683): n is a, c, t, g, unknown, or other
  misc_feature (688)..(688): n is a, c, t, g, unknown, or other
naaagctggagctccccgcggtggcggccgctctagaactagtggatcccccgggctgcaggaattcgcacgagaccattacctagaacatcctaatcgaaaacacgatcacacaccactccacagcagtagcaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgatcgccgaggcgaggaacatcaagaccacgacgacggagaagaaggacgacgcggtggtgcagccgcagaccttcccgcccttcgaccgcctcggcggcggcgcgtccccggcgttcggcggcctccccggcggcagcattcctggcagcagcattncccgggttcagcatgcccggcagcggcagcagcctacccgggttcagcttgcccggcagcggcagcatgccccctcttcggcggcggctccccgggcttgcggggcttcggcgggaaatgcccgggtcccccacccgccggctccgtcccccgagcacgccaacaagccctgaacgcaacnaagcgtggnnaaaantagagtggtgctact

SEQ ID NO: 11659 - protein, 130 aa, Zea mays
  misc_feature: Ceres CLONE 1364184-F
  misc_feature (74)..(74): Xaa is any aa, unknown, or other
MARSSKMMVAAALLALALAVSIAEARNIKTTTTEKKDDAVVQPQTFPPFDRLGGGASPAFGGLPGGSIPGSSIXRVQHARQRQQPTRVQLARQRQHAPSSAAAPRACGASAGNARVPHPPAPSPEHANKP

SEQ ID NO: 11660 - DNA, 683 bp, Zea mays
  misc_feature: Ceres CLONE 1364187-F
  misc_feature: Encodes the peptide sequence at SEQ ID NO. 11661
tcaccgcggtggcggccgctctagaactagtggatcccccgggctgcaggaattcgcacgagaccattacctagaacatcccaatcgaaaagaacatcgagtctattacatatcggagataaaaacttacaacatgtctaccgtcatcggggaggaaatagcttccttcttcgcctcctccgccgccgcaatcgtactcgtcgtctcctgtatggcagctgcttatggaacggagaaaagggagggaggagcggcttgcatggaagagatgacagacgatcttgtgatgaaatctatcgaacctgtcggtatatttgacgaggagggtatttactgaatgaccattgatgagatgataactgcggtgattaaccccgaggcataagccttacttacatctacgacggatacatgcattctcgcttccgaccttgattgtgaccttgctgttgatttcgctgaaatgttgaatgtcatggctcgaaatacggaggacaccgactacgatcaagagcctaaggtatttgtccggatgatccataacgatatcaacggataagtgtttgctgttgacctccttattgtgatgaccatcctatcctctagagtctggcatgataaagctgaagagaagatcaccgcagatgatgttcatgtacatgctgagagcaactatgacgatg

SEQ ID NO: 11661 - protein, 67 aa, Zea mays
  misc_feature: Ceres CLONE 1364187-F
  misc_feature: SWISSPROT Homolog: EC 3.6.3.14 H(+)-transporting two-sector ATPase
MSTVIGEEIASFFASSAAAIVLVVSCMAAAYGTEKREGGAACMEEMTDDLVMKSIEPVGIFDEEGIY

SEQ ID NO: 11662 - DNA, 716 bp, Zea mays
  misc_feature: Ceres CLONE 1364191-F
  misc_feature (358)..(358): n is a, c, t, g, unknown, or other
  misc_feature (366)..(366): n is a, c, t, g, unknown, or other
  misc_feature (383)..(383): n is a, c, t, g, unknown, or other
  misc_feature (384)..(384): n is a, c, t, g, unknown, or other
  misc_feature (413)..(413): n is a, c, t, g, unknown, or other
aaagctggagctccccgcggtggcggccgctctagaactagtggatcccccgggctgcaggaattcgcacgagaccattacctagaacatcctaatcgaaaaacaaagctctctctccctccccccattctctctctttctcctgttccccgcgagagtcgctcaaggccgcggcgaggagaagcggcagcgcgtcacctctccaatggcatccccgtccttcctccgtgcaacctgtgcgcttctcgagtgctgaggctccctgtccctgagacaagcttgcgcgcgcgatggagggtttttcgagggacttgctgtgcgggattggcaaggggacgcgccgccaccggagaagagncggggcanctgcggaagagatgganngagtgagcttagcctcggctgtcgctggncgccgaatccggctcgacaggaggggagcaaatccccccggtcgtcgtccgggggggcatgttgacaaccccggggaggggccggggccccccgccctcccgggggaagttccttccggtccaagggagggttccaaattttaaaagaaaaagggtgggagggagggggtttttgcggaggggggggggttcctcgggggaaaaccggggggggggtgcggggaggggaaaccctccctcccccctctcggggggggagaaaaatttttggggggcccccccggaggaaaatcccccccccgt

SEQ ID NO: 11663 - DNA, 708 bp, Zea mays
  misc_feature: Ceres CLONE 1364194-F
  misc_feature: Translation starting site: 219
  misc_feature (347)..(347): n is a, c, t, g, unknown, or other
  misc_feature (348)..(348): n is a, c, t, g, unknown, or other
  misc_feature (350)..(350): n is a, c, t, g, unknown, or other
  misc_feature (434)..(434): n is a, c, t, g, unknown, or other
aagctggagctccccgcggtggcggccgctctagaactagtggatcccccgggctgcaggaattcgcacgagaccattacctagaacatcctaatcgaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattggnngnaggtgatgatgctttcaacaccttcttcagtgagactggtgctgggaagcacgtgccccgtgctggttttttgtgacctggaanccactgtcatcgatgaggtgaggaactggacctaccgccaggtctttcaacccggaagaggttcataggggggaaggggggaggcagccaaaaacttttgcccgggggccactaccccattggaaagggaaattgttgacccaagccttggaacccatcaggaaaattttgccgaaaaggtgacctgggtcccaggggtttccccccttttaaaagggtgttggggggagaaaaggggtctttgggccttgggtccccccccccaaaagagggc

SEQ ID NO: 11664 - DNA, 651 bp, Zea mays
  misc_feature: Ceres CLONE 1364195-F
  misc_feature: Translation starting site: 177
  misc_feature: Pfam Name: RPE65 Pfam Description: Retinal pigment epithelial membrane protein
  misc_feature: SWISSPROT Homolog: EC 1.13.11.51 9-cis-epoxycarotenoid dioxygenase
  misc_feature (473)..(473): n is a, c, t, g, unknown, or other
  misc_feature (580)..(580): n is a, c, t, g, unknown, or other
aaagctggagctccccgcggtggcggccgctctagaactagtggatcccccgggctgcaggaattcgcacgagaccattacctagaacatcctaatcgaaaaagaatcttctgccactgcccttccatctcgtcccttagctacaagtcatctcgccgcaaccggaacccgcagccatggggacggaggcggagcagccggacatggacagccaccgaaacgacggcgtcgtggtggtgccagcgccgcgcccgcgtaaggggctcgcctcctgggcgcttgacctgctcgagtccctcgccgtgcgcctcggccacgacaagaccaagccgctccactggctctccggcaacttcgccccccgtcgtcgaggagaccccgccggccccaaaccttagcgtccgcggacacctcccggagtgcttgaatggagagtttggtcagggttgggccctaatccgaagtttgctccntgttgcggggtatcactgggttgatggagacgggatgattcatgccatgcgtattaaggatggaaaagctacctatgtatcaagatatgtgaagactgcccgcctcnacaagaggaagtattttggtggagcaagttttatgaagatggaaccttaaggggattttttggattgttta

SEQ ID NO: 11665 - DNA, 672 bp, Zea mays
  misc_feature: Ceres CLONE 1364198-F
  misc_feature: Encodes the peptide sequence at SEQ ID NO. 11666
  misc_feature (506)..(506): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (648)..(648): n is a, c, t, g, unknown, or other
aaagctggagctccccgcggtggcggccgctctagaactagtggatcccccgggctgcaggaattcgcacgagaccattacctagaacatcctaatcgaaaagttcccctttccctcctgcgcacccgtcttctcctccccgcgtcaaaccccagcacaaaaagcaaccgcccgccgcctcctcgctcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccggcaactacgtcaaggcgttccctctctacatgaacgcgctcgagtacttcaaaacccacctcaagtacgagaagaaccccaagatcaaggaggccatcaccgccaagttcaccgagtacctccgccgcgccgaggagaaatccggcgggcctcgnatgggggtggggcgcagggcggnnnccccaaacggtgggggacgcagctgtcgccacgcgccccaagaccaggggcaagggacgggggacggaggcaacgggaggggatgaactccgagcagtccaaggctggagggcgggngctcaactccgccatcatcaccga

SEQ ID NO: 11666 - protein, 110 aa, Zea mays
  misc_feature: Ceres CLONE 1364198-F
  misc_feature (5)..(68): Pfam Name: MIT Pfam Description: MIT (microtubule interacting and transport) domain
  misc_feature: SWISSPROT Homolog: EC 2.7.11.1 Non-specific serine/threonine protein kinase
  misc_feature (82)..(82): Xaa is any aa, unknown, or other
  misc_feature (83)..(83): Xaa is any aa, unknown, or other
MYSNFKEQAIEYVKQAVQEDNAGNYVKAFPLYMNALEYFKTHLKYEKNPKIKEAITAKFTEYLRRAEEKSGGPRMGVGRRAXXPNGGGRSCRHAPQDQGQGTGDGGNGRG

SEQ ID NO: 11667 - DNA, 657 bp, Zea mays
  misc_feature: Ceres CLONE 1364204-F
  misc_feature: SWISSPROT Homolog: EC 3.2.1.4 Cellulase
  misc_feature (356)..(356): n is a, c, t, g, unknown, or other
  misc_feature (362)..(362): n is a, c, t, g, unknown, or other
  misc_feature (405)..(405): n is a, c, t, g, unknown, or other
  misc_feature (406)..(406): n is a, c, t, g, unknown, or other
  misc_feature (450)..(450): n is a, c, t, g, unknown, or other
  misc_feature (454)..(454): n is a, c, t, g, unknown, or other
  misc_feature (513)..(513): n is a, c, t, g, unknown, or other
ggagctccccgcggtggcggccgctctagaactagtggatcccccgggctgcaggaattcgcacgagaccattacctagaacatcctaatcgaaaagaggaggcagtgcggagacgggagccagtggccagtgacagtgagcggcgacgttccagtgtccactgtccagtaggcgagcgaggaggtggtccattggccggccatggctcgtctccgctgcgtcttcgtcgtcttcgtcctggctctcgtctgccctccgccttccaggcgacgccattgcctcccgggggcaccatggccccgccgcacacgactacagggacgcgctcgtcaagtccatcctcttctttcgaggncagcgntcgggcaagctgcccgcgtcgcagcgcgtgtcctggcgcaggnnactcggactctccgacggtcactccgccagggtgacctggtggncggntaccacgacgctggtgaacacgtcaaagttccggttccccgatggcggtcaccatgacnattcctgcgggacccggggtggaaattttggcgccctcatgaatccgagttgcacacccccaggaacccccccccttggggggcccatatctgtgttaaggggcacggggcccccaaaccttttaatggccacgggggggggga

SEQ ID NO: 11668 - DNA, 651 bp, Zea mays
  misc_feature: Ceres CLONE 1364205-F
  misc_feature: SWISSPROT Homolog: EC 1.11.1.7 Peroxidase
  misc_feature (392)..(392): n is a, c, t, g, unknown, or other
  misc_feature (404)..(404): n is a, c, t, g, unknown, or other
  misc_feature (546)..(546): n is a, c, t, g, unknown, or other
  misc_feature (558)..(558): n is a, c, t, g, unknown, or other
aaagctggagctccccgcggtggcggccgctctagaactagtggatcccccgggctgcaggaattcgcacgagaccattacctagaacatcctaatcaaaaacgatacaaaacacaaactctcggagacagggaagtagcgtagctagatccagagctcggcgccagagatacccgacatcctcgtcatgtctccggttgcaagcaagggagtagtgatggacggtgccccgtgggcggtggcggcagtggccgccgccgtgctgctgtgcctccatctgccggcggtggcgcgaggccagctggcaggtggggttctacaacacgagctgccccaacgccgagtccctggtccggcaggcggtggccagcgcgttcgccaacgactccggnatcgccgccggnctcatccgcctccatttccacgactgcttcgtcaggggctgcgaagcgtcggtgctgctgacctccgccaacaacacgggcggagcgtgacgcgccgcccaaacacccgagcctccacgggttccaggtgatcgacgcgggnaaggggggcggngggagcagagctgcccgcaaaaggtggccgtgggcggacatcgtgggccttcgcggggcgcgacagcatcaaacctcacgggcaacctgccgt

SEQ ID NO: 11669 - DNA, 631 bp, Zea mays
  misc_feature: Ceres CLONE 1364215-F
  misc_feature: Encodes the peptide sequence at SEQ ID NO. 11670
  misc_feature (544)..(544): n is a, c, t, g, unknown, or other
  misc_feature (604)..(604): n is a, c, t, g, unknown, or other
aaagctggagctccccgcggtggcggccgctctagaactagtggatcccccgggctgcaggaattcgcacgagaccattacctagaacatcctaatcaaaaaatccgctccccgccttccgcttccctaccccccgcatcacctaccaacgccgacaccatgggggccttcgcgaatgaggagcaccagttcctcgccgagctcggcctcgcgcagcgcaacccgggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgacgccgctaagacatggatggcgattcctgctccaaagcgaggagagatcgttaggcaaatcggtgatgcactgagagcaaagctccatcaccttggcaggcttgtgtcacttgagatggggaaaatcttcctgaaggaaatcggtgaggttcaggaaatcattgacatgtgtgattatgctngtgggactaagtcgccaactaaatggatccattataccatctgaacgacaaacatagatngggatgggaggtgtggatccccctggg

SEQ ID NO: 11670 - protein, 142 aa, Zea mays
  misc_feature: Ceres CLONE 1364215-F
  misc_feature: SWISSPROT Homolog: EC 1.2.1.3 Aldehyde dehydrogenase (NAD(+))
  misc_feature (129)..(129): Xaa is any aa, unknown, or other
MGAFANEEHQFLAELGLAQRNPGAFACGAWGGSGPTVTSTSPTNNQVIAEVVEASVHDYEEGMRACFDAAKTWMAIPAPKRGEIVRQIGDALRAKLHHLGRLVSLEMGKIFLKEIGEVQEIIDMCDYAXGTKSPTKWIHYTI

SEQ ID NO: 11671 - DNA, 590 bp, Zea mays
  misc_feature: Ceres CLONE 1364225-F
  misc_feature: Encodes the peptide sequence at SEQ ID NO. 11672
  misc_feature (277)..(277): n is a, c, t, g, unknown, or other
  misc_feature (283)..(283): n is a, c, t, g, unknown, or other
  misc_feature (288)..(288): n is a, c, t, g, unknown, or other
  misc_feature (293)..(293): n is a, c, t, g, unknown, or other
  misc_feature (296)..(296): n is a, c, t, g, unknown, or other
  misc_feature (297)..(297): n is a, c, t, g, unknown, or other
  misc_feature (314)..(314): n is a, c, t, g, unknown, or other
  misc_feature (319)..(319): n is a, c, t, g, unknown, or other
  misc_feature (351)..(351): n is a, c, t, g, unknown, or other
  misc_feature (367)..(367): n is a, c, t, g, unknown, or other
  misc_feature (372)..(372): n is a, c, t, g, unknown, or other
  misc_feature (403)..(403): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
tggagctccccgcggtggcggccgctctagaactagtggatcccccgggctgcaggaattcgcacgagaccattacctagaacatcctaatcaaaaagtgccgccctcccccaccccgtcaaccaggagcgcagccgcttgtcggtgcggaaatgcgggttcgtcttgcggcgccgcggtgagctattgattgctggtggtagctcgccccgggcaccggcgatgggctgcttcccgtgctttcgctccacgcgcgaggagggagctcagtactacngatccnagggncccgncgnnagcatgggcgtggtggncaacnaaccgcgtccttccgtcctcgtccgcttgaanctgttggtggagccgnccggnaaaaaaaggcggtgtgccccccccgtgttcnaagggccccgaaagggccgaaaaaccccacttaaagaatgtgggctcaaaaaaggattttccaacctagaaacccccgggaatggtttcttggttaaaccttcaccttcgcccagttggaccccaaaaaactagtaaacccctggggtgggggggtggnnnnnnnnntttcgtgtcccccctctaac

SEQ ID NO: 11672 - protein, 104 aa, Zea mays
  misc_feature: Ceres CLONE 1364225-F
  misc_feature (19)..(19): Xaa is any aa, unknown, or other
  misc_feature (21)..(21): Xaa is any aa, unknown, or other
  misc_feature (24)..(24): Xaa is any aa, unknown, or other
  misc_feature (25)..(25): Xaa is any aa, unknown, or other
  misc_feature (31)..(31): Xaa is any aa, unknown, or other
  misc_feature (33)..(33): Xaa is any aa, unknown, or other
  misc_feature (43)..(43): Xaa is any aa, unknown, or other
  misc_feature (49)..(49): Xaa is any aa, unknown, or other
  misc_feature (61)..(61): Xaa is any aa, unknown, or other
MGCFPCFRSTREEGAQYYXSXGPXXSMGVVXNXPRPSVLVRLXLLVEPXGKKRRCAPPVFXGPRKGRKTPLKECGLKKGFSNLETPGNGFLVKPSPSPSWTPKN

SEQ ID NO: 11673 - DNA, 642 bp, Zea mays
  misc_feature: Ceres CLONE 1364226-F
  misc_feature (246)..(246): n is a, c, t, g, unknown, or other
  misc_feature (248)..(248): n is a, c, t, g, unknown, or other
  misc_feature (249)..(249): n is a, c, t, g, unknown, or other
  misc_feature (252)..(252): n is a, c, t, g, unknown, or other
  misc_feature (253)..(253): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (261)..(261): n is a, c, t, g, unknown, or other
  misc_feature (262)..(262): n is a, c, t, g, unknown, or other
aaagctggagctccccgcggtggcggccgctctagaactagtggatcccccgggctgcaggaattcgcacgagaccattacctagaacatcctaatcaaaaaagtccaaccaccaccaccaccctctctgtcttcgcctccgctgccgattcgaaagcacccgtcctgtcccctcgcaaaaccctagccccagccaccatgaagggcaaggctgacacctccaaggacccacagggccaggctccngnncgnncgnnnccnnccgaaagcgcaagaaaggcgccgcgagcggcaaggccaaaggggccgccccccggccttcttcggcttcattggctggaattcaggccaggagattcagggggcttgcaccctgggaaacaagaaagggtgtggaacggggaagcaaaggaacaaagggaaaaaaggggggggggttttgggccaaatcacaaaaaacaccccccttttggggggcccaaagggggggcgaaaaaaaacccggccttttttggaaaaaaatagggggcaaacttttttttaaaaaagggggggccccccgcccctccaaaaagggcgttaaaccggcgggggggggggggggggctcccaaaaccaaagggtttttaaataagaaaatgc

SEQ ID NO: 11674 - DNA, 649 bp, Zea mays
  misc_feature: Ceres CLONE 1364241-F
  misc_feature: Encodes the peptide sequence at SEQ ID NO. 11675
  misc_feature (535)..(535): n is a, c, t, g, unknown, or other
  misc_feature (546)..(546): n is a, c, t, g, unknown, or other
  misc_feature (568)..(568): n is a, c, t, g, unknown, or other
  misc_feature (600)..(600): n is a, c, t, g, unknown, or other
tggagctccccgcggtggcggccgctctagaactagtggatcccccgggctgcaggaattcgcacgagaccattacctagaacatcctaatcgaaaaacgcagtttctcgcgccatctgaagtcagctggggcgacgaagaaatgtcctctagcgatcaaaacccagctgccacacccgcgtcgtcgggccccgccgagccctcgccgccgggcaggccaacggcggtgtcctcgcgtgtcctcgacatgggcgcgcagctggcgcaggcgctgaagccggtgcggcagatgaagcagcacgcgtgcagcttcgcgctgtacgcccacgacttgcaccgccaggtggaggtccaccacttcgtcgcccggctcaaccaggacgtcctccagtgcgccgtctacgactccgacaagccctcggcccgcctcatcggcgtggagtacatcgtctccgacaccatcttcgagggcctggccccggacgagcagaggctgtggcactcgcacgcgtacgaggtgaaagccgggtggtgnaccgacgtcgncgtgcccggagcgctgcagagnctcggagatggcgagcttcgcaagacgtaggnccagtcgggggccccccgggggggaggggggacccggggcgacgcgctt

SEQ ID NO: 11675 - protein, 151 aa, Zea mays
  misc_feature: Ceres CLONE 1364241-F
  misc_feature (23)..(150): Pfam Name: DUF1264 Pfam Description: Protein of unknown function (DUF1264)
  misc_feature (131)..(131): Xaa is any aa, unknown, or other
  misc_feature (135)..(135): Xaa is any aa, unknown, or other
  misc_feature (142)..(142): Xaa is any aa, unknown, or other
MSSSDQNPAATPASSGPAEPSPPGRPTAVSSRVLDMGAQLAQALKPVRQMKQHACSFALYAHDLHRQVEVHHFVARLNQDVLQCAVYDSDKPSARLIGVEYIVSDTIFEGLAPDEQRLWHSHAYEVKAGWXTDVXVPGALQXLGDGELRKT

SEQ ID NO: 11676 - DNA, 670 bp, Zea mays
  misc_feature: Ceres CLONE 1364245-F
  misc_feature (264)..(264): n is a, c, t, g, unknown, or other
  misc_feature (283)..(283): n is a, c, t, g, unknown, or other
  misc_feature (289)..(289): n is a, c, t, g, unknown, or other
  misc_feature (425)..(425): n is a, c, t, g, unknown, or other
tggagctccccgcggtggcggccgctctagaactagtggatcccccgggctgcaggaattcgcacgagaccattacctagaacatcctaatcgaaaaacagatctcgaggcagcggagtccggggacgccgttctttccgttgtgcttcctttgcctcttgctgccggtggccggtgattttcccgaggtctgtttgggcggcaggtagaagctattttcttgcggctgggtggatggatagccacgccgccggtcgagctccngcggtccggggatgggcgnccgcancccaggaagaagctccaggaaaaccacgtattccaaggttactcagcaggagcttccagttggcgagccgattcttactccgaaatggggtatttcaggattcggtccttggtggcgggattttgggccccatggnatggtttccctggaagcttcccgacagggttgccaaaaccgtaatccgaattaagaatgccggggcccctggtggggggacgaaaaaatttttttactcccggaagggagattcccaaaaaggtggaaaaggatccgcgaatttaaaaagggtttaaaaaccccgcttttttgggaataacccgggggggagtttttcccaaaaaaataaaggggttttccaaacccccgttgggggccccctta

SEQ ID NO: 11677 - DNA, 647 bp, Zea mays
  misc_feature: Ceres CLONE 1364266-F
  misc_feature: Translation starting site: 225
  misc_feature (377)..(377): n is a, c, t, g, unknown, or other
aaagctggagctccccgcggtggcggccgctctagaactagtggatcccccgggctgcaggaattcgcacgagaccattacctagaacatcctaatcgaaaaatcaatcaaatatacgagaggccacctctaccaccgccatccgcagtccatacagtgacccccacgaggtcaagaacctgtaccaggagaggaaagaacctggaagacaggagcttgaggagatggcgagcgccgagggcgagaggtgggtgggactggcgacggacttctcgcaggagagccgagaggcgctgcagtgtgcggcgaccaacctgctccgcgccggagaccacctgctgctgctgcacgtcatcaaggagcccgactacgagagnagcgaggccatcctctggggaatccccggctccccgttgattccccctctcggagttctctgaccctattatcgcgaagaaatatggagcaaaacccgacatggaaaccttggacctcctgaacactacgctacccagaaaggaagtttttgaatttcttttgacaacagattatggggggttgtgaaagtccttgtggggagatccgcgtgagaagctctgtcaagttatccatgacacccccgttgagctgcttggtaataggaagca

SEQ ID NO: 11678 - DNA, 662 bp, Zea mays
  misc_feature: Ceres CLONE 1364270-F
  misc_feature: Encodes the peptide sequence at SEQ ID NO. 11679
  misc_feature (155)..(155): n is a, c, t, g, unknown, or other
  misc_feature (500)..(500): n is a, c, t, g, unknown, or other
  misc_feature (503)..(503): n is a, c, t, g, unknown, or other
  misc_feature (594)..(594): n is a, c, t, g, unknown, or other
aagctggagctccccgcggtggcggccgctctagaactagtggatcccccgggctgcaggaattcgcacgagaccattacctagaacatcctaatcgaaaaagcaggccgcctgcgctccttgcccctaagcctcgtttccggtgtacgactccnacgacgacgagatggcctccccgctccgtcggagcttcccctccctcggccgcgcgcttctcacgccggcgccggcgcggatgctctccgcggaggcctccgatgccctcgttgagatcaagcctggggagattgggatggtctccggcatccccgaggagcacctccgccgtaaggttgtaatttattcaccagctaggactgcatctcagcaaggttcaggcaaagttgggagatggaaaattaactttttgtcaacccaaaagtgggagaacccattggatgggatgggacatctactggggatccatatggctaatgtcgggtgaagcaggacttacattncancagtgcggagtcagcaaaagcatttgctgaaaaacatggatggaaaatatgtggtacggaaacggcatacacctcttttgaagcctagggnctacgctgagaacttcaagtggaagggccccccgaaggcggagcaagcataagacctccagcagcatg

SEQ ID NO: 11679 - protein, 105 aa, Zea mays
  misc_feature: Ceres CLONE 1364270-F
MASPLRRSFPSLGRALLTPAPARMLSAEASDALVEIKPGEIGMVSGIPEEHLRRKVVIYSPARTASQQGSGKVGRWKINFLSTQKWENPLDGMGHLLGIHMANVG

SEQ ID NO: 11680 - DNA, 590 bp, Zea mays
  misc_feature: Ceres CLONE 1364275-F
  misc_feature: Encodes the peptide sequence at SEQ ID NO. 11681
  misc_feature (253)..(253): n is a, c, t, g, unknown, or other
  misc_feature (290)..(290): n is a, c, t, g, unknown, or other
  misc_feature (304)..(304): n is a, c, t, g, unknown, or other
  misc_feature (310)..(310): n is a, c, t, g, unknown, or other
  misc_feature (316)..(316): n is a, c, t, g, unknown, or other
  misc_feature (330)..(330): n is a, c, t, g, unknown, or other
  misc_feature (341)..(341): n is a, c, t, g, unknown, or other
  misc_feature (342)..(342): n is a, c, t, g, unknown, or other
  misc_feature (381)..(381): n is a, c, t, g, unknown, or other
caaagctggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcangggccaagaaacggcggcgccttccccaaagccgacnagggccgccgccgncgtggnaacccnagttctaccctggncgacgacgtcnnagccccgcgttcccagcaccccgcagcctaagcctaccnagctcaggtcgagcatcacgcctggggacggtgctgaccctcctcgcagggcgcttcatgggaaaaaaaaaggggtgtttctcaaggagcttcaaggctggcctgctccttatctctgggccttttcagaatcatggagtaccgatccggcgtggtgaacagacccatggcattgctacatcaaccaagtgacctctcgggggggtggt

SEQ ID NO: 11681 - protein, 123 aa, Zea mays
  misc_feature: Ceres CLONE 1364275-F
  misc_feature (29)..(29): Xaa is any aa, unknown, or other
  misc_feature (46)..(46): Xaa is any aa, unknown, or other
  misc_feature (48)..(48): Xaa is any aa, unknown, or other
  misc_feature (50)..(50): Xaa is any aa, unknown, or other
  misc_feature (55)..(55): Xaa is any aa, unknown, or other
  misc_feature (59)..(59): Xaa is any aa, unknown, or other
  misc_feature (72)..(72): Xaa is any aa, unknown, or other
MAPTSKLSTGIKRASRSHTYHRRGLWAIXGQETAAPSPKPTRAAAXVXTXVLPWXTTSXPRVPSTPQPKPTXLRSSITPGDGADPPRRALHGKKKGVFLKELQGWPAPYLWAFSESWSTDPAW

SEQ ID NO: 11682 - DNA, 689 bp, Zea mays
  misc_feature: Ceres CLONE 1364302-F
  misc_feature (167)..(167): n is a, c, t, g, unknown, or other
  misc_feature (348)..(348): n is a, c, t, g, unknown, or other
  misc_feature (357)..(357): n is a, c, t, g, unknown, or other
  misc_feature (363)..(363): n is a, c, t, g, unknown, or other
  misc_feature (364)..(364): n is a, c, t, g, unknown, or other
  misc_feature (366)..(366): n is a, c, t, g, unknown, or other
  misc_feature (367)..(367): n is a, c, t, g, unknown, or other
catagctggagctccccgcggtggcggccgctctagaactagtggatcccccgggctgcaggaattcgcacgagaccattacctagaacatcctaatcgaaaaaaaaaaaaaagttgggcggggcttcaggctaggtttcgtctttttccgttcacaggcggccgtncggtgttcggtgcccctctcctgccaaacgatcccgagcagtgccaccggtgcggccgtgcagaggaagcggccggggtacagtacaggatgggcgggggttgacacgcgctgcgaaacgcgcagggggagatgggcgtcaaacggcggtgggtgggcgccggtcacttggtttccggggncacatgggncgcggnncnntccgcggcattccgcgatcggtctcaaggctcggcgaactcaatcaatcgagggtccgcggacggcccggaatcccaattaatcctcaagcaaaatggaagaaccttcaacccagttgcgtctcagcaaaagagggcgaatttcttggctcttaaacaagaaagggatctaggcaaacccccaacataaatgaataaggggggctggaatcatttttgaatcatgcgaggcagggattggattctcaataaaatgaccctagcttcccgggtctggtaaccagcttttcttgggttttggctgagctgaaaactaaagggaa

SEQ ID NO: 11683 - DNA, 676 bp, Zea mays
  misc_feature: Ceres CLONE 1364305-F
  misc_feature: Encodes the peptide sequence at SEQ ID NO. 11684
aaagctggagctccccgcggtggcggccgctctagaactagtggatcccccgggctgcaggaattcgcacgagaccattacctagaacatcctaatcgaaaactcgaaaccctagcgccggcgcctccacttcgttttcctcactctctcctccagctcagggtccggcggcgaagggaaggcaagatgtacaccgcgaggaagaagatccagaaggagaagggccttgagccctccgagttcgaggactccgttgcccaggctttctttgatctggagaacgggaaccaggagctcaagagcgacctcaaggacctgtacatcaacaatgctatccagatggatgttaccgggagcaggaaggctgttgtcatccacgtcccataccgcctgcgcaaggccttcaggaagatccatgtcagactcgtcagggagctggagaagaaattcagcggcaaggatgtggtaattgttgctacaaggaggattgtgaggcaccccaagagggggttcagctgttctgcgccctcgcacccaggactctgactgctgttccgatgcatcttttggggaggatgttgtctacccagcttgagattgttggggaaagcgtgtcagataccccggtcctggatgggttccaagaatatcaaaagattttctttgggacccaaag

SEQ ID NO: 11684 - protein, 119 aa, Zea mays
  misc_feature: Ceres CLONE 1364305-F
  misc_feature (6)..(118): Pfam Name: Ribosomal_S7e Pfam Description: Ribosomal protein S7e
MYTARKKIQKEKGLEPSEFEDSVAQAFFDLENGNQELKSDLKDLYINNAIQMDVTGSRKAVVIHVPYRLRKAFRKIHVRLVRELEKKFSGKDVVIVATRRIVRHPKRGFSCSAPSHPGL

SEQ ID NO: 11685 - DNA, 666 bp, Zea mays
  misc_feature: Ceres CLONE 1364310-F
  misc_feature: Encodes the peptide sequence at SEQ ID NO. 11686
  misc_feature (353)..(353): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (422)..(422): n is a, c, t, g, unknown, or other
  misc_feature (426)..(426): n is a, c, t, g, unknown, or other
  misc_feature (649)..(649): n is a, c, t, g, unknown, or other
  misc_feature (658)..(658): n is a, c, t, g, unknown, or other
tggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtnggcgacgctgttcccgctgggcgggctgctgctggtgtnnnntcggggctgggcgctgacggcctccgngggnggggggctgggcgtggccaacgccgggtggtccctgatcttcagcccccgtgctggtccccgccgcgctgctcatcgggacggccggtcatggggtcccctcacgtcgggcgcgctgggggcttcggaggcctgtcctcgctcacgtggctcgccaaacgggggcgggaagcgttccagcgcaccccggactaacgtggaggaggcgcacgcaaggatggggnagggcgcgncgcacgcg

SEQ ID NO: 11686 - protein, 139 aa, Zea mays
  misc_feature: Ceres CLONE 1364310-F
  misc_feature (65)..(65): Xaa is any aa, unknown, or other
  misc_feature (76)..(76): Xaa is any aa, unknown, or other
MADRDRSGIYGGAHATYGQQQQQGGGGRPMGEQVKGMLHDKGPTASQALTVGDAVPAGRAAAGVXSGLGADGLRGXGAGRGQRRVVPDLQPPCWSPPRCSSGRPVMGSPHVGRAGGFGGLSSLTWLAKRGREAFQRTPD

SEQ ID NO: 11687 - DNA, 643 bp, Zea mays
  misc_feature: Ceres CLONE 1364315-F
  misc_feature: Translation starting site: 199
  misc_feature: SWISSPROT Homolog: EC 1.1.1.1 Alcohol dehydrogenase
  misc_feature (434)..(434): n is a, c, t, g, unknown, or other
  misc_feature (481)..(481): n is a, c, t, g, unknown, or other
  misc_feature (519)..(519): n is a, c, t, g, unknown, or other
  misc_feature (563)..(563): n is a, c, t, g, unknown, or other
  misc_feature (571)..(571): n is a, c, t, g, unknown, or other
  misc_feature (580)..(580): n is a, c, t, g, unknown, or other
  misc_feature (581)..(581): n is a, c, t, g, unknown, or other
tccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctggcacaccgacgtctacttctgggaggccaaggagcagactcccgtgttccctcggatctttggccacgaggctggagtatcatagagagtgttggnagagggtgtgactgacgtagctccgggcgacatgtccctcctgtgtncactggggagtgcaaggagtgtgcccactgcaagtcgnagagagcaacatgtgtgatctgctcaggatcacacggaccgcgntgtgatgnatggcgagnncaaggtcgcgtttttcaatcaatgggaagctatctaaccactttgttgggactgcaccttca

SEQ ID NO: 11688 - DNA, 607 bp, Zea mays
  misc_feature: Ceres CLONE 1364324-F
  misc_feature: Encodes the peptide sequence at SEQ ID NO. 11689
  misc_feature (337)..(337): n is a, c, t, g, unknown, or other
  misc_feature (539)..(539): n is a, c, t, g, unknown, or other
  misc_feature (542)..(542): n is a, c, t, g, unknown, or other
  misc_feature (544)..(544): n is a, c, t, g, unknown, or other
  misc_feature (586)..(586): n is a, c, t, g, unknown, or other
  misc_feature (607)..(607): n is a, c, t, g, unknown, or other
caaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctctttcacccntatagctccaacaagcaatcgcagcaagcaacatacctttatcacccttgttttcacatcgccagccctatcctttgggtgcagtcattggtacaaaccatcagggcacagcagctgcagcaactcgtgcttactgtgatcaaccaagtagctctgggcaaacctttctccctactctcagcaacaacaattttcttcattncancnactgtctacctttgaaccgtggctgcttaatttgcagcaacnactattaacatttcaggccgn

SEQ ID NO: 11689 - protein, 55 aa, Zea mays
  misc_feature: Ceres CLONE 1364324-F
MATKIFSLLMLLALSACVANATIFPQCSQAPIASLLPPYLPSMIASVCENPALSP

SEQ ID NO: 11690 - DNA, 656 bp, Zea mays
  misc_feature: Ceres CLONE 1364329-F
  misc_feature: Translation starting site: 244
  misc_feature: SWISSPROT Homolog: EC 1.11.1.7 Peroxidase
  misc_feature (304)..(304): n is a, c, t, g, unknown, or other
  misc_feature (367)..(367): n is a, c, t, g, unknown, or other
  misc_feature (507)..(507): n is a, c, t, g, unknown, or other
  misc_feature (508)..(508): n is a, c, t, g, unknown, or other
  misc_feature (521)..(521): n is a, c, t, g, unknown, or other
  misc_feature (613)..(613): n is a, c, t, g, unknown, or other
  misc_feature (633)..(633): n is a, c, t, g, unknown, or other
aaagctggagctccccgcggtggcggccgctctagaactagtggatcccccgggctgcaggaattcgcacgagaccattacctagaacatcctaatcgaaaaagcggcaactacacgccagagagagggaaggggaggttggccagagagccgagagcagccctgcagtcgagagcatccgactgctagctactagcaatagcataggcagataagctcgggccgggccggggcacgcgcacaatgaggtcgcggcggtggcacagcgtggtcgccgtagcgctggcagcggcggcgtggtggntggtgcgcgggcggcgcaggcgcaggcgcaggcgcagctgagccagagctcaaccgcgtcacnttgccccgacgtgggagacgctggtcccgcggcgccgtcacccagaagctgcaggagaccttcaacgcggcgccgggcacgctccgcctcttcttcacgactgcttcgtcagggctgcgacgcgtccgtgcctgctgcgnngcccgacgaaggncacagcgcgggcgcgaaaaccacgctggtccccggacgcgctcgacctggtacccgcgcccagggcggccgtggacgccgacccgcgctggnccaaccagggtgtcctgcgncgacatcctcgccctcgccgaac

SEQ ID NO: 11691 - DNA, 656 bp, Zea mays
  misc_feature: Ceres CLONE 1364348-F
  misc_feature: Encodes the peptide sequence at SEQ ID NO. 11692
  misc_feature (225)..(225): n is a, c, t, g, unknown, or other
  misc_feature (348)..(348): n is a, c, t, g, unknown, or other
  misc_feature (349)..(349): n is a, c, t, g, unknown, or other
  misc_feature (433)..(433): n is a, c, t, g, unknown, or other
  misc_feature (434)..(434): n is a, c, t, g, unknown, or other
  misc_feature (551)..(551): n is a, c, t, g, unknown, or other
aaagctggagctccccgcggtggcggccgctctagaactagtggatcccccgggctgcaggaattcgcacgagaccattacctagaacatcctaatcgaaaaaattagcatgaagttgtttttgctgaagagggtcgaacaaaagaaatgcttcactgagcaaaatatagcatttcgatcccgacaccccaaaatccctcagccctctggcctcggcggcgctcnaaccttcgccgtcccgccgtctccaaaaccctcttaccatggccgccgcgacaaccgcgggggccggagccgcgacgccgcagccgccacggcagtacaagctagctccgcaagcgagctgcnntttgtggaggtgctccccgacgcgcccctccgagtgcgcctcgtcactgggcaccgcagagatcttcggcaccgagctgcctcnncggagggctgggtccccgtccctccccgatccaagatcgccattttcacctggcacggcgcgacggtggaactgggacggggtgagcgagagcgagtacacgtctgacgagactccnatgggtaatttatgtcaacacgcacgccattctggatgcccgcagggcaagggcgagaaagccgcagctcaggggggcgataaggaggcatcaagggacctagaa

SEQ ID NO: 11692 - protein, 131 aa, Zea mays
  misc_feature: Ceres CLONE 1364348-F
  misc_feature (29)..(29): Xaa is any aa, unknown, or other
  misc_feature (57)..(57): Xaa is any aa, unknown, or other
MAAATTAGAGAATPQPPRQYKLAPQASCXLWRCSPTRPSECASSLGTAEIFGTELPXRRAGSPSLPDPRSPFSPGTARRWNWDGVSESEYTSDETPMGNLCQHARHSGCPQGKGEKAAAQGGDKEASRDLE

SEQ ID NO: 11693 - DNA, 614 bp, Zea mays
  misc_feature: Ceres CLONE 1364352-F
  misc_feature: Encodes the peptide sequence at SEQ ID NO. 11694
tccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgctcgcccgatgggtgagcaggtgaatggcatgctccacgacaaggggccgacggcgtctcaggcgctgacggtggtgacgctgttcccgctgggcgggctgctgctggtgctgtcggggctggcgctgacggactccgtggtggggctggccgtgtccacgccgttgttcctgatcttcagccacgtgctcgtctccgccgcgctgctcatcgggacggccgtcatgtggttcctcacgtcgggcgcgctggtgctcggaggactgtcctcgctcacgtgcctcgccaacacggagcggctagtgctccagcgcaccccggactacgtggacgatgcgcac

SEQ ID NO: 11694 - protein, 140 aa, Zea mays
  misc_feature: Ceres CLONE 1364352-F
  misc_feature (44)..(140): Pfam Name: Oleosin Pfam Description: Oleosin
MADRDRSGIYGGAHATYGQQQQQGGGARPMGEQVNGMLHDKGPTASQALTVVTLFPLGGLLLVLSGLALTDSVVGLAVSTPLFLIFSHVLVSAALLIGTAVMWFLTSGALVLGGLSSLTCLANTERLVLQRTPDYVDDAH

SEQ ID NO: 11695 - DNA, 647 bp, Zea mays
  misc_feature: Ceres CLONE 1364353-F
  misc_feature: Encodes the peptide sequence at SEQ ID NO. 11696
  misc_feature (507)..(507): n is a, c, t, g, unknown, or other
  misc_feature (594)..(594): n is a, c, t, g, unknown, or other
  misc_feature (639)..(639): n is a, c, t, g, unknown, or other
tccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcngcagcgcccgcgccgtcgccatcctcagctcgtcggcctccaccagcagccgcgacagcgcggccttgtagctgtccagcgccgcgncccacctcggcgtccgcggctcctagcccggccgccctgagccgnccgcgcgc

SEQ ID NO: 11696 - protein, 113 aa, Zea mays
  misc_feature: Ceres CLONE 1364353-F
  misc_feature (72)..(72): Xaa is any aa, unknown, or other
  misc_feature (101)..(101): Xaa is any aa, unknown, or other
MLLTSCRQGRGMASLSCARADGVVRSGALPAKLLLCASCCFPTAAPVADGEVQVLACRQHLHRLPRRQDLRXQRPRRRHPQLVGLHQQPRQRGLVAVQRRXPPRRPRLLARPP

SEQ ID NO: 11697 - DNA, 619 bp, Zea mays
  misc_feature: Ceres CLONE 1364365-F
  misc_feature: Encodes the peptide sequence at SEQ ID NO. 11698
  misc_feature (574)..(574): n is a, c, t, g, unknown, or other
tccccgcggtggcggccgctctagaactagtggatcccccgggctgcaggaattcgcacgagaccattacctagaacatcctaatcaaaaacacgcgaaggcacctagcagccgccactcgccgaactgaggaacacgccgggcgacgggatacagcagcagcgcgcccctctatgcccgacgcgacggcgccctgcagctgcagataaacctgttccaatggccaaacaaaaagagggtgtggacaaaagaactgctaggaagatgatccgatctacggaaggctgtgcaaagagcattactttcgagaggaacaacaaatcagacgctgtgcagcttcacgatctgccgaatgacatcctaggtagcatactatcacggttgacattcagagaatcctcacagatgggccttggttctcatacctggcgggcgctgtggagaaactgttgccggaaacctggtctttcaccagggccaaccagggtccaccccgggaaaagggggggttccaaacattccggggccccccttttgccctgggaaagagccccaagggttttttggggggggnaaaaaacccccccccccccccctccccaaaaaagggtgggtgggt

SEQ ID NO: 11698 - protein, 133 aa, Zea mays
  misc_feature: Ceres CLONE 1364365-F
  misc_feature (119)..(119): Xaa is any aa, unknown, or other
MAKQKEGVDKRTARKMIRSTEGCAKSITFERNNKSDAVQLHDLPNDILGSILSRLTFRESSQMGLGSHTWRALWRNCCRKPGLSPGPTRVHPGKRGGSKHSGAPLLPWERAPRVFWGGXKTPPPPPPQKRVGG

SEQ ID NO: 11699 - DNA, 665 bp, Zea mays
  misc_feature: Ceres CLONE 1364366-F
  misc_feature: Encodes the peptide sequence at SEQ ID NO. 11700
  misc_feature (349)..(349): n is a, c, t, g, unknown, or other
  misc_feature (350)..(350): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
aaagctggagctccccgcggtggcggccgctctagaactagtggatcccccgggctgcaggaattcgcacgagaccattacctagaacatcctaatcgaaaaataggaaaaacgactccacacggtccacggcgtcgtctccggcgaaccttcgcgagccctcggctcccctctaccaccgctgccgcgaccccgcctacggagcatcctcgggtagcgctctggcttcccgtgccggcggacgtcctgcaggaggcggcggcctccgtggcatgttgatgagggccgccgctgccctccctcgccgatcgtcgcggccctcggagccggggtcctcctcctcccgggnntccgcccctggagctccctcagccgggctcctggcccccgnnngctcctcgacccccttcgatgtcgataccgaccccgcatcgcggcttgagctgacgccgaagcagatcgggctctgcgttgacccgctcgcgcatccgaggacaaggggaacgccgggatgactgggcccgaggaggtccaagcctcccggggatcggaattaaaacttttgaaacggtcgggggatccctttacccggttaaaaaaaaagacccgaaatttgggggggtttaccctttggggacccggaggggggttaaacctccgcgggg

SEQ ID NO: 11700 - protein, 80 aa, Zea mays
  misc_feature: Ceres CLONE 1364366-F
  misc_feature (26)..(26): Xaa is any aa, unknown, or other
  misc_feature (40)..(40): Xaa is any aa, unknown, or other
  misc_feature (41)..(41): Xaa is any aa, unknown, or other
MLMRAAAALPRRSSRPSEPGSSSSRXSAPGAPSAGLLAPXXSSTPFDVDTDPASRLELTPKQIGLCVDPLAHPRTRGTPG

SEQ ID NO: 11701 - DNA, 660 bp, Zea mays
  misc_feature: Ceres CLONE 1364375-F
  misc_feature: Encodes the peptide sequence at SEQ ID NO. 11702
aagctggagctccccgcggtggcggccgctctagaactagtggatcccccgggctgcaggaattcgcacgagaccattacctagaacatcctaatcgaaaaagggaagaaaatacaatcgctgaaaccagatgtccaacggatgactggaactcctgtcagtttgcactgagcaatggttcatccattctcaataaccacagtgctccacaggatagcctcacttatggagataatgatctaaactacattgattggcctggcattgacaattttgaggatgttgacacattattcaggagatctgatttcacatatgatccgcagcagctggagaatacagatgggttatcttggcttccttcttcagatgctgtttactcttctgatgttgctttgcagcaagggtttgactcgtcttattccgattatgatattctggatgatctctcagcattccaatgtgcagaagataaatcactaccctcagttggtccttcatcggatttatgtgataatcaattcaatgatacctatctgttcagtgagcagaagaatgcgaatgcatatggtgaacagatataccaagaggatgtgatggagttgttgcccactgaccagatatgcagtggacatgaaaacattgatatgggtggaaaca

SEQ ID NO: 11702 - protein, 219 aa, Zea mays
  misc_feature: Ceres CLONE 1364375-F
AGAPRGGGRSRTSGSPGLQEFARDHYLEHPNRKREENTIAETRCPTDDWNSCQFALSNGSSILNNHSAPQDSLTYGDNDLNYIDWPGIDNFEDVDTLFRRSDFTYDPQQLENTDGLSWLPSSDAVYSSDVALQQGFDSSYSDYDILDDLSAFQCAEDKSLPSVGPSSDLCDNQFNDTYLFSEQKNANAYGEQIYQEDVMELLPTDQICSGHENIDMGGN

SEQ ID NO: 11703 - DNA, 660 bp, Zea mays
  misc_feature: Ceres CLONE 1364392-F
  misc_feature: Encodes the peptide sequence at SEQ ID NO. 11704
  misc_feature (434)..(434): n is a, c, t, g, unknown, or other
  misc_feature (456)..(456): n is a, c, t, g, unknown, or other
  misc_feature (482)..(482): n is a, c, t, g, unknown, or other
  misc_feature (509)..(509): n is a, c, t, g, unknown, or other
  misc_feature (612)..(612): n is a, c, t, g, unknown, or other
  misc_feature (613)..(613): n is a, c, t, g, unknown, or other
aagctggagctccccgcggtggcggccgctctagaactagtggatcccccgggctgcaggaattcgcacgagaccattacctagaacatcctaatcgaaaattgtccgcggcgaaacaaaatttcccacagtgagcgaggttcccctcccgactcggtgatggcggcgccggcggcggacgaggcatggtgccggaagacggtgccacgggtgatggaactggtgtgtccgcgccttccgcagcgggacgcatgcgcgctgctcgctgtcagtccctggtgctaccgtgccctcgttgctaactccaggctctgggaggtacttgatctacgtgagatgaagaatgctggaaaccgacttatttcagcactttcactggcaaggtatcgtcacctcaaagtattaaaccttgaatttgctcaagatattgaggnatcgatattttgttcatctaanagaaacgagtggcatctcactggganaatttggaattcctgaacctaaatgcnatgtcagaagatctctgataaaggaaattgaagctggttaccagtctttgtcctaatcttcagcgcttgctatcctattgggatttgtaggactgacagaacnntcagtattgggcactttacaaagaactgcaagcatctagtgacttta

SEQ ID NO: 11704 - protein, 112 aa, Zea mays
  misc_feature: Ceres CLONE 1364392-F
  misc_feature (92)..(92): Xaa is any aa, unknown, or other
  misc_feature (99)..(99): Xaa is any aa, unknown, or other
  misc_feature (108)..(108): Xaa is any aa, unknown, or other
MAAPAADEAWCRKTVPRVMELVCPRLPQRDACALLAVSPWCYRALVANSRLWEVLDLREMKNAGNRLISALSLARYRHLKVLNLEFAQDIEXSIFCSSXRNEWHLTGXIWNS

SEQ ID NO: 11705 - DNA, 650 bp, Zea mays
  misc_feature: Ceres CLONE 1364404-F
  misc_feature: Encodes the peptide sequence at SEQ ID NO. 11706
  misc_feature (309)..(309): n is a, c, t, g, unknown, or other
  misc_feature (310)..(310): n is a, c, t, g, unknown, or other
  misc_feature (328)..(328): n is a, c, t, g, unknown, or other
gctggagctccccgcggtggcggccgctctagaactagtggatcccccgggctgcaggaattcgcacgagaccattacctagaacatcctaatcgaaaaaaaaaaacgcaactgaaaaacctcgtctacattcgcatctaggcgcccctccacctcgttccgatccagctcgccggcgcccggcggccatgtcgcagcccacggcggcggtggccgcggaggcgcagccgcagggtcgcggcctcgcgaggcgccagggcggcggtggcggccttgagcagagcatctctggcatcgtgcggatggcgnntgtctggtacttcgcggncaaaagtcttcggcccaagcgcccgcccgcggaccccgggattctcatgtccgacctcttccagaagggcgagccaatggatatgtgcatgtatttatcagagagtgacaagttcaacgattttgctaatgaggacgcacttatttggcatgaggcaaacataccatatgcagtatggggacctaccagtactagaacacggtcattaacatactacccttcagagctctcaagcataagggatctttggatgctcatgtttactttgcccgttcggggtaccctggggaccccaaagatcctggatatgacaaaaaatctg

SEQ ID NO: 11706 - protein, 154 aa, Zea mays
  misc_feature: Ceres CLONE 1364404-F
  misc_feature (41)..(41): Xaa is any aa, unknown, or other
  misc_feature (47)..(47): Xaa is any aa, unknown, or other
MSQPTAAVAAEAQPQGRGLARRQGGGGGLEQSISGIVRMAXVWYFAXKSLRPKRPPADPGILMSDLFQKGEPMDMCMYLSESDKFNDFANEDALIWHEANIPYAVWGPTSTRTRSLTYYPSELSSIRDLWMLMFTLPVRGTLGTPKILDMTKNL

SEQ ID NO: 11707 - DNA, 642 bp, Zea mays
  misc_feature: Ceres CLONE 1364409-F
  misc_feature: Encodes the peptide sequence at SEQ ID NO. 11708
  misc_feature (196)..(196): n is a, c, t, g, unknown, or other
  misc_feature (263)..(263): n is a, c, t, g, unknown, or other
  misc_feature (315)..(315): n is a, c, t, g, unknown, or other
  misc_feature (335)..(335): n is a, c, t, g, unknown, or other
aaagctggagctccccgcggtggcggccgctctagaactagtggatcccccgggctgcaggaattcgcacgagaccattacctagaacatcctaatcgaaaaaatttttcgcccgccgcccccagtcccgatccgaagctgtgcctcgtaccatttcgatccaatggcgccgacgtcgaagctgtcgaacggcatncagcgcgcttcgcggtcgcacgcgtaccatcgccgtgggctgtgggccatcagggccagaaaacggngcggctttccccaaggccgacaagggcggccgccgccgtgggaacccaggtnctaacctggcggacgagtgnaggcccgcggttcccaggacccgcaaggctaaagcctaccaaggtcaaggcgagcatacgccttgggaaggggctgatcctccctcgcagggggcttcattggggaaaaaaaggggtggtttttcaaagaaagttcaaggccgggcctggtcccttatttctgggggctttttaggaaaaaagggagggaaccaaccccccccgggggaaccaaaaaacactttttttttgtttactccacccaaagttggcatccctccggggggtggggggggggccccactttggttggagcaaaaaacttttg

SEQ ID NO: 11708 - protein, 50 aa, Zea mays
  misc_feature: Ceres CLONE 1364409-F
  misc_feature (11)..(11): Xaa is any aa, unknown, or other
  misc_feature (34)..(34): Xaa is any aa, unknown, or other
MAPTSKLSNGXQRASRSHAYHRRGLWAIRARKRXGFPQGRQGRPPPWEPR

SEQ ID NO: 11709 - DNA, 630 bp, Zea mays
  misc_feature: Ceres CLONE 1364413-F
  misc_feature: Encodes the peptide sequence at SEQ ID NO. 11710
  misc_feature (525)..(525): n is a, c, t, g, unknown, or other
  misc_feature (536)..(536): n is a, c, t, g, unknown, or other
  misc_feature (537)..(537): n is a, c, t, g, unknown, or other
tccccgcggtggcggccgctctagaactagtggatcccccgggctgcaggaattcgcacgagaccattacctagaacatcctaatcaaaaaggaaaagcacgcgagagcttgtcggagggctctctgtctctgtgataaaccgatacgcagaggaagctgcggagaggtgtccctgctctgccggtgagctgcggccagcgggtgaagagaagtggaccggacggggacgaaggagagagagaataagaaaaaggcgccgcgggggccatggctggacacgcgccggcgagggacaagattaccaccggcttcgccgctacgtgcagcctgctgagccagtttctcaaggagaagaagggcggcctgcagggcctcggcggcctcgccatggcgccggcgccggcagctgtagcaggagctttccggccgccgaccaccatgaactttgctgtcgcgctcgacgcggccaaggccaccgtcggggagccagaagccatgggccacgcaccgcgggaatccaaggnacgcacctggnngagagcgcatcagctgaacatcttctacggcggaaaagtgtcgtcttcacaggtccccctccgcaagtcaaggactgctgcaaatcgggaccc

SEQ ID NO: 11710 - protein, 120 aa, Zea mays
  misc_feature: Ceres CLONE 1364413-F
  misc_feature (86)..(86): Xaa is any aa, unknown, or other
  misc_feature (90)..(90): Xaa is any aa, unknown, or other
MAGHAPARDKITTGFAATCSLLSQFLKEKKGGLQGLGGLAMAPAPAAVAGAFRPPTTMNFAVALDAAKATVGEPEAMGHAPRESKXRTWXRAHQLNIFYGGKVSSSQVPLRKSRTAANRD

SEQ ID NO: 11711 - DNA, 662 bp, Zea mays
  misc_feature: Ceres CLONE 1364414-F
  misc_feature: Encodes the peptide sequence at SEQ ID NO. 11712
  misc_feature (280)..(280): n is a, c, t, g, unknown, or other
  misc_feature (445)..(445): n is a, c, t, g, unknown, or other
  misc_feature (497)..(497): n is a, c, t, g, unknown, or other
  misc_feature (600)..(600): n is a, c, t, g, unknown, or other
caaagctggagctccccgcggtggcggccgctctagaactagtggatcccccgggctgcaggaattcgcacgagactattacctagaacatcctaatcgaaaaaagccgccccagccgacgaggcgaggtgcgtgcaattccgtagctgcaacgaactccctcgaccgtatcgcccgctgctcctctatccctttcctgctgctgctactaccttaagctatcactatcatggccttgatgctgctagcgcgcaacctgcgctcccgcctccgcccacgnctcgccgccgccgcggcgttctcgtcggccgcggcggaggcggagagggcgatacgggacgggccgcggaacgactggagccggcccgagatccaggccgtctacgactcaccgctcctcgacctcctctttcacggggctcaggtccacagaaatgtccataanttcagagaagtgcagcaatgcacacttctttcaatcaagactggtggatgcnagtgaagattgttcttactgtcctcagtcatcaagaacaaacctgggattgaaggcccaaaaatgatgaacaaagatgctgtcttggaaagcagcaaaaagcnaaaagagtctgggagcacccgtttttgcatgggagctgcatggagagaaacattggcaggaa

SEQ ID NO: 11712 - protein, 89 aa, Zea mays
  misc_feature: Ceres CLONE 1364414-F
  misc_feature: SWISSPROT Homolog: EC 2.8.1.6 Biotin synthase
  misc_feature (72)..(72): Xaa is any aa, unknown, or other
MALMLLARNLRSRLRPRLAAAAAFSSAAAEAERAIRDGPRNDWSRPEIQAVYDSPLLDLLFHGAQVHRNVHXFREVQQCTLLSIKTGGC

SEQ ID NO: 11713 - DNA, 610 bp, Zea mays
  misc_feature: Ceres CLONE 1364416-F
  misc_feature: Encodes the peptide sequence at SEQ ID NO. 11714
  misc_feature (213)..(213): n is a, c, t, g, unknown, or other
  misc_feature (214)..(214): n is a, c, t, g, unknown, or other
  misc_feature (230)..(230): n is a, c, t, g, unknown, or other
  misc_feature (281)..(281): n is a, c, t, g, unknown, or other
  misc_feature (328)..(328): n is a, c, t, g, unknown, or other
  misc_feature (466)..(466): n is a, c, t, g, unknown, or other
  misc_feature (497)..(497): n is a, c, t, g, unknown, or other
  misc_feature (501)..(501): n is a, c, t, g, unknown, or other
aaagctggagctccccgcggtggcggccgctctagaactagtggatcccccgggctgcaggaattcgcacgagaccattacctagaacatcctaatcgaaaaaacgatcggtcgggactccggactcgggagtcggcactcgggtctcgacgtctcgtctcgtctcgtctcgcctgcccgcagcccttggctttcgtcatccgcttctccgcnngcgcggaaagaagggnaatgcgcaccggctgctgcgggacgcgcaggcggacgggtgggaagcgtcngacttccccatcatctgcgagtcatgcctcggcgacaacccctacgntcggatgttaagagctgaatatgacaaagaatgcaaaatttgtgcacgtccttttactgtattccggtggcgtcctgggcgagatgcaaggtacagaagactgagatctgccagacatgttgcaagcaaaagatgtcntcgcagtctgcctgctggatcttgatatggnctcngctgtcaggtccgagaacagcactctctatcattccaatggatgcatttccaggagggaggtcatccccaatatttgcaaaaaacatgaaaggaggccaaagctgcaaa

SEQ ID NO: 11714 - protein, 52 aa, Zea mays
  misc_feature: Ceres CLONE 1364416-F
  misc_feature (45)..(45): Xaa is any aa, unknown, or other
MLRAEYDKECKICARPFTVFRWRPGRDARYRRLRSARHVASKRCXRSLPAGS

SEQ ID NO: 11715 - DNA, 705 bp, Zea mays
  misc_feature: Ceres CLONE 1364422-F
  misc_feature: Encodes the peptide sequence at SEQ ID NO. 11716
agagctggagctccccgcggtggcggccgctctagaactagtggatcccccgggctgcaggaattcgcacgagaccattacctagaacatcctaatcgaaaaaatcacacactaatcaacaagcaggaccagctagctagctcctcccactgttatcacccgggccccggccagccatctcgctgaaagagaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcgggctctcgctgtcctaacacatcacccccgacatcgactgcgacaaagtcccaaagcaaagaaagttttgcttcaccttccatcaacaggacccaaaatgatcgaatgaagggatactgttcccttaccagaaccatacgacgggatggtgatgttcagtgccctgctagcagtaggctgcatctgcactgagtgaca

SEQ ID NO: 11716 - protein, 106 aa, Zea mays
  misc_feature: Ceres CLONE 1364422-F
  misc_feature (28)..(107): Pfam Name: Tryp_alpha_amyl Pfam Description: Protease inhibitor/seed storage/LTP family
MKTTSSGIAVVLLVAMLAVQSAVADISCSDVLNDLSPCLPFLQGKAAKPSESNNQCCDGVRTLYAAADTRPDRQATCRCLKAAYVQVHAVLSAAQELPGDCGLSLS

SEQ ID NO: 11717 - DNA, 689 bp, Zea mays
  misc_feature: Ceres CLONE 1364428-F
  misc_feature: Encodes the peptide sequence at SEQ ID NO. 11718
  misc_feature (402)..(402): n is a, c, t, g, unknown, or other
  misc_feature (689)..(689): n is a, c, t, g, unknown, or other
tggagctccccgcggtggcggccgctctagaactagtggatcccccgggctgcaggaattcgcacgagaccattacctagaacatcctaatcaaaaccacgatactccgacgcccactttgctacctcggaaccctagccgccgcccatggatatcgccggagaccggcgccggtagcgatacgcaaaaggagtggtacgttctttgaccttgtttattgctgcgcccgaggcgtgtggcgcggggggagcaggaaggagaggggaagaacagaaggggaaggcgggcggggccgcgatgtcggtgcggatcaaggcggttgtagaccggttcgtgaaggagctgcaggaggcgctggacgcggacatccaagaccgcgtcatgaaggagcgcgagatgcanagctacatcgaggagcgcgagcgcgaggtcgccgagcgggaggccgcctggaaggccgagctatcccgccgcgaggccgagatcgcaccggcaagaaagcaggctgaagatggaaaaggagaatttagagaaggaaaaaagcgtcctcctgggaacagcatcgagccaagacaaccaagatggagcccttgagatcacttggcagtggggaaaaatacaggtgcccctccgcttctccaaggcgaaaaaatgagaaatggaactggcactggaacttggaccaacan

SEQ ID NO: 11718 - protein, 98 aa, Zea mays
  misc_feature: Ceres CLONE 1364428-F
  misc_feature (35)..(35): Xaa is any aa, unknown, or other
MSVRIKAVVDRFVKELQEALDADIQDRVMKEREMXSYIEEREREVAEREAAWKAELSRREAEIAPARKQAEDGKGEFREGKKRPPGNSIEPRQPRWSP

SEQ ID NO: 11719 - DNA, 695 bp, Zea mays
  misc_feature: Ceres CLONE 1364429-F
  misc_feature: Encodes the peptide sequence at SEQ ID NO. 11720
  misc_feature (418)..(418): n is a, c, t, g, unknown, or other
  misc_feature (619)..(619): n is a, c, t, g, unknown, or other
  misc_feature (654)..(654): n is a, c, t, g, unknown, or other
  misc_feature (659)..(659): n is a, c, t, g, unknown, or other
aagctggagctccccgcggtggcggccgctctagaactagtggatcccccgggctgcaggaattcgcacgagaccattacctagaacatcctaatcgaaaagtgtgtctggaaaccctagccgccatatctcacgatccactcgagcaccaagccgagggaaggggaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccangaggtacctgaagtacttgaccaagaagtacttgaagaagcacaacgtgcgggattggctacgcgtggttgctgccaacaaggaccgaaacgtctatgagctccgctacttcaacattgctgagaacgagggggaggaagaagattagattgcactacgcttatattttagtattgaactccgttgcattttggtacctgnaccccgtatttccccaaatgtcccatgttatgggnggggnatggttaatttggaaaaatccttaatgtactggaac

SEQ ID NO: 11720 - protein, 130 aa, Zea mays
  misc_feature: Ceres CLONE 1364429-F
  misc_feature (16)..(130): Pfam Name: Ribosomal_L22e Pfam Description: Ribosomal L22e protein family
  misc_feature (82)..(82): Xaa is any aa, unknown, or other
MARGVVSAKGGAVAGKKKGSVSFTIDCTKPVEDKIMEVASLEKFLQERIKVAGGKAGNLGDSVTISREKTKVTVTSDGPFSXRYLKYLTKKYLKKHNVRDWLRVVAANKDRNVYELRYFNIAENEGEEED

SEQ ID NO: 11721 - DNA, 741 bp, Zea mays
  misc_feature: Ceres CLONE 1364435-F
  misc_feature: Encodes the peptide sequence at SEQ ID NO. 11722
  misc_feature (490)..(490): n is a, c, t, g, unknown, or other
aagctggagctccccgcggtggcggccgctctagaactagtggatcccccgggctgcaggaattcgcacgagaccattacctagaacatcctatgcgaaaaagactccagtctcctctagtcgtatcgcgcgtttaaccttccccaccccgccggcgccatcggaggcccgcagccgcatccgctatgggtgagcacaagtacgtctcgtagctatgacgtaggaagcagtccgatgtgatgcggttcgtgcagcgcgtgcgctgctgtgattacaggcagcagtcggtcatcctccgcctcacaaggcccactcgccctgacaaggcgcggcggctcggttacaaggccaaagcagggttattgttgtttaccgagtgccgggtaaccccggttgcaagaaaaaggcctggtgcctaaaaggaattgcctatgggaaagccaaaagaaccaggggaattccccaagctccagtttccagaggaaacaanaaggttctgtttactgaagaaaacggcctgggaaaaaaagctttgggtggaactccagggtatctccaactccctactggggtgaaatgggggaaaacgcacctaacaaggaacttttgaaaaacatttcttgggtgaggggggcgccaaaccatacaattccgggaaaggatcccaaggagacaaaacggacaatagaaacaccctggggcaaaaaagcacccgggagagctcccgggtgcctcccaccg

SEQ ID NO: 11722 - protein, 59 aa, Zea mays
  misc_feature: Ceres CLONE 1364435-F
MRFVQRVRCCDYRQQSVILRLTRPTRPDKARRLGYKAKAGLLLFTECRVTPVARKRPGA

SEQ ID NO: 11723 - DNA, 651 bp, Zea mays
  misc_feature: Ceres CLONE 1364436-F
  misc_feature: Encodes the peptide sequence at SEQ ID NO. 11724
  misc_feature (394)..(394): n is a, c, t, g, unknown, or other
  misc_feature (551)..(551): n is a, c, t, g, unknown, or other
tggagctccccgcggtggcggccgctctagaactagtggatcccccgggctgcaggaattcgcacgagaccattacctagaacatcctaatgaaaaaccgcccagctgcaccctgcagcgctcactcgctcactgactcactcccctcccctggcctcctcctctctctctctctctccactctctcccacagccgaaccaacatgcaggggcgcagcagggacgccgccaccgtcgctgcagcggtggtgtgcgcagctgcgctgctcctcggcgacgcctggaccgtctcggcgcaggcggcggcggaggaggacaagataagcgccctgccggggcagccgccggtgggcttcgcacagtactccggttacatcccggtggacgccgcggngaagcgctccctcttctactacttcgccgaggcggaggcggatccggcggccaagccgctcgtgctctggctcaatggagggcctgggtgctcatcccgtggagtgggggcgttctcagagaatgggccgttcaggcctagcggcaatgcgctgacngagaacgagtacagctggaaaacaagagccatatgctgtatctggagagcccctgcaggggtggcttttcatactccactgatcctgctttctacgaggg

SEQ ID NO: 11724 - protein, 149 aa, Zea mays
  misc_feature: Ceres CLONE 1364436-F
  misc_feature: SWISSPROT Homolog: EC 3.4.16.6 Carboxypeptidase D
  misc_feature (64)..(64): Xaa is any aa, unknown, or other
MQGRSRDAATVAAAVVCAAALLLGDAWTVSAQAAAEEDKISALPGQPPVGFAQYSGYIPVDAAXKRSLFYYFAEAEADPAAKPLVLWLNGGPGCSSRGVGAFSENGPFRPSGNALTENEYSWKTRAICCIWRAPAGVAFHTPLILLSTR

SEQ ID NO: 11725 - DNA, 676 bp, Zea mays
  misc_feature: Ceres CLONE 1364437-F
  misc_feature: Encodes the peptide sequence at SEQ ID NO. 11726
  misc_feature (404)..(404): n is a, c, t, g, unknown, or other
  misc_feature (433)..(433): n is a, c, t, g, unknown, or other
  misc_feature (434)..(434): n is a, c, t, g, unknown, or other
  misc_feature (446)..(446): n is a, c, t, g, unknown, or other
  misc_feature (529)..(529): n is a, c, t, g, unknown, or other
  misc_feature (530)..(530): n is a, c, t, g, unknown, or other
  misc_feature (539)..(539): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (594)..(594): n is a, c, t, g, unknown, or other
aagctggagctccccgcggtggcggccgctctagaactagtggatcccccgggctgcaggaattcgcacgagaccattacctagaacatcctaatcgaaaaacctttgccgctccgcatccgaagccaccgagccgctacccgtcgcagccgccgcgaaatggccgccggcgcgcgccccctggtctccgtgagggccctggagggcgacatggccacggactccgtcggtgtcccgcttccggacgtcctccgcgcgccgatccgcccagacatcgtccgcttcgtccacaagctcctgtcctgcaacagccggcagccgtacgcggtgtcgcgtcgcgctggccaccagacctccgcggagtcctggggcacggggcgtgcggtgtcccgtatcccccgcgnttcctggcggtggtacccaccgcgccggnncaggagccttcngcaacatgtgcccgtggcggacgcatgtttgcgcccaccaagaatctggcgccgctggcacccgcgcgtcacatccacctccnngcgtgtggncatcgcctccgccctcgnnngcaccggcgtccccgtccctcgtctcgccgggggncaccgggggtggagtctgtccccgagctttcggctcgtcgtttccgacctcggcgagttccattgagaagacagctcagggc

SEQ ID NO: 11726 - protein, 166 aa, Zea mays
  misc_feature: Ceres CLONE 1364437-F
  misc_feature (23)..(165): Pfam Name: Ribosomal_L4 Pfam Description: Ribosomal protein L4/L1 family
  misc_feature (82)..(82): Xaa is any aa, unknown, or other
  misc_feature (92)..(92): Xaa is any aa, unknown, or other
  misc_feature (96)..(96): Xaa is any aa, unknown, or other
  misc_feature (124)..(124): Xaa is any aa, unknown, or other
  misc_feature (127)..(127): Xaa is any aa, unknown, or other
  misc_feature (133)..(133): Xaa is any aa, unknown, or other
  misc_feature (134)..(134): Xaa is any aa, unknown, or other
MAAGARPLVSVRALEGDMATDSVGVPLPDVLRAPIRPDIVRFVHKLLSCNSRQPYAVSRRAGHQTSAESWGTGRAVSRIPRXSWRWYPPRRXRSLXQHVPVADACLRPPRIWRRWHPRVTSTSXRVXIASALXXTGVPVPRLAGGHRGWSLSPSFRLVVSDLGEFH

SEQ ID NO: 11727 - DNA, 679 bp, Zea mays
  misc_feature: Ceres CLONE 1364442-F
  misc_feature: Encodes the peptide sequence at SEQ ID NO. 11728
tggagctccccgcggtggcggccgctctagaactagtggatcccccgggctgcaggaattcgcacgagaccattacctagaacatcctaatcgaaaaaggaccggtcactcggcacgcaggctagcagcacagcagcagccagagccatcccctctcctcgctacgcttcgcttcctcggcgccgattcctcctcctcctcctccaccctcgtccgtccccttccggcgcgcgagctcgcccgagatggcgaacgcgagatcgggtgtcgctgtgaacgatgagtgcatgctgaagtttggcgagctgcagtcgaagaggctgcaccgcttcataactttcaagatggacgacaagttcaaggagatagttgtggaccaggtcggggatcgcgctaccagctacgatgacttcacaaacagcctccctgagaatgactgccgatacgcgatctatgatttcgactttgttactgcagaggatgtccagaagagcaggatcttctatatcctatgggtcccatcctcccgccagggtgagagcaagatgctttatgcaagctcaaaccagaaatttcagagtggccctcatggcattcaggttggactcccaggcacagatgcgagtgaaatcagcctcgatgagatcaagggatcggcacgctaggcgcaccgccatcg

SEQ ID NO: 11728 - protein, 139 aa, Zea mays
  misc_feature: Ceres CLONE 1364442-F
  misc_feature (12)..(139): Pfam Name: Cofilin_ADF Pfam Description: Cofilin/tropomyosin-type actin-binding protein
MANARSGVAVNDECMLKFGELQSKRLHRFITFKMDDKFKEIVVDQVGDRATSYDDFTNSLPENDCRYAIYDFDFVTAEDVQKSRIFYILWVPSSRQGESKMLYASSNQKFQSGPHGIQVGLPGTDASEISLDEIKGSAR

SEQ ID NO: 11729 - DNA, 691 bp, Zea mays
  misc_feature: Ceres CLONE 1364447-F
  misc_feature: Encodes the peptide sequence at SEQ ID NO. 11730
  misc_feature (548)..(548): n is a, c, t, g, unknown, or other
  misc_feature (588)..(588): n is a, c, t, g, unknown, or other
  misc_feature (597)..(597): n is a, c, t, g, unknown, or other
  misc_feature (621)..(621): n is a, c, t, g, unknown, or other
  misc_feature (631)..(631): n is a, c, t, g, unknown, or other
  misc_feature (691)..(691): n is a, c, t, g, unknown, or other
aaagctggagctccccgcggtggcggccgctctagaactagtggatcccccgggctgcaggaattcgcacgagaccattacctagaacatcctaatcgaaaacactttagctgaagattccatccatgttgaagcaaatggtcacaatgagacacaagtgagagtttctgtcaatgatgatgcaaatagcacgacaatagtcatcaaagttgcagaaaaatcctgcaacatcagcattcacagtgcaatcacaagggagacggctggcagtggcagagtcataaggatgccacttacgccaacatacacgctactgccagtcttccttctcctctttgcggtggcagtgtgcatcgtggtccggaggtggcgcaaccaggacggcgaccctgcgtatcagaagctagacatgtcagacttgccggtttcggttggaggcaagaaagaacatgacgatcggtctgacaagtgggacgacaactggggagatgactgggacgacgagaaagctcccgtgacgcccatcaagcctctgcccaacccttcgntcaaaggtctcgccccgaggcgatcggcgaaagatggtgnaaaagatanttagcacatgacgccacttaaaangagcattgcngaaatagttccagtgcatgcagtatattttaccctcatcttttgtgtaaatatttctgan

SEQ ID NO: 11730 - protein, 103 aa, Zea mays
  misc_feature: Ceres CLONE 1364447-F
  misc_feature (88)..(88): Xaa is any aa, unknown, or other
  misc_feature (101)..(101): Xaa is any aa, unknown, or other
MPLTPTYTLLPVFLLLFAVAVCIVVRRWRNQDGDPAYQKLDMSDLPVSVGGKKEHDDRSDKWDDNWGDDWDDEKAPVTPIKPLPNPSXKGLAPRRSAKDGXKD

SEQ ID NO: 11731 - DNA, 669 bp, Zea mays
  misc_feature: Ceres CLONE 1364462-F
  misc_feature: Encodes the peptide sequence at SEQ ID NO. 11732
  misc_feature (352)..(352): n is a, c, t, g, unknown, or other
  misc_feature (362)..(362): n is a, c, t, g, unknown, or other
  misc_feature (662)..(662): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
tggagctccccgcggtggcggccgctctagaactagtggatcccccgggctgcaggaattcgcacgagaccattacctagaacatcctaatcgaaaaactcgctaaacgctcccgttctcctccgcctgcccccaccggctccccttgtacacgagcgccggagacgccatggcggcggcgcagccgaagccggccaagaggctgggcggcatggcggaggcgctcgccatcgccgccgacctcggattccccgcctctaccacgcaggaagatcagactagctccgacaaaagcgatgatttggtgaaggttttgagggaactgactgtcgtgcagaggaacattgccaancttgcagtgnagctacagggaagaaaggatgataaaaacattgctcatttgactcatgggagtgagatggaaaaaaagtgcgagtcttgggccagattgactgcaattttgaaagatgtaatccaaaaacaagaatcgattattggtcgggtgcaacagccttaatccccttgactggataccagttggaagtggaaaccaaaaaacaatctccggagctacttctgaaaagcacaaagggactatggggggtttgacagaatcagtcggggattttccagggggcccaaaattttgggaaatcccatangctnnnn

SEQ ID NO: 11732 - protein, 115 aa, Zea mays
  misc_feature: Ceres CLONE 1364462-F
  misc_feature (61)..(61): Xaa is any aa, unknown, or other
  misc_feature (65)..(65): Xaa is any aa, unknown, or other
MAAAQPKPAKRLGGMAEALAIAADLGFPASTTQEDQTSSDKSDDLVKVLRELTVVQRNIAXLAVXLQGRKDDKNIAHLTHGSEMEKKCESWARLTAILKDVIQKQESIIGRVQQP

SEQ ID NO: 11733 - DNA, 729 bp, Zea mays
  misc_feature: Ceres CLONE 1364465-F
aaagctggagctccccgcggtggcggccgctctagaatagtggatcccccgggctgcaggaattcgcacgagaccattacctagaacatcctaatcaaaaaatctccctgtttaatcaatccttcaagcgcaagctgcctcctcctcgtcgtccggtcgtgagaagggatggcgggccgtggcaaggctatcggcgctggcgccgcgaagaagcaacgtcgaggagctccaaggccggactccagttccccgtcggcaggattgctaggttcctcaaggcgggcaagtacgctgagcgcgtcggcgccggcgcccccgtgtacctcgccgccgtcctcgagtacctcgcggctgagggtctcgaacttgccgggacggcgcgagggacaacagaagacccgcattgggcccgcgccacatcagcttgctgggcgcaacgacaaggagcttgaccaactgttgggggggtgccccattcggggcgggagggggttatgccaaaatccatcaagatttggtccccaaaaagggttccctcctccaaggccaggtgccaacaaaacaaaaaatggaaaatgtttccttgaaaaaaggcccccccccccccctttgttttaagaaaaaaaaggagagtttttccttcccacccgggagagaaccccttttttttgttgaaaagaaaaaaaaaaaaaaaaaacctggttttttttgagggggaggggcggaggg

SEQ ID NO: 11734 - DNA, 682 bp, Zea mays
  misc_feature: Ceres CLONE 1364467-F
  misc_feature: Encodes the peptide sequence at SEQ ID NO. 11735
  misc_feature (567)..(567): n is a, c, t, g, unknown, or other
aaagctggagctccccgcggtggcggccgctctagaactagtggatcccccgggctgcaggaattcgcacgagaccattacctagaacatcctaatcgaaaaaccagagtcatcgcggcgtgttcaaatcccacaatcttcttgtagcacaccactgtcttcgtccaactcggcggcgatgtctgggcgcggcaagggcggcaaggggctgggcaagggtggtgcgaaacgccaccgtaaggttctccgcgacaacatccagggtatcacgaagccggcaatccggaggctggcgaggaggggcggcgtgaagcgtatctccgggcttatctacgaggagacccgcggcgtgctcaagatcttcctcgagaatgtcatccgcgacgcggtcacctacaccgagcacgctcgccgcaagaccgtcaccgccatggatgttgtgtacgccctcaagcgccagggccgcactctgtacgggttcggtggttgagcgcatctcttccctcgtctgcagcggctgccggtggcgtttccctcagtccctctgccttgcttggcttgatgtanagagtatcagattaaatatctctgatgtgcttcggtattgggtgaatcatgtgtcccagcagtgctgggaaatcgagatcagatgtatctttctttgcagtaatgaaatgttaaa

SEQ ID NO: 11735 - protein, 103 aa, Zea mays; identical to SEQ ID NO: 6459
  misc_feature: Ceres CLONE 1364467-F
  misc_feature (25)..(94): Pfam Name: Histone Pfam Description: Core histone H2A/H2B/H3/H4

SEQ ID NO: 11736 - DNA, 672 bp, Zea mays
  misc_feature: Ceres CLONE 1364470-F
  misc_feature: Encodes the peptide sequence at SEQ ID NO. 11737
  misc_feature (449)..(449): n is a, c, t, g, unknown, or other
  misc_feature (489)..(489): n is a, c, t, g, unknown, or other
  misc_feature (496)..(496): n is a, c, t, g, unknown, or other
  misc_feature (518)..(518): n is a, c, t, g, unknown, or other
aaagctggagctccccgcggtggcggccgctctagaactagtggatcccccgggctgcaggaattcgcacgagaccattacctagaacatcctaatcgaaaaatcaactcgcaattccgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatactcgccgctgagggtctggagctcgccggtatgctgccagggacaacaggngactcgcattattccgcgccacgtgtttctggcgatccgnaacgacnaggagcttggaaagctgttggncggcgtgacatcgctcacgggggggggctcccaatatcaaccctgtttggtggccaaaaaaacggggaaaaagggtccgtggggggaaacaaggggagaaatcccccaaaaagggcccccagccccaaaaaaaggaaaaggggcgggcgggggt

SEQ ID NO: 11737 - protein, 162 aa, Zea mays
  misc_feature: Ceres CLONE 1364470-F
  misc_feature (31)..(103): Pfam Name: Histone Pfam Description: Core histone H2A/H2B/H3/H4
  misc_feature (88)..(88): Xaa is any aa, unknown, or other
  misc_feature (104)..(104): Xaa is any aa, unknown, or other
  misc_feature (111)..(111): Xaa is any aa, unknown, or other
MDSTGTGAGGKGKKGAAGRKVGGPRKKSVSRSVKAGLQFPVGRIGRYLKKGRYAQRVGTGAPVYLAAVLEYSPLRVWSSPVCCQGQQXTRIIPRHVFLAIRNDXELGKLLXGVTSLTGGGSQYQPCLVAKKTGKKGPWGETRGEIPQKGPPAPKKGKGAGGG

SEQ ID NO: 11738 - DNA, 712 bp, Zea mays
  misc_feature: Ceres CLONE 1364474-F
  misc_feature: Encodes the peptide sequence at SEQ ID NO. 11739
  misc_feature (336)..(336): n is a, c, t, g, unknown, or other
  misc_feature (385)..(385): n is a, c, t, g, unknown, or other
  misc_feature (393)..(393): n is a, c, t, g, unknown, or other
aaagctggagctccccgcggtggcggccgctctagaactagtggatcccccgggctgcaggaattcgcacgagaccattacctagaacatcctaatcgaaaaagcagtcagcagtgaccaactcgaagcttcgttcttgtagtagaggtcggcagcaagcggtagagcgagaggtcgagaagatgaagagcagcactctgttggcgatcctagttctccaggcccttctggtctctacggccgtggccaaaggacctgcagggccgaagaagcagtgctggtgcggcgagtgcaccagctggtcgggcgtgtggacctgcgacgacctcctcaccnagtgcgcccgcacctgcaagaactgcgtccccgtctccacggacaaggncgccaccnagtacagatgccgcgacttccctcccgaaaactgcggctgcaagatccactagactcatccacagcggcacagccgatggatccttccatgctccctcgtccgtccgccttggctacagcaggcagccaccccatagctagctccctggtggttggtttgcatggttggatggggtggcccctcccaagcgaagaatgaattaatggcaggcgcaccgtaccgacggggtaattacagtattttctcccccaaaaaaaaaaaactccacctgggggggttaaaccctggccccccaaaaatttccctttaaaaaagggg

SEQ ID NO: 11739 - protein, 87 aa, Zea mays
  misc_feature: Ceres CLONE 1364474-F
  misc_feature (52)..(52): Xaa is any aa, unknown, or other
  misc_feature (68)..(68): Xaa is any aa, unknown, or other
  misc_feature (71)..(71): Xaa is any aa, unknown, or other
MKSSTLLAILVLQALLVSTAVAKGPAGPKKQCWCGECTSWSGVWTCDDLLTXCARTCKNCVPVSTDKXATXYRCRDFPPENCGCKIH

SEQ ID NO: 11740 - DNA, 660 bp, Zea mays
  misc_feature: Ceres CLONE 1364486-F
  misc_feature: Encodes the peptide sequence at SEQ ID NO. 11741
  misc_feature (399)..(399): n is a, c, t, g, unknown, or other
  misc_feature (494)..(494): n is a, c, t, g, unknown, or other
  misc_feature (563)..(563): n is a, c, t, g, unknown, or other
  misc_feature (634)..(634): n is a, c, t, g, unknown, or other
aagctggagctccccgcggtggcggccgctctagaactagtggatcccccgggctgcaggaattcgcacgagaccattacctagaacatcctaatcgaaaaacaactcgaagtacgagtaactccggagtccggatggctgcagcgatggacgtcgacgaagccggcggcgaggagaggcgaccgtcagagaaggagctcttccgcgccgctgagtccggcgacgccgccgcgttcgcctccctcgcccccgccgacctctccctgcgcaacgaggacggccgctccctcctccacgtcgccgccgctgccgggcatccccaggtgatgctcgcgcttgcccagtgcggtggtgacgccgcggctagcgtgctgaatgcgcaggacgagggagggtggncgccgatccactccgccgcgagctccgggcactctcaaatcgtcgacatcctgcttgagcgaggtgctgatggtaacctggttactgatggtggntcgactgcccttcattatgctgcgagtaaagggaggcttacatagctgaaaaactaatagcccatgggntgctatggtcaacagaaagacaggtttggctgcacaccctttgcataaagctgcaagcactggaaacgcgnagcttgggtgaattctcattggggaa

SEQ ID NO: 11741 - protein, 134 aa, Zea mays
  misc_feature: Ceres CLONE 1364486-F
  misc_feature (86)..(118): Pfam Name: Ank Pfam Description: Ankyrin repeat
  misc_feature: SWISSPROT Homolog: EC 2.7.11.1 Non-specific serine/threonine protein kinase
  misc_feature (89)..(89): Xaa is any aa, unknown, or other
MAAAMDVDEAGGEERRPSEKELFRAAESGDAAAFASLAPADLSLRNEDGRSLLHVAAAAGHPQVMLALAQCGGDAAASVLNAQDEGGWXPIHSAASSGHSQIVDILLERGADGNLVTDGGSTALHYAASKGRLT

SEQ ID NO: 11742 - DNA, 706 bp, Zea mays
  misc_feature: Ceres CLONE 1364491-F
  misc_feature: Pfam Name: L51_S25_CI-B8 Pfam Description: Mitochondrial ribosomal protein L51 / S25 / CI-B8 domain
  misc_feature (704)..(704): n is a, c, t, g, unknown, or other
aaagctggagctccccgcggtggcggccgctcgagaactagtggatcccccgggatgcaggaattcgcaccataccattacctacaagatcctaatcgaaaaactagggcgaccgccgtccataaacgcccagctgcccagggcttcataggttccctcgccggtgacgagcacccaatacaccaggatggcgctgaggggggtatgtcagctccagaatgtcgtgtgaaactattgccagtgcagaggtagcagcaaggcaatcagagacttcttgcagtgacatcttccagcgtataaggaaacgattcacacttagaactgctgacagagcttgtgccgcggctacatcctaacttgaccggaatttacgagatccataaccagcgagccgccatgctgataaatataccgctctacgagatactcctgcgagcctccagactaccgagctctctaggacagcaagaggtgaagctgcggaccagtacacgtaacgacgcgccccagtggccagccaaacgtggtcgacggacctgcaagatgtgcagcgatgtagcaaacaacgtgaatcacttatcgtcggtgctgcgatcttaaagaaatgcctaactcagacactaacttccgaaagacagctgccgattatgccaagactaattcgagagcctaattgatttacgcctttagcttcggactatcgngg

SEQ ID NO: 11743 - DNA, 724 bp, Zea mays
  misc_feature: Ceres CLONE 1364493-F
  misc_feature: Encodes the peptide sequence at SEQ ID NO. 11744
  misc_feature (371)..(371): n is a, c, t, g, unknown, or other
aaagctggagctccccgcggtggcggccgctctagaactagtggatcccccgggctgcaggaattcgcacgagaccattacctagaacatcctaatcgaaaagactcactaagcactgtccttcctgatcccaccgcggtctccttccgcgacacgcgcacacgccacagcgcattcgcgtacgtcaacggacgtcgaacccatcgcccatgggaggagggcacgaggagcaggagggtggcggcgcaaaggccgggggctactcctccggtctcccgccgtcggagccgccgcaggagtacgggtacggcacgttccagggccctcggcatcctccccgtcgggtcccgcagcctgcccgccctccgggntcggcggcgggcggggctacccacaacagcaacagccgtacgcgcacgcggagacgtactacggccaggggtaccagaccgtggcaggctatggtcctggtgctgaaggaagacttggaaaaatgaggcgcctcccatggtgggggcctcgggctaaggtgggggcctggtcatggggggtttttcccttgtggccattccagggaaaattggggctttcgttccgaaatggggggcgggaactggccccccgagaaaacccgggtattggtggtttgaaaattgggggcgggggtggtggcccggcccaaattccggggggaaaaaaaaggaaacacccgggtgggggaatt

SEQ ID NO: 11744 - protein, 95 aa, Zea mays
  misc_feature: Ceres CLONE 1364493-F
MGGGHEEQEGGGAKAGGYSSGLPPSEPPQEYGYGTFQGPRHPPRRVPQPARPPGSAAGGATHNSNSRTRTRRRTTARGTRPWQAMVLVLKEDLEK

SEQ ID NO: 11745 - DNA, 655 bp, Zea mays
  misc_feature: Ceres CLONE 1364502-F
  misc_feature: Encodes the peptide sequence at SEQ ID NO. 11746
aaagctggagctccccgcggtggcggccgctctagaactagtggatcccccgggctgcaggaattcgcacgagaccattacctagaacatcctaatcgaaaaatctccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgagggagcggtggaggcgcccaaggggttcgtggccccgcagctggaccccagcacggcgtccccgatcttcggcggcagcacgggcgggctgctccgcagggcgcagtggaggagtctacgtcatcacgtggacgtcccccaaggagcaggtgtcgagatgcccaccggcggcgcggcatcatgcggaaggcccccacctcttgaagctggccgcaagaacagtgcctggcgctcggcacaggttgcgctccaggacagatcacctacagttctacggctcttcccaagggggaggggcagacctcccccccaggacgggctaccgaagaagtc

SEQ ID NO: 11746 - protein, 160 aa, Zea mays
  misc_feature: Ceres CLONE 1364502-F
MAMATQASAATRHLLAAAWAPAAKPRQLSSQLALPSSSSRGPAPLRASTEGAVEAPKGFVAPQLDPSTASPIFGGSTGGLLRRAQWRSLRHHVDVPQGAGVEMPTGGAASCGRPPPLEAGRKNSAWRSAQVALQDRSPTVLRLFPRGRGRPPPQDGLPKK

SEQ ID NO: 11747 - DNA, 702 bp, Zea mays
  misc_feature: Ceres CLONE 1364506-F
  misc_feature: Encodes the peptide sequence at SEQ ID NO. 11748
  misc_feature (432)..(432): n is a, c, t, g, unknown, or other
  misc_feature (436)..(436): n is a, c, t, g, unknown, or other
  misc_feature (451)..(451): n is a, c, t, g, unknown, or other
  misc_feature (535)..(535): n is a, c, t, g, unknown, or other
aaagctggagctccccgcggtggcggccgctctagaactagtggatcccccgggctgcaggaattcgcacgagaccattacctagaacatcctaatcgaaaaaagccgccctatcgtcctgtcgtgagaagcaatggcgggccgtggcaaggcgattggcgctggtgccgcgaagaaggcgacgtcaaggagctccaaggctgggctgcagttcccagtcggcaggatcgcccgtttcctcaaggccggcaagtacgccgagcgcgtgggcgccggcgcccctgtctacctcgccgctgtcctcgagtacctcgccgctgaggtcctggagcttgctgggaacgcagcgagggataacaagaagacccgcatcgtgccgcgtcacatccagctcgccgtgcgcaacgacgaggagctgaccaagctgctggntggntgcaccatcgcgagncgcgggcgtatgcccaacatccaccagcacctcctccccaagaaggctggctcgtccaggcctcccacgtcgatgacgatgacnactgaagctgcccactgaagagaagcatccgctaccggctgggttcctaggtttaccccccagttaagcagcatgtctttggaaactccaagggtttggaatagacaaaactccttttcttggtccctaaaaaacgttggttccaagggaaaaccgctaaggttttg

SEQ ID NO: 11748 - protein, 139 aa, Zea mays
  misc_feature: Ceres CLONE 1364506-F
  misc_feature (19)..(92): Pfam Name: Histone Pfam Description: Core histone H2A/H2B/H3/H4
  misc_feature (100)..(100): Xaa is any aa, unknown, or other
  misc_feature (106)..(106): Xaa is any aa, unknown, or other
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLXGCTIAXRGRMPNIHQHLLPKKAGSSRPPTSMTMTTEAAH

SEQ ID NO: 11749 - DNA, 676 bp, Zea mays
  misc_feature: Ceres CLONE 1364514-F
  misc_feature: Encodes the peptide sequence at SEQ ID NO. 11750
  misc_feature (501)..(501): n is a, c, t, g, unknown, or other
tggagctccccgcggtggcggccgctctagaactagtggatcccccgggctgcaggaattcgcacgagaccattacctagaacatcctaatcgaaaaatcacactctaatcaacaagcaggaccagctagctagctcctcccactgctatcacccgggccccggccagccatctcgctgaaagagaaaagcgcagccatgaagactactagctcgggcattgcagccgtcctcctggtgccgatgctggcagtccaggccgcggtggtcgacatctcgtgctccgacgtgctcaacgacctgacgccgtgcctgcccttcctgcaggacaaggcagccaaacccagcgagagcaacaaccagtgctgcgacggcgtgacgaccctgtactcggtgctgaacaccagtcccgacaggaagggcacgtgccgatgactcaaggctgtctacgctcaggtccacgctgagctctccgcgacgcatgagctgcccggcgactgcngacctctcgctgtcctacacgtccccccccgacttcgactgggacaagatcgaatgaagggatcctgtttcccttacagaaatccaaaccacgggaatggtgatagttcagggccactttttagcaggaggcttgcctcttcccctggagtgctaaaaataagggattttggttg

SEQ ID NO: 11750 - protein, 78 aa, Zea mays
  misc_feature: Ceres CLONE 1364514-F
MKTTSSGIAAVLLVPMLAVQAAVVDISCSDVLNDLTPCLPFLQDKAAKPSESNNQCCDGVTTLYSVLNTSPDRKGTCR

SEQ ID NO: 11751 - DNA, 755 bp, Zea mays
  misc_feature: Ceres CLONE 1364515-F
  misc_feature: Encodes the peptide sequence at SEQ ID NO. 11752
  misc_feature (245)..(245): n is a, c, t, g, unknown, or other
  misc_feature (324)..(324): n is a, c, t, g, unknown, or other
gctggagctccccgcggtggcggccgctctagaactagtggatcccccgggctgcaggaattcgcacgagaccattacctagaacatcctaatcgaaaaaccacctcccccattttcgccgccccctccgatctcgccgttctcgtctccttccgttggattagggctcttcatctgttcgccgcacttcgtcagtcgcccatggcggatgaggaggtcactgatccaaaggcgctcctagaggnatcgttcaatgctaagtgtgtgtcgcagtgttatgattatcagaaatgtgttaaaaggatttgagacgatgagactggncacaagcactgtaccggtcagtactttgattactgaaaatgtgttgaccagaatgttgcagagaaactctttgagagaatgtaaaaatgacaaatttttcccctccattttatccacctaaaggttgggaaataattggtatccctttaaggagggcccaataaacttattaagggcctttaattattttggcaaaaaatttttgccccttttgggggaaaaaaaaaattttcccatggccgggttgcattttctttccggccaaaaagaatggaacccccaggggtttcccccattgggtggaaaaaaaacaaggggaaatttccccaaaaaggggggggagaaaataaaagggttatatagggcccttttttgtttttaggggggttttttgagagaagaaaaaaataaaatacttcggggtaaaaggg

SEQ ID NO: 11752 - protein, 35 aa, Zea mays
  misc_feature: Ceres CLONE 1364515-F
  misc_feature (15)..(15): Xaa is any aa, unknown, or other
MADEEVTDPKALLEXSFNAKCVSQCYDYQKCVKRI

SEQ ID NO: 11753 - DNA, 719 bp, Zea mays
  misc_feature: Ceres CLONE 1364565-F
  misc_feature: Encodes the peptide sequence at SEQ ID NO. 11754
  misc_feature (415)..(415): n is a, c, t, g, unknown, or other
agagctggagctccccgcggtggcggccgctctagaactagtggatcccccgggctgcaggaattcgcacgagaccattacctagaacatcctaatcgaaaaaggacgggacgggagagagagagagaggcgcgtgcgttcgtggtcggtgccggtgcgtgcgtggcgtggtggccgctgccgtacgtgatccgtccaccccctctcctcttccgacgccggcgacagcgggaggtactcccggggaggaatggccgtggcaagggctccgctcggcgcggttgctgcgatggcggtggccgctctcgtcttcgccatactcatgaccgccgccgctgcggcgcaggcaccggcgcccgcgcccaccagcgacggcacatcaatcgacctggggattgcgtacatccttatgctnggtgccctagtgctcacctacctgatccacccgcttgacgcgtcctccccctacaagctctttctgatccctgcggcttttccgtttggtcatgcgggttaaggcggcgataggattttgagttaggcaacgttgcttaggtggaggctggaaggtttaggatgatgattggcgggcatccgggcttggttggaaataaaggattggagggcccaaaccttgggggggccggaatgggtttggatttgggcggcccccctgatttttttggctcacccccctcattttggtcaaaaaaaaaaaa

SEQ ID NO: 11754 - protein, 88 aa, Zea mays
  misc_feature: Ceres CLONE 1364565-F
  misc_feature (12)..(65): Pfam Name: DUF1070 Pfam Description: Protein of unknown function (DUF1070)
MAVARAPLGAVAAMAVAALVFAILMTAAAAAQAPAPAPTSDGTSIDLGIAYILMLGALVLTYLIHPLDASSPYKLFLIPAAFPFGHAG

SEQ ID NO: 11755 - DNA, 704 bp, Zea mays
  misc_feature: Ceres CLONE 1364567-F
  misc_feature: Encodes the peptide sequence at SEQ ID NO. 11756
agagctggagctccccgcggtggcggccgctctagaactagtggatcccccgggctgcaggaattcgcacgagaccattacctagaacatcctaatcgaaaagacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtgctggccatggtctggcagcgcaagagtgtcgtcacaactggccgcaagatcattggcgccaccaaccccctggcttctgagcccggcaccattccgcggcgacttttgctgtcgacattggccaggaatgccatttctggaagtgacagccattgaaagcgctaataaggacattgcccctgtgccccccccgaggccccctgctgattggcagaccacccatccccccctggcccctaccaagaacaaaacctgcccaagttttcacccccaaccccttgtataccccataagcaagtattgccccccacttcggggtctttaaccaatgg

SEQ ID NO: 11756 - protein, 121 aa, Zea mays
  misc_feature: Ceres CLONE 1364567-F
  misc_feature (2)..(120): Pfam Name: NDK Pfam Description: Nucleoside diphosphate kinase
  misc_feature: SWISSPROT Homolog: EC 2.7.4.6 Nucleoside-diphosphate kinase
MESTFIMIKPDGVQRGLIGEIISRFEKKGFYLKALKLVNVERSFAEKHYADLASKPFFQGLVDYIISGPVLAMVWQRKSVVTTGRKIIGATNPLASEPGTIPRRLLLSTLARNAISGSDSH

SEQ ID NO: 11757 - DNA, 674 bp, Zea mays
  misc_feature: Ceres CLONE 1364571-F
  misc_feature: Translation starting site: 288
  misc_feature: Pfam Name: zf-C3HC4 Pfam Description: Zinc finger, C3HC4 type (RING finger)
  misc_feature (460)..(460): n is a, c, t, g, unknown, or other
caaagctggagctccccgcggtggcggccgctctagaactagtggatcccccgggctgcaggaattcgcacgagaccattacctagaacatcctaatcgaaaaacgttcacggttcaccagtctcgtcgtgtccgttcgcgatcgggcaaacctgcaaccctttcctcttcgtccccccgctctctcgttgccccaagccggagtacggagtacggcagtcgcacccccgtcgtcccgttccttgctcgccccaacttcgccgccgcgtccccctcggctcctagtgatgtctggtggtaacgcgtggtcgccgctcccttcgcacggatttgaatccgactccggcggcatggggagccgcgcaggcgaccctgtggcgaggacaacagcagcggcggtggcggtagcagcaaggactcgggcagcttcgagtgcaacatctgtctggacctggcgcangatcccgtggtcaccctctggcgccacctcttctgctggccatggctctacgagtggctccacgtgcacgcgcactccaaggagtgccccgtctgcaaggcgtcgtcgaagaagggaaactcgttcctctctacgggcgtggtggcaactccacctccacccgttgcagggtcgtgggccggtgtggaaatccccaacaggcccaaccggcaac

SEQ ID NO: 11758 - DNA, 666 bp, Zea mays
  misc_feature: Ceres CLONE 1364572-F
  misc_feature: Encodes the peptide sequence at SEQ ID NO. 11759
tggagctccccgcggtggcggccgctctagaactagtggatcccccgggctgcaggaattcgcacgagaccattacctagaacatcctaatcgaaaaatccgcaggccatacagggacccccacgaggtgaagaacctgtacgaggatagggaacctttctgtcttcagagcacctttctcacatggccacaggccagagtaagaagtacgtgagactgaccaccgacttctcgctcgttggtcgacacgacttgcactgcgcgtccacctacctgctcagcgccgtctaccaccagctggtgctgcacctcttcattgaccccgactacaatcagagtgaggcgatctgctgagaatccaccgcgtccccgtggagagccctctcagagttctctgaccctattatcgcaaagaatcatggagcttacaccgcatgtaagcctggaactgcctgagcactacaggtaccccccaatgaaattatgctcgtttgttaaacatcctctctagagatcgtgtctgagaagcctctgacagctatccatgacccccctgtaagctcgtttggctataagaagaaggtccctcggtctaacctgcagggggtggcccatttacaacattcccccgattaaaggccgggaaccacggccaccctactcccg

SEQ ID NO: 11759 - protein, 56 aa, Zea mays
  misc_feature: Ceres CLONE 1364572-F
MATGQSKKYVRLTTDFSLVGRHDLHCASTYLLSAVYHQLVLHLFIDPDYNQSEAIC

SEQ ID NO: 11760 - DNA, 723 bp, Zea mays
  misc_feature: Ceres CLONE 1364574-F
  misc_feature: Encodes the peptide sequence at SEQ ID NO. 11761
  misc_feature (387)..(387): n is a, c, t, g, unknown, or other
agagctggagctccccgcggtggcggccgctctagaactagtggatcccccgggctgcaggaattcgcacgagaccattacctagaacatcctaatcgaaaacccatccatcacagctagctagcatacagacgaataatctcttcttcacctcactaacaccagctagcaactctttctctcctgcaataatggccgctcgctcctcctcctcccagccgcagctggtcgcggaggcggcggtcctggcagcggagctgctgctgctggcggcggtggccgtgacggagacgccgacggtgagctgcgaagaggtgacgtcgtcgatgccgccgtgcctcggatacgcgatgggcagcgcggcgtcgccctccgcgacgagctgcnagcgggtgcgctcgctcaacagccgcgcgtcgtcggcgggggaccggcaggccacctgcaactgcctcaagagcatgacgggacgggtcggcggcggcgccagcatggccaacgccgccaacatcccccggaaaggcgggcgtctccctcgggggtgcccatcagccccaccgtggactggaacaagatccactgacccatgggaaccataggggaaggaacctccccccgtgggatagcaaagggacggggcccatcaaaaacaaccaatcccccgtcggaaccaaaaaagtcccaaactaccggtggggtcacgggttaaaaatggcccaaaaa

SEQ ID NO: 11761 - protein, 135 aa, Zea mays
  misc_feature: Ceres CLONE 1364574-F
  misc_feature (39)..(118): Pfam Name: Tryp_alpha_amyl Pfam Description: Protease inhibitor/seed storage/LTP family
  misc_feature (66)..(66): Xaa is any aa, unknown, or other
MAARSSSSQPQLVAEAAVLAAELLLLAAVAVTETPTVSCEEVTSSMPPCLGYAMGSAASPSATSCXRVRSLNSRASSAGDRQATCNCLKSMTGRVGGGASMANAANIPRKGGRLPRGCPSAPPWTGTRSTDPWEP

SEQ ID NO: 11762 - DNA, 690 bp, Zea mays
  misc_feature: Ceres CLONE 1364577-F
  misc_feature: Encodes the peptide sequence at SEQ ID NO. 11763
  misc_feature (611)..(611): n is a, c, t, g, unknown, or other
  misc_feature (647)..(647): n is a, c, t, g, unknown, or other
agagctggagctccccgcggtggcggccgctctagaactagtggatcccccgggctgcaggaattcgcacgagaccattacctagaacatcctaatcgaaaaatcttgctctgaacgcattcctcccatctcccaagacctcctcagacccgagaagcgcagctgcggccatggacgccaccggcactggagctggagggaaggcgaagaagggagcggccggtcgcaaggccggctggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgcttaccggcgtgaccatcgcccacggcggcgtggtgcccaacatcaacccggtcctgctgcccaagagacggcggagaaagcgtccagccgcgggagcaaggagccaagtncgccaagaagggcgccaagtccccccagaaggcatnagggttggaggcggatccaatggtgtcatgtgtaggttgtaaa

SEQ ID NO: 11763 - protein, 172 aa, Zea mays
  misc_feature: Ceres CLONE 1364577-F
  misc_feature (31)..(104): Pfam Name: Histone Pfam Description: Core histone H2A/H2B/H3/H4
  misc_feature (159)..(159): Xaa is any aa, unknown, or other
MDATGTGAGGKAKKGAAGRKAGWPRKKSVTRSVKAGLQFPVGRIGRYLKKGRYAQRVGSGAPVYLAAVLEYLAAEVLELAGNAAKDNKKTRIVPRHVLLAIRNDEELGKLLTGVTIAHGGVVPNINPVLLPKRRRRKRPAAGARSQVRQEGRQVPPEGXRVGGGSNGVMCRL

SEQ ID NO: 11764 - DNA, 725 bp, Zea mays
  misc_feature: Ceres CLONE 1364579-F
  misc_feature: Encodes the peptide sequence at SEQ ID NO. 11765
  misc_feature (534)..(534): n is a, c, t, g, unknown, or other
  misc_feature (581)..(581): n is a, c, t, g, unknown, or other
  misc_feature (584)..(584): n is a, c, t, g, unknown, or other
  misc_feature (586)..(586): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
aaagctggagctccccgcggtggcggccgctctagaactagtggatcccccgggctgcaggaattcgcacgagaccattacctagaacatcctaatcgaaaaagtcgcatctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgccgccaagaaggcatcccccaagacaangctaagccgcaaaggccgccgctgccaagacaccgccccccagccgncangncgccgcgccagtcaagaagcagcgctgccagccaagaggcgctgctgtggacagcgcagtgccaaaaagctgcgacaattcgacccactagannnnnnnnnnnnnnnnnnnnnnnnnnnnnnnnnnnnnnnnnnnnnnn

SEQ ID NO: 11765 - protein, 162 aa, Zea mays
  misc_feature: Ceres CLONE 1364579-F
  misc_feature (35)..(105): Pfam Name: Linker_histone Pfam Description: linker histone H1 and H5 family
  misc_feature (115)..(115): Xaa is any aa, unknown, or other
  misc_feature (131)..(131): Xaa is any aa, unknown, or other
  misc_feature (132)..(132): Xaa is any aa, unknown, or other
MPALAKPASRTAKPAAAPKPKPAAAKPKAATAGASHPPYFEMIKEAITALKERTGSSSQAIAKYVGDKHGASLPANFKKMLSIQLRGSAAKGKLVKVKASYKLSDAAKKASPKTXLSRKGRRCQDTAPQPXXRRASQEAALPAKRRCCGQRSAKKLRQFDPL

SEQ ID NO: 11766 - DNA, 732 bp, Zea mays
  misc_feature: Ceres CLONE 1364583-F
  misc_feature: Encodes the peptide sequence at SEQ ID NO. 11767
  misc_feature (377)..(377): n is a, c, t, g, unknown, or other
  misc_feature (416)..(416): n is a, c, t, g, unknown, or other
  misc_feature (418)..(418): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (434)..(434): n is a, c, t, g, unknown, or other
  misc_feature (436)..(436): n is a, c, t, g, unknown, or other
  misc_feature (437)..(437): n is a, c, t, g, unknown, or other
  misc_feature (443)..(443): n is a, c, t, g, unknown, or other
  misc_feature (449)..(449): n is a, c, t, g, unknown, or other
  misc_feature (452)..(452): n is a, c, t, g, unknown, or other
  misc_feature (512)..(512): n is a, c, t, g, unknown, or other
agagctggagctccccgcggtggcggccgctctagaactagtggatcccccgggctgcaggaattcgcacgagaccattacctagaacatcctaatcgaaaaatccaaccgttcctgggtcgcacagcccatcccgccgcgccgtctccctctcgccccaaacccctctcctcctctctttctctatccacctttccaccgtcaccatggccaccgccactacgtccgcctatcattgcaacgccgtcctccaccttcccagacctccgcagttccgccggctcctgccccctctcccctccctcgtcacccgcagagccgcgagcgtcgggctgggggtcgcccgtctcggttcgagggcgagggcaaggggcagntcccgtaccgccaccgccaccccatttttgaaaccgtgnangannngaggaggagangnnagagancgtggntgntccgatgcgaaggcgggattcagtgacgaggcaaaagatgagcaggaatggtccgggcgnaaacgccccgcccccgcgggaagaacctgggccccgaccccggcaaggacctatacggtgggcccgggaaatggcccgccccccgggaaactgttccgggggaaacctccccggcccgttggaaagtcccagaacctgctcaaagtttttaaacccccaggggacacggcctctcccgggggaaattccccccgaggccccagttccggaaataacccgg

SEQ ID NO: 11767 - protein, 175 aa, Zea mays
  misc_feature: Ceres CLONE 1364583-F
  misc_feature (57)..(57): Xaa is any aa, unknown, or other
  misc_feature (70)..(70): Xaa is any aa, unknown, or other
  misc_feature (71)..(71): Xaa is any aa, unknown, or other
  misc_feature (72)..(72): Xaa is any aa, unknown, or other
  misc_feature (73)..(73): Xaa is any aa, unknown, or other
  misc_feature (76)..(76): Xaa is any aa, unknown, or other
  misc_feature (77)..(77): Xaa is any aa, unknown, or other
  misc_feature (79)..(79): Xaa is any aa, unknown, or other
  misc_feature (82)..(82): Xaa is any aa, unknown, or other
MATATTSAYHCNAVLHLPRPPQFRRLLPPLPSLVTRRAASVGLGVARLGSRARARGXSRTATATPFLKPXXXXGGXXRXRGXSDAKAGFSDEAKDEQEWSGRKRPAPAGRTWAPTPARTYTVGPGNGPPPGKLFRGKPPRPVGKSQNLLKVFKPPGDTASPGGNSPRGPSSGNNP

SEQ ID NO: 11768 - DNA, 646 bp, Zea mays
  misc_feature: Ceres CLONE 1364584-F
  misc_feature: Encodes the peptide sequence at SEQ ID NO. 11769
gaaggaattcccacgagaccattacctagaacatcctaatcgaaaaaccagcggcatctatagtaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagccccctggtacgggccccgacccgcgtcaaagtacctcgggccccctcttccggggagccccccgaactaccttaccttttttttttccccgggcaactaacgggggggaaaaccccccgggtttgtcccgcgaaccccgaaaaccttttcccaaaaaaacccggaggggggggggggggaccccccccccctgggggcaattattcccggggggcccggggtggggtttttccccccaaaaattttttcccccccaaaaaggcgcaaaaatttttttggaagagcccctttttgtttaaaaggggggggggccccccaaatttttttgggggggggggggtgggggaaattttttgtgggaacccccccctttttttccccccggccaaaaaaactctcccccgcgat

SEQ ID NO: 11769 - protein, 180 aa, Zea mays
  misc_feature: Ceres CLONE 1364584-F
MAASTMAISSTAMAGTPIKVGSFGEGRITMRKTVGKPKVAASGSPLVRAPTRVKVPRAPSSGEPPELPYLFFFPGQLTGGKTPRVCPANPENLFPKKPGGGGGGPPPPGGNYSRGARGGVFPPKNFFPPKKAQKFFWKSPFLFKRGGGPPNFFGGGGVGEIFCGNPPLFFPPAKKTLPRD

SEQ ID NO: 11770 - DNA, 681 bp, Zea mays
  misc_feature: Ceres CLONE 1364587-F
  misc_feature: Translation starting site: 179
aaagctggagctccccgcggtggcggccgctctagaactagtggatcccccgggctgcaggaattcgcactataccattacctagaacatcctaatcgaaaactagccaccggatcgtcgacctcttgttcgttccgttcaggctgggaagaaatcgagcttcccaggagaggagaagatggctcgtacgaatcataccgcccgcaagtccaccggaggtaaggccccgcgtttgcatctcgccaccaaggcgttgaggaagtctgcgccgactaccggcggggtgaataatccccacaggtacaggtccgggacggtggctctgcgcgagatccgtaagtaccatgaagagcacgtagctgctgatccgagagttgcccttccagcgcctggtccgtgagatctctcaggacttcaggacggatctgcgattccagagccactgcgtcctgaacctccaggaagccgccgaggcctacctcgtcggtctgttcgaggacaccaacctctgttccatccactgcaagcgcgtaaccatcttgcctgaagacgtcctgttcgcccgccgtgtctgcggagatagctcgtatgcgtatctcgtgcccggccccaatgatgtcgtgaggatggaggagggctatctgtaaccttatgctgtttgttcgcttatagacgtcgtga

SEQ ID NO: 11771 - DNA, 702 bp, Zea mays
  misc_feature: Ceres CLONE 1364589-F
  misc_feature: Encodes the peptide sequence at SEQ ID NO. 11772
  misc_feature (443)..(443): n is a, c, t, g, unknown, or other
  misc_feature (444)..(444): n is a, c, t, g, unknown, or other
  misc_feature (465)..(465): n is a, c, t, g, unknown, or other
  misc_feature (496)..(496): n is a, c, t, g, unknown, or other
  misc_feature (497)..(497): n is a, c, t, g, unknown, or other
  misc_feature (503)..(503): n is a, c, t, g, unknown, or other
aaagctggagctccccgcggtggcggccgctctagaactagtggatcccccgggctgcaggaattcgcacgagaccattacctagaacatcctaatcgaaaaaatacgaggaggagcagagcagcaggtctctccatggatgcaagccaggatgtgtcggactgggactgggagctggtcctgccagaccacaggagcttctccctgagcaatggcggcaagaatcttgatgataaagaaacagaggagcatgatctgctgccaccgtcaggagacgttgacgtgcacgacgagtgcaagggcatcggcgtcgtgctggatgagacctgcaaatccgccgtgcctagtgttgccgatccgataatggcttctgagggtggcgaggaagagaaggcgatccagagccctgatgccgaggagtccgtcaccgccgacagcaagtnntgctcagagggagagaaggangaaagaagatatcagaagggacgcaacgatnnaggtgnagccctgatcggcgcgctgtgctcgtttgggggtcgcagccgccaccgcctgcgtctttctcatcggggggaggttgcatcatcaccaaccgcagcaccacaaaatcagctggcagtccttcggcatgataagggaatccagaaagttgggccccaaacttcaagggtgacccaaagggcatgccctttgctagggggc

SEQ ID NO: 11772 - protein, 189 aa, Zea mays
  misc_feature: Ceres CLONE 1364589-F
  misc_feature (103)..(103): Xaa is any aa, unknown, or other
  misc_feature (110)..(110): Xaa is any aa, unknown, or other
  misc_feature (121)..(121): Xaa is any aa, unknown, or other
  misc_feature (123)..(123): Xaa is any aa, unknown, or other
MDASQDVSDWDWELVLPDHRSFSLSNGGKNLDDKETEEHDLLPPSGDVDVHDECKGIGVVLDETCKSAVPSVADPIMASEGGEEEKAIQSPDAEESVTADSKXCSEGEKXERRYQKGRNDXGXALIGALCSFGGRSRHRLRLSHRGEVASSPTAAPQNQLAVLRHDKGIQKVGPQTSRVTQRACPLLGG

SEQ ID NO: 11773 - DNA, 747 bp, Zea mays
  misc_feature: Ceres CLONE 1364590-F
  misc_feature: Encodes the peptide sequence at SEQ ID NO. 11774
  misc_feature (42)..(42): n is a, c, t, g, unknown, or other
  misc_feature (51)..(51): n is a, c, t, g, unknown, or other
gctcggggccccgcccccggccgcgcccgccggccacccccnccccgcgcnccgcacagagctggcgctccaccgcggtggcggccgctctagaactagtggatcccccgggctgcaggaattcgcacgagaccattacctagaacatcctaatcgaaaaatcgtcagacacactatagaccacagccagccagccacatcactagctagctgagcagaggcaatggcgcccacgggtgagctggtgggggaggtcaagtccccggctgacaagctgtgggcggcgctgcgcgactccacggagctgttccccaagatcttccccgagcagtacaagagcatcgagaccgtcgagggcgacggcaagtcggccggcaccgtccgcctcctcaagtacaccgaggcgaggcccgatgctgacgttcgccaaggagaagcttgagacggccggacgacgagaacaaggtggtgtcgtacagcgtcggtggacggcgagctggaggacttctacaagaacttctagatcacgctgaaggtgactccgaccaaaggcggacggcagaggggcggcgccgtcgtcgggctggggcatgggagggagaacaagggccaaggaccatggtgcccgaacccgggacggtgatcaagggaggacccggccaccaaggaatgtttcctcgggaccctcggacggacttacccttcccccagcgaagcctagacgggggggcggacaacctggggaga

SEQ ID NO: 11774 - protein, 72 aa, Zea mays
  misc_feature: Ceres CLONE 1364590-F
MAPTGELVGEVKSPADKLWAALRDSTELFPKIFPEQYKSIETVEGDGKSAGTVRLLKYTEARPDADVRQGEA

SEQ ID NO: 11775 - DNA, 677 bp, Zea mays
  misc_feature: Ceres CLONE 1364592-F
  misc_feature: Encodes the peptide sequence at SEQ ID NO. 11776
  misc_feature (461)..(461): n is a, c, t, g, unknown, or other
  misc_feature (479)..(479): n is a, c, t, g, unknown, or other
  misc_feature (488)..(488): n is a, c, t, g, unknown, or other
  misc_feature (489)..(489): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (646)..(646): n is a, c, t, g, unknown, or other
aaagctggagctccccgcggtggcggccgctctagaactagtggatcccccgggctgcaggaattcgcacgagaccattacctagaacatcctaatcgaaaacccgaaaccctagctcacttaacgccgccgcggagctgctccgcgcccccgacgccggtgattaggagcaggagcaagaggggttcggaatggccaagtctaagaaccacacggcgcataaccagtcgttcaaggcgcacaagaacggcatcaagaagcccaagcgccaccgccagacctccaccaaggggatggaccccaagtttctgaggaacttgaggtactcaaggaagggcaataagaagagttgtgaggctgagtcagaggagtgagatgatgcctgagtttgtggcgacaaatgcatctcttgtatcgttagggtcttagttgtgaacttaattttcacatctgtatgattnaaagagatcatcattggntactgaagnngtgtttttttggcttgttgcctatctggagtttattttactaaaatcatcagtggggcccttgaaaatcgggcactaatggatcattttcgggtccccggggannnnnnnnnnnnnnnnnaaaaaaaaaaaaaaaaaannnannnnaaaattttttnaaaaaaaaaaaaggtctttccaacccggccc

SEQ ID NO: 11776 - protein, 60 aa, Zea mays; identical to SEQ ID NO: 195
  misc_feature: Ceres CLONE 1364592-F
  misc_feature (3)..(42): Pfam Name: Ribosomal_L29e Pfam Description: Ribosomal L29e protein family

SEQ ID NO: 11777 - DNA, 686 bp, Zea mays
  misc_feature: Ceres CLONE 1364593-F
  misc_feature: Encodes the peptide sequence at SEQ ID NO. 11778
  misc_feature (425)..(425): n is a, c, t, g, unknown, or other
  misc_feature (535)..(535): n is a, c, t, g, unknown, or other
aaagctggagctccccgcggtggcggccgctctagaactagtggatcccccgggctgcaggaattcgcacgagaccattacctagaacatcctaatcgaaaaaccgagaatcacaatacgaaacgaattaatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcggatgctgntgatcagcggcgagcggcgcccggagagcgcgaggacgccagtacctgcgcatggaagcgcggatggccaagtcatgcgcaaagtcgtgctgcccgacaacgcgacgggnacaagtccccgcccggtgcaagaacgggtgctcaccgggacggcaaaaacctgcccccgccgaaccccaaagcccaaaaccaccaaattaaggcccctgaagggaaaccttttccgaacaaggcccgggacttggggggaaacctgggaaa

SEQ ID NO: 11778 - protein, 168 aa, Zea mays
  misc_feature: Ceres CLONE 1364593-F
  misc_feature (49)..(149): Pfam Name: HSP20 Pfam Description: Hsp20/alpha crystallin family
  misc_feature (82)..(82): Xaa is any aa, unknown, or other
MDARMFGLETPRVAALHHLLDVPDGDKAGGGATRTYVRDARAMAATPADVKELAGAYAFVVDMPGLSTGDIRVQVEDERMLXISGERRPESARTPVPAHGSADGQVMRKVVLPDNATGTSPRPVQERVLTGTAKTCPRRTPKPKTTKLRPLKGNLFRTRPGTWGETWE

SEQ ID NO: 11779 - DNA, 681 bp, Zea mays
  misc_feature: Ceres CLONE 1364594-F
  misc_feature: Encodes the peptide sequence at SEQ ID NO. 11780
  misc_feature (396)..(396): n is a, c, t, g, unknown, or other
  misc_feature (433)..(433): n is a, c, t, g, unknown, or other
  misc_feature (472)..(472): n is a, c, t, g, unknown, or other
agagctggagctccccgcggtggcggccgctctagaactagtggatcccccgggctgcaggaattcgcacgagaccattacctagaacatcctaatcgaaaaagcagcacagtcatccacactaacgaacgaactgaggtcgacgacgactgatcgagcagcgacgatggcggctgtgctgaacagcaggaagacgccgcaggtggttgccgtgctggtggcggcggcgctgctggcgtcgtccgcttcggcggcgatcacctgcgggcaggtggggtcgtcgctggctccgtgcatcccgtacgcgacgggcagggccagcgcgctccccgcgtcgtgctgcagcggcgtcaagagccctcacagcgcggcgcggaccagcgcggaccgccagancgcgtgccgctgcctcaggagcctcgccaacagcgtncagagcgtcaacatgggcaccgtcgccaccatccccggnaagtgcggcgtctccgtcggattccccatcagcatgtccaccgactgcaacaggatcggctaaggtatacgaccgcccagctaataagcctaccgaacgtacccctagtcccgcgccctgcccgagtgattgaccccgggaaaaaaaaaaaaaagctttcttgattgccaggaccacttgccatttccaccaaaaattaccgggctggg

SEQ ID NO: 11780 - protein, 122 aa, Zea mays
  misc_feature: Ceres CLONE 1364594-F
  misc_feature (33)..(118): Pfam Name: Tryp_alpha_amyl Pfam Description: Protease inhibitor/seed storage/LTP family
  misc_feature (77)..(77): Xaa is any aa, unknown, or other
MAAVLNSRKTPQVVAVLVAAALLASSASAAITCGQVGSSLAPCIPYATGRASALPASCCSGVKSPHSAARTSADRQXACRCLRSLANSVQSVNMGTVATIPGKCGVSVGFPISMSTDCNRIG

SEQ ID NO: 11781 - DNA, 688 bp, Zea mays
  misc_feature: Ceres CLONE 1364602-F
  misc_feature (422)..(422): n is a, c, t, g, unknown, or other
aaagctggagctccccgcggtggcggccgctctagaactagtggatcccccgggctgcaggaattcgcacgagaccattacctagaacatcctaatcgaaaaatcacacactcgactctcctctctcgcatccgcagcctttcgagctctactccaccccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggtacctgaagaaggggccggtacgcgcagcgcgtcggcacgggcgcccccgtctacctgggcgccgtcctcgagtacctgggcgccgnagtgctggagctggccggcaacgctgccaaggacaacaagaagacccgcatcatcccgcggcacgtgctccctggccatccgaacgacgaggagttcggaaagctggtggccgggggcaccatcgcccaggggggggtcctccccaaaataaacccgggggttctggccaaaaaaaccccttaaaaggggggggccaaggaggccaattcccccaaaaaggcccccaagccccccaaaaaggaaaaagggggggggcgcctttccg

SEQ ID NO: 11782 - DNA, 706 bp, Zea mays
  misc_feature: Ceres CLONE 1364603-F
  misc_feature: Encodes the peptide sequence at SEQ ID NO. 11783
  misc_feature (675)..(675): n is a, c, t, g, unknown, or other
  misc_feature (677)..(677): n is a, c, t, g, unknown, or other
aagctggagctccccgcggtggcggccgctctagaactagtggatcccccgggctgcaggaattcgcacgagaccattacctagaacatcctaatcgaaaaattcttaaaaacctctgttcgggtctagggtttcctcccagtcgtcatcgcttggtgtccgcctcagcccgccgccaggagagttcaggagagtttcaagaagctgaaatggctcctaaagctgctcctgccaagaagggtgatgccaagacccaggccttgaaggttgccaaggctgtgaagtctgtgtcagtaacgaagaccaagaagatccgcacgtccgtgacatttcaccgccccaagaccctgaagaatgctagggaccccaagtacccaagaatcatgactaccggaaggaacaagcttgatcagtaccaaattctcaagtatcccctcaccacagaatcggcgatgatgaagattgaagataacaacactcttgtcttcattgtcgacctcaaggcagacaagaagaagatcaacgctgctgccaggaagatgtatgaccttcacgcccacgaaggtcaccaccctgatcaggcctgatggaaaagaacaaggctttacgggaaagcttatgccctgactatgaatggtctttgcacgggggcccaccaaaaacggggcttcattntnaaagtttccccttctaggaattttggttg

SEQ ID NO: 11783 - protein, 125 aa, Zea mays
  misc_feature: Ceres CLONE 1364603-F
  misc_feature (11)..(63): Pfam Name: Ribosomal_L23eN Pfam Description: Ribosomal protein L23, N-terminal domain
MAPKAAPAKKGDAKTQALKVAKAVKSVSVTKTKKIRTSVTFHRPKTLKNARDPKYPRIMTTGRNKLDQYQILKYPLTTESAMMKIEDNNTLVFIVDLKADKKKINAAARKMYDLHAHEGHHPDQA

SEQ ID NO: 11784 - DNA, 692 bp, Zea mays
  misc_feature: Ceres CLONE 1364606-F
  misc_feature: Translation starting site: 120
  misc_feature (665)..(665): n is a, c, t, g, unknown, or other
aagctggagctccccgcggtggcggccgctctagaactagtggatcccccgggctgcaggaattcgcacgagaccattacctagaacatcctaatcgaaaaactacacacaaacacacaatggcaccagaaaggatgctcctcggcgtctgtgtcgtgctgatggtggtcggcgtcacaaacgcggaggatggccaagtggcgtcgctcgtcgtgggcctggcgaggtgcgccgactgcacgaggaacaacatgaatgctgagggcgctttcaagggtcttcaggtggcgatcaagtgcaagaacagcaacggcgagtactacacaaaggctcgcgagtgagatccaaagctccggagtcttcatcgtcccactcgccgccgacctccacggcgccgactgccacgcgcagctccacagcgtctgcaataacgcgcctgtgcctgtgcaagagccgtccaggatcacacccatgtcaggcggcaccttcgtctgcatgactgactagatgcactacccgtccacggagtgcgcgtccgcgtgtctctgctccacgatctagaagcactagttagatcactttcacatagcgaccctgactggtgacggagtactactcggtgactgactacaacaagcctctggagtcggacctacaccctgtgncttgactactgcagccgggcttgaata

SEQ ID NO: 11785 - DNA, 697 bp, Zea mays
  misc_feature: Ceres CLONE 1364610-F
  misc_feature: Encodes the peptide sequence at SEQ ID NO. 11786
  misc_feature (456)..(456): n is a, c, t, g, unknown, or other
  misc_feature (590)..(590): n is a, c, t, g, unknown, or other
aaagctggagctccccgcggtggcggccgctctagaactagtggatcccccgggctgcaggaattcgcacgagaccattacctagaacatcctaatcgaaaaagagagcgttctggcagccgatgcggagcttgaacctctgcaaccaccaacagctaaactaaaagcagcggcggacggcgcgcggtactggacgaccggccgacgatggctacgccggcgcagcagcagggtgaccagcaccagccgaggctgcagaaggtgatggtggctgaagaccagagcgagtgcaaccggcacgcgttggattgggccctgcgaaccttggcgccaccctggccccaccgctactggggttcaccgggaaacccacttcccgctcggaatcgtcccccccccgtccttccgggcacccctgggacccgccccccccgggttccccgaccccaccaggcnatggcggagcgccacaaggaagttaccaaggagttcctcccaaaagccaagtcccactccgcccgaaccggggctttccgccaaaaacaaattggcaacacgccgcaactgccagggggggcaaaccgggaaangcctcaaaaaaaaaaaaagggccccccccccgactcccagaacacaccaagaggcggtgcctcaaacaaaaagggcttcccccctgtgggagggcccgaatgccaga

SEQ ID NO: 11786 - protein, 80 aa, Zea mays
  misc_feature: Ceres CLONE 1364610-F
  misc_feature (45)..(45): Xaa is any aa, unknown, or other
MAERHKEVTKEFLPKAKSHSARTGAFRQKQIGNTPQLPGGANREXPQKKKKGPPPDSQNTPRGGASNKKGFPPVGGPECQ

SEQ ID NO: 11787 - DNA, 723 bp, Zea mays
  misc_feature: Ceres CLONE 1364611-F
  misc_feature: Translation starting site: 170
tggagctccccgcggtggcggccgctctagaactagtggatcccccgggctgcaggaattcgcacgagaccattacctagaacatcctaatcgaaaagtgtgtctggaaaccctagccgccatatctcacgatccactctagcaccaagtcgagggaatggtaggagtgatggcgcgcagtgtgttgtcggtaaagggcgtggcgatcgcgatcaagaagaaggggtcggtttccttcacgatcgactgcaccgagtcagaggaggacaatatcatggagatcacctcgctcgacaagttcctgcatgagcacatgcaaggtcgccgtgggaaaggtatgcaacctcggagactccgtcaccatctctcgcgagaagaccaatgtcaccgtcacctctgagggacccttctccaagaggtacctgaagtacttgaccaataagtactagaagatgcacaacgagctggattgtctacgcgtggttgctgccaacaaggaccgaaaccgcaatgagctccggctccttcaaaattgctgaaaaacgggggccagggaagaaaattaaaatggccttacccctaaaatttttaggattgaaacttcgtggaattttggttccccgggaccccgaaaatttccgcaaattgccccccggtttaggggggggggtaggggccaaaatttaaaaaaaatcctctttttagacgggaaatctctcgaat

SEQ ID NO: 11788 - DNA, 711 bp, Zea mays
  misc_feature: Ceres CLONE 1364614-F
  misc_feature (368)..(368): n is a, c, t, g, unknown, or other
aaagctggagctccccgcggtggcggccgctctagaactagtggatcccccgggctgcaggaattcgcacgagaccattacctagaacatcctaatcgaaaaatcggctccaacaccccccgcggttatgtcgaattgatgtaggttatgttccgttgggaacaaattccacatgtcacttggtctaccggtggcggccacgatgaactgtcagtgaaatacgcgagccaataacctgtagatcatctccgtcgatgagatgaagggtcgactcaaccgcctcccgttggactgtgtcggcgacatggttgtggccaccgtaaacaagctatagcctcacctctggaatgaagtgatgccctgcgtcnacatcatgcagcaggagccgtgtcgtcacaaggactgcgtctacatgtacttcgaagataacgctggcgagagtgttaatcactacgggatatgaaatgttatgcaatcactggacgtataccgaagcaatgtgctgacctttggcctaggatccctagccaggaaatcgcatcgtttgataggttgttgaatgtagttgaacttgaggatgaacattctcaatgtgcctgccccggccatcaaggggtttcatggtacccgcggctccttttaaaagtgggccttccatttggtacggaaccaaaatttccggcggcccaaattcgctgctgggaatgtaaa

SEQ ID NO: 11789 - DNA, 844 bp, Zea mays
  misc_feature: Ceres CLONE 1364614-R
  misc_feature (1)..(1): n is a, c, t, g, unknown, or other
  misc_feature (684)..(684): n is a, c, t, g, unknown, or other
nttccgattgggtaccgggccccccctcgaggtcgacggtatcgataagcttttttttttttttttttcgcacccttttatttcttttttttttttttatttttttttttattttattataatttgttttttttttttttttcctgcaaataaaaccggtataaccccaaactatgtgtcgctccaatttcccgcggggtacggtgttaaaaaaattcagaggactcgtaacaggggggccaaaatttaacaggggaacaaaaagcccaaattctaccaaagcctccccgaggccggtcccccagaagccaaactctcaaaatttttttgcccaacgataacggtggagggaaagggtctggttgcccttacagggggccccccccaccggcctattcttggggtgaggggggcccctgacccccagaccaaagaacttcttgccgggggaaggaaaaccacggaccccccgaggcttgtccacaagattccaaaccccattgaccctggaatcattgagaagggcgagggggaccccatcaaccagaatcatctcacagtacttgggggggcttccccccttcacccccgatgagtgaaaaacccaaattcagacagggtttctcccagcccttcccctagcaacgaaagtcttggccccccgtaacttgagcagggtaacancccggctggtttggctgcccaaaaaaaaatacctttagggaaaaggcattcttggggctcccctcgcctaaccggggaaaccgggaaacaaatgtatcccctgccttggaccttataacccaagggcggagccgcactttttcaggggaaaaatgggcca

SEQ ID NO: 11790 - DNA, 693 bp, Zea mays
  misc_feature: Ceres CLONE 1364615-F
  misc_feature: Translation starting site: 227
  misc_feature: Pfam Name: Tax Pfam Description: HTLV Tax
  misc_feature (363)..(363): n is a, c, t, g, unknown, or other
aaagctggagctccccgcggtggcggccgctctagaactagtggatcccccgggctgcaggaattcgcacgagaccattacctagaacatcctaatcgaaaaatcccatctccatccccatccatagagctgcaggcggcctgcgctgcagccaacaagctcatcagctcaccgtacctaggaggacgaccgagcagctaaggtagtagtagctagctagccagtgatggcgggctacaaagcgcagggcggggcgctcggcgtcgtcctggctgtcgccgcgctcttcgcggcggcagcgatggcgatggcggtggacgacgagcacatgtaccactgtgagtgcttcaagtcgtgcacggngaactgccgcgacgaggacgcctatgacgacgtcgtcacccgacactccgagggctcctcccacgtcgtcgtcgctgacgtctccagcggaagtgcaaggacaggatgctcagcaagtgcttcgaggacggcccggtcatctgctaccaccagtgggtcgccaccaattgcccctgctacccaccctttagcaccgaaaaatgggttgggcctgaaaaaactggtggaaaaaggtgtttcccccacggcccgtctggccctaaacccagggcgcccaagggcttggccccccaaacccccctgcccccgggaaaaacccagcccccggcc

SEQ ID NO: 11791 - DNA, 698 bp, Zea mays
  misc_feature: Ceres CLONE 1364616-F
  misc_feature: Encodes the peptide sequence at SEQ ID NO. 11792
  misc_feature (346)..(346): n is a, c, t, g, unknown, or other
  misc_feature (460)..(460): n is a, c, t, g, unknown, or other
  misc_feature (530)..(530): n is a, c, t, g, unknown, or other
  misc_feature (531)..(531): n is a, c, t, g, unknown, or other
  misc_feature (553)..(553): n is a, c, t, g, unknown, or other
  misc_feature (561)..(561): n is a, c, t, g, unknown, or other
  misc_feature (571)..(571): n is a, c, t, g, unknown, or other
  misc_feature (610)..(610): n is a, c, t, g, unknown, or other
  misc_feature (628)..(628): n is a, c, t, g, unknown, or other
  misc_feature (685)..(685): n is a, c, t, g, unknown, or other
aaagctggagctccccgcggtggcggccgctctagaactagtggatcccccgggctgcaggaattcgcacgagaccattacctagaacatcctaatcgaaaagtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggattcggnttcgttaccttctcctccgagaactccatgctcgacgctatcgagaacatgaacggcaaggagttcgacggccgtaacatcaccgttaaccaggcccagtcccgtgccggtggnggtggcgggggtggatacgggggcggtcgcggggggggcggctatggtgggcgggcgccgcggcggcgannaagggggggggggggggcttcncccccccngcccctaggngggtgggcgccgggttaccaaaggttgtggtgggttacncccccccgcctctatggntagtcggatgaaagcaacggtgggacatgggcacccaattggcagggaatatagggnagggccccaccct

SEQ ID NO: 11792 - protein, 146 aa, Zea mays
  misc_feature: Ceres CLONE 1364616-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (114)..(114): Xaa is any aa, unknown, or other
  misc_feature (124)..(124): Xaa is any aa, unknown, or other
MAAADVEYRCFVGGLAWATSNESLENAFASYGEILDSKVITDRETGRSRGFGFVTFSSENSMLDAIENMNGKEFDGRNITVNQAQSRAGGGGGGGYGGGRGGGGYGGRAPRRRXRGGGGASPPXPLGGWAPGYQRLWWVTPPRLYG

SEQ ID NO: 11793 - DNA, 696 bp, Zea mays
  misc_feature: Ceres CLONE 1364617-F
  misc_feature: Encodes the peptide sequence at SEQ ID NO. 11794
  misc_feature (384)..(384): n is a, c, t, g, unknown, or other
  misc_feature (388)..(388): n is a, c, t, g, unknown, or other
  misc_feature (389)..(389): n is a, c, t, g, unknown, or other
  misc_feature (398)..(398): n is a, c, t, g, unknown, or other
tggagctccccgcggtggcggccgctctagaactagtggatcccccgggctgcaggaattcgcacgagaccattacctagaacatcctaatcgaaaacttctagaatcgtgtgcgagctggacagcaggaagagccgtagagttcgacgcgaggagcgagcgagtgattagctcgtgcgtgctgtgcaaggaaagtaaccaagcagatcgatcggtcgaggcgggtaggacaggatccagaggtagctagccatggcggaggaagcgtctgcgcctgcggcggggacggaagcgccgccggggagatgacgatggtggtaggggtcgacgagagcgagcacagcttctacgcgctgcagtgggcactgcagcacttcttcccgncggnncagcgaagnagtacggctccgtcgcgtaaccggcaagcccacgccgcctctcgcggtgggcctccccggccagggcccccgaattgctgccctaccgggaaggggatctaaagcgttccccctgtgggggtttaaaaaacccaaaggcccttgcccaaaggaaacgaatttttgttttagggcctggggggggaccctagaaaacccctcttgggagtgtttaaagagaacgggcccaaattttcctcctcccccccctgggtttccggccctttaaaagggttctttcttaagggggggccccctc

SEQ ID NO: 11794 - protein, 64 aa, Zea mays
  misc_feature: Ceres CLONE 1364617-F
  misc_feature (27)..(27): Xaa is any aa, unknown, or other
  misc_feature (28)..(28): Xaa is any aa, unknown, or other
  misc_feature (31)..(31): Xaa is any aa, unknown, or other
MTMVVGVDESEHSFYALQWALQHFFPXXQRXSTAPSRNRQAHAASRGGPPRPGPPNCCPTGKGI

SEQ ID NO: 11795 - DNA, 600 bp, Zea mays
  misc_feature: Ceres CLONE 1364618-F
  misc_feature (347)..(347): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
aagctggagctccccgcggtggcggccgctctagaactagtggatcccccgggctgcaggaattcgcacgagaccattacctagaacatcctaatcgaaaagtgtggctggaaaccctagccgccatatctcacgatccactcgagcaccaagccgagggaaggggaggagcgatggcgcgcggcgtggtgtcggccaagggcggcgcgttcgcggacaacaaagaaggcgtcggatttcctttcacgaatcgactggcccccaaggcccggggggggggggaaaaaaaaattggggggggggcccccccccccccgggaaaaaaacccccccgggggggggggccnccctcccctgccccccgggggaaaagggtttaaaccccggggggctccccccccctcctccggggaaaaaaaaggagggccccccccccctggggggccccctcctccttagggcgcccaaaagggttgtccccaaaaaattttttaaaaaaaaacccgcggggggggggtttttctcggggggtttgccccaaaagaggaaaagnnnnttttttccccccccccccccccccggaggagggggggggggggg

SEQ ID NO: 11796 - DNA, 695 bp, Zea mays
  misc_feature: Ceres CLONE 1364622-F
  misc_feature (370)..(370): n is a, c, t, g, unknown, or other
agagctggagctccccgcggtggcggccgctctagaactagtggatcccccgggctgcaggaattcgcacgagaccattacctagaacatcctaatcgaaaactctttagctgagtattacatccatggtcaaccaaatgggcacaatgagacatgagagatagtttctgtcaatgcatgatgcaaatagaacgactgtactcatcaaagttgcttaataatcctgcaacatcagcattcacagtgcaatcacaagggtaaacggatgccagtgacagagtcatattgatgtcacttacaccaacatacactctactgccagacttccttctcctctttgcggggcaaccgcacattgtgctaccccaanagcgcaaccaggacggtgaccctgaccatcagaagctatacatgtctcacttgtcggcttcggtgggaggcaataaataatatgacgatccttctgacaaccggtacgacaactggaaagatgactgatacgacgaggaagctgccgtatgatgccatcaaagcctctggccaaccctacgtccaaagatctcgcccccagtctatcagacgaaagattggtttgaaatatttagttagcccacctgacgcccacttaaaaggagcattgccggaaataagttcccgctgcatggcagaatattttttacctttcatcttttgtt

SEQ ID NO: 11797 - DNA, 706 bp, Zea mays
  misc_feature: Ceres CLONE 1365869-F
  misc_feature: Encodes the peptide sequence at SEQ ID NO. 11798
  misc_feature (706)..(706): n is a, c, t, g, unknown, or other
tggagctccccgcggtggcggccgctctagaactagtggatcccccgggctgcaggaattcgcacgagaccattacctagaacatcctaatcgaaaaagtcccaggagcgtggcctcactctcctcgtcgcatcccccctcctcatcttcgcagcgcgggcggcggcaatggcgatggcctccacctacgcgccgggcggaggcgcgcgggcgctcgcgcagggtagatgcagggtccgcggtcccgcggggctgggcttcctcggcccctccaaggccgccggcctcccccgccccctcgccctcgccaggcggatgagcagccccgtcgcggtgggcgccaggctgcgatgcgcggcgtcgtcgtcccccgcggcggtgcggcccgccacggcggcgcgcttcatccaggacaagaaggaggccttctggttctaccgcttcctctccatcgtgaacgaccacgtcatcaatccgggccactggaccgaggacatgcgcgacgacgcgctggaacctgtcgacctcttcagccgccacctcacgatcgtccgacgacgatgagggcacgggggtttatcatcgctcggcctcgtccagtaccgccaacccggagaaacggccacgctgctccaaacagtccccccgccccatatttgaacaaggccccggcaaaaaaggaagccccttccaggtgggttcaccn

SEQ ID NO: 11798 - protein, 131 aa, Zea mays
  misc_feature: Ceres CLONE 1365869-F
MAMASTYAPGGGARALAQGRCRVRGPAGLGFLGPSKAAGLPRPLALARRMSSPVAVGARLRCAASSSPAAVRPATAARFIQDKKEAFWFYRFLSIVNDHVINPGHWTEDMRDDALEPVDLFSRHLTIVRRR

SEQ ID NO: 11799 - DNA, 733 bp, Zea mays
  misc_feature: Ceres CLONE 1365894-F
  misc_feature: Encodes the peptide sequence at SEQ ID NO. 11800
  misc_feature (359)..(359): n is a, c, t, g, unknown, or other
  misc_feature (360)..(360): n is a, c, t, g, unknown, or other
  misc_feature (381)..(381): n is a, c, t, g, unknown, or other
  misc_feature (412)..(412): n is a, c, t, g, unknown, or other
  misc_feature (417)..(417): n is a, c, t, g, unknown, or other
  misc_feature (420)..(420): n is a, c, t, g, unknown, or other
  misc_feature (433)..(433): n is a, c, t, g, unknown, or other
  misc_feature (436)..(436): n is a, c, t, g, unknown, or other
  misc_feature (460)..(460): n is a, c, t, g, unknown, or other
aaagctggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtaccctgagcagccgcagtgcagcccgctggnncgcgcgccctactacgccggntgtgggcagccgagcgccatggtccagccgntcccnggnacagtgctgccancancaaatgaggatgatggacctgcantccgtccggcaacaattgcaatgatgatgcactttgaacggggccttgcccccccaaaaaaccttgacaaaccaattttgagggaaaaaaaaaaaagtttgttggacccccgggtttcaacccctgggccgtgtgtggcccaaaaattgcgccccaggggggggtttaaaaaaaaaatgttcgccaatacccaccaccccccgggggggcccccggtttttcccccctatattgggtttgtgtgtttgggaaacccccccttcctcttttctt

SEQ ID NO: 11800 - protein, 189 aa, Zea mays
  misc_feature: Ceres CLONE 1365894-F
  misc_feature (65)..(65): Xaa is any aa, unknown, or other
  misc_feature (83)..(83): Xaa is any aa, unknown, or other
  misc_feature (90)..(90): Xaa is any aa, unknown, or other
  misc_feature (91)..(91): Xaa is any aa, unknown, or other
  misc_feature (99)..(99): Xaa is any aa, unknown, or other
MKMVIVLVVCLALSAASASAMQMPCPCAGLQGLYGAGAGLTTMMGAGGLYPYAEYPEQPQCSPLXRAPYYAGCGQPSAMVQPXPGTVLPXXNEDDGPAXRPATIAMMMHFERGLAPPKNLDKPILREKKKSLLDPRVSTPGPCVAQKLRPRGGFKKKMFANTHHPPGGPPVFPPYIGFVCLGNPPFLFS

SEQ ID NO: 11801 - DNA, 673 bp, Zea mays
  misc_feature: Ceres CLONE 1365902-F
  misc_feature: Encodes the peptide sequence at SEQ ID NO. 11802
ctggagctccccgcggtggcggccgctctagaactagtggatcccccgggctgcaggaattcgcacgagaccattacctagaacatcctaatcgaaaaacggaccacggctatgttccactccaggtggaggctgcagccccggtttcgcaagccgcgccgtggtttgcttgcccacaggcggccaaaccgcaccctccttcccgctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcacaccgaccgcg

SEQ ID NO: 11802 - protein, 122 aa, Zea mays
  misc_feature: Ceres CLONE 1365902-F
  misc_feature (34)..(118): Pfam Name: ADH_N Pfam Description: Alcohol dehydrogenase GroES-like domain
  misc_feature: SWISSPROT Homolog: EC 1.1.1.1 Alcohol dehydrogenase
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRITPTA

SEQ ID NO: 11803 - DNA, 678 bp, Zea mays
  misc_feature: Ceres CLONE 1365908-F
  misc_feature: Encodes the peptide sequence at SEQ ID NO. 11804
  misc_feature (544)..(544): n is a, c, t, g, unknown, or other
  misc_feature (569)..(569): n is a, c, t, g, unknown, or other
  misc_feature (603)..(603): n is a, c, t, g, unknown, or other
aaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttctttccatcaaccnactgtctacactgaaccctgctgcntatttgcaggcaacactattaccatttaggccgntaggtactggctactcttaagaacaaacacttctttcatttaaaccaattgggcgcactgaaccccggtggtaat

SEQ ID NO: 11804 - protein, 150 aa, Zea mays
  misc_feature: Ceres CLONE 1365908-F
  misc_feature (125)..(125): Xaa is any aa, unknown, or other
  misc_feature (145)..(145): Xaa is any aa, unknown, or other
MATKIFSLLMLLALSTCVANATIFPQCSQAPIASLLPPYLPSIIASICENPALQPYRLQQAIAASNIPLSPLLFQQSPALSLVQSLVQTIRAQQLQQLVLPLINQVALANLSPYSQQQQFLSINXLSTLNPAAYLQATLLPFRPXGTGYS

SEQ ID NO: 11805 - DNA, 829 bp, Zea mays
  misc_feature: Ceres CLONE 1365916-F
  misc_feature (401)..(401): n is a, c, t, g, unknown, or other
  misc_feature (470)..(470): n is a, c, t, g, unknown, or other
  misc_feature (478)..(478): n is a, c, t, g, unknown, or other
  misc_feature (479)..(479): n is a, c, t, g, unknown, or other
  misc_feature (524)..(524): n is a, c, t, g, unknown, or other
  misc_feature (545)..(545): n is a, c, t, g, unknown, or other
  misc_feature (589)..(589): n is a, c, t, g, unknown, or other
  misc_feature (612)..(612): n is a, c, t, g, unknown, or other
gggggagcgcgggggggagaggggggaatattttacaacggcgagcgcacaaaaatggaggtcaccgcggtgggggcggctctagaatagtggatcccccgggctgcaggaattcgcacgagaccattacctacaagtcctaatcgaaaaaaaacacacggggaatcgattagcagaacccgcgccaccccccttcctcggagtcggagcgagtcgaggaacgggtcgtctgcctctccggttctccttcctctcctccccagaagatccgatccatcatcgaggactcgccgggaggaatcagggatatatagataatataccaacaaaggttcctccagagcccagagcaggagggaagtcaccgggcgtccggcggggaggagatgtcgaacgggccnggtctcccggacgggcgtccctggcggcgctggggctgtcggtcggcggcgggggggggcccctcgtcntgtggcannaaggaccctctgcagagctctgaggccttccttctttcccgaagnaccccctgacgagggctgggnacccttcgaggggggaaccgtgctttcaggcctgaaaccgttgngggaaggggcggggggctctctnccgaagcccagagggcgaattaaagggccgcggaccggggaatcctccatgcgggctggggtaaaggggaataacccattggggcggccgtcagaccccaaggctcggggtcccaccccggggggggctttctgccccgaggggcgcaaacgtgcgcctgaggagagcgataggcaaaagggcgggcggcaacccccctttttggggggcccgcggg

SEQ ID NO: 11806 - DNA, 673 bp, Zea mays
  misc_feature: Ceres CLONE 1365938-F
  misc_feature: Translation starting site: 227
  misc_feature: Pfam Name: DUF1909 Pfam Description: Domain of unknown function (DUF1909)
  misc_feature (290)..(290): n is a, c, t, g, unknown, or other
  misc_feature (291)..(291): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (442)..(442): n is a, c, t, g, unknown, or other
  misc_feature (443)..(443): n is a, c, t, g, unknown, or other
  misc_feature (446)..(446): n is a, c, t, g, unknown, or other
tggagctccccgcggtggcggccgctctagaactagtggatcccccgggctgcaggaattcgcacgagaccattacctagaacatcctaatcaaaaaaccggagagatctggtctgccattccctcgctccttcccgtgaaccacaaacctaacgcggagcggcgcgggccggccgccgggcgaggtgcgcgtagctgccgtcgattgtcgccggatccatccaccatgggcggtggcaacggccagaagtccaagatggcccgcgagcgcaacttggagaagaacaggnnggccaaggggagccagctcgagaccaacaagaaggccatgagcatccagtgcaaagtgtgcatgcaaacattcatgtgtaccacgagtgaggtgaagtgccggagccacgccgagggcaagatttcccaagaaaannnnnnnntnnnnnannaanattgattgcatatttacttcccctttaaccacaaataatgaaaactgcgcgtgcgcgcccttggggcccctgaggtcaccggaggggggggagcgccccacgccccgcgggggggagacggggggcggcaggggaggcgccgaccctgtgtcgggctgagaccgcgcccccgtatacttgaacgtggaacacctgatagagagagcttgcgggggctgttgcgggag

SEQ ID NO: 11807 - DNA, 671 bp, Zea mays
  misc_feature: Ceres CLONE 1365940-F
  misc_feature: Encodes the peptide sequence at SEQ ID NO. 11808
  misc_feature (363)..(363): n is a, c, t, g, unknown, or other
  misc_feature (374)..(374): n is a, c, t, g, unknown, or other
  misc_feature (381)..(381): n is a, c, t, g, unknown, or other
  misc_feature (399)..(399): n is a, c, t, g, unknown, or other
  misc_feature (400)..(400): n is a, c, t, g, unknown, or other
  misc_feature (405)..(405): n is a, c, t, g, unknown, or other
  misc_feature (465)..(465): n is a, c, t, g, unknown, or other
  misc_feature (472)..(472): n is a, c, t, g, unknown, or other
tccccgcggtggcggccgctctagaactagtggatcccccgggctgcaggaattcgcacgagaccattacctagaacatcctaatcgaaaaacactacaatactgctgcgcgctagcggtagcgctcgcgctcccactcgcaccacagcacgccaccgctgctgccggctcctccccgcgctcgcattgcgatttgcgacctagcgcgagggtaccgggggtggtgcgcgtgctccgtgatccgggaagcgccgcgagatggccgggggcggaggcggcggtgccgcgccgaagcacgacgacttcacgccgcaccccgtcaaggaccagctccctggggtctcctactgcatcaccagcccntcccccgtggnctgaagncgttctttcttgggtccnnacatnatctggtcatgcttggggaccactgggatcataccacctggcacttgtccacaaatgggnaggaaancatggagaacaaagcagtgggtattcaaacatttgctgttcggtgcaagaatcaaacacctccctggcaaagttcctttggaaccaggttccctggaaggaaccggggggccaaaaccctttggccggccaaaattttcaaaaacccttgggggggggtttggttatgaccccaaccccccaattaaattttccccccc

SEQ ID NO: 11808 - protein, 38 aa, Zea mays
  misc_feature: Ceres CLONE 1365940-F
MAGGGGGGAAPKHDDFTPHPVKDQLPGVSYCITSPSPV

SEQ ID NO: 11809 - DNA, 698 bp, Zea mays
  misc_feature: Ceres CLONE 1365941-F
  misc_feature: Encodes the peptide sequence at SEQ ID NO. 11810
  misc_feature (430)..(430): n is a, c, t, g, unknown, or other
  misc_feature (436)..(436): n is a, c, t, g, unknown, or other
  misc_feature (510)..(510): n is a, c, t, g, unknown, or other
  misc_feature (631)..(631): n is a, c, t, g, unknown, or other
tggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggncgtggncacgcccggtgtcctgatcttcagccccgtgctcgtccccgccgcgctgctcatcgggacggccgtcatggggntcctcacgtcgggcgcgctggggctcggggggctgtcctcgctcacgtgcctcgccaccacggggcggagggggttcagcgcacccgggactacggggagggagcgccaccgcagatgccnaaggccgcgggccaccgggcccaaaaaccggccaggaagccaggccatccagggcaggccccaggag

SEQ ID NO: 11810 - protein, 166 aa, Zea mays
  misc_feature: Ceres CLONE 1365941-F
  misc_feature (44)..(160): Pfam Name: Oleosin Pfam Description: Oleosin
  misc_feature (77)..(77): Xaa is any aa, unknown, or other
  misc_feature (79)..(79): Xaa is any aa, unknown, or other
  misc_feature (104)..(104): Xaa is any aa, unknown, or other
  misc_feature (144)..(144): Xaa is any aa, unknown, or other
MADRDRSGIYGGAHATYGQQQQQGGGGRPMGEQVKGMLHDKGPTASQALTVVTLFPLGGLLLVLSGLALTASVVGLXVXTPGVLIFSPVLVPAALLIGTAVMGXLTSGALGLGGLSSLTCLATTGRRGFSAPGTTGRERHRRCXRPRATGPKNRPGSQAIQGRPQE

SEQ ID NO: 11811 - DNA, 681 bp, Zea mays
  misc_feature: Ceres CLONE 1365944-F
  misc_feature: Encodes the peptide sequence at SEQ ID NO. 11812
  misc_feature (375)..(375): n is a, c, t, g, unknown, or other
  misc_feature (505)..(505): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (577)..(577): n is a, c, t, g, unknown, or other
  misc_feature (578)..(578): n is a, c, t, g, unknown, or other
  misc_feature (597)..(597): n is a, c, t, g, unknown, or other
  misc_feature (598)..(598): n is a, c, t, g, unknown, or other
  misc_feature (611)..(611): n is a, c, t, g, unknown, or other
  misc_feature (612)..(612): n is a, c, t, g, unknown, or other
tggagctccccgcggtggcggccgctctagaactagtggatcccccgggctgcaggaattcgcacgagaccattacctagaacatcctaatcgaaaaactccagaaaacctcacaaaaaccctcgctccccacaacccgccgccgcccacgccgccgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgttggtacaaacttatatgaattgaaactagatctgaatgacaaagtaaacgttgaggctagcaaaatnagtgtggggtgtcaggtccatattctgtattgtagaaaaagctgaggccaaatggtggaagaaacttgttcgagatgatcaaagggcacctcactttgtgaaagttgattgggacaaatgggttgacaanaatgatgatgggtgctgatgccaacttgggatggggatggacttctcaaattttgcgggtatggnnnngggnnattggggggggcatggggnnaataatgctgggnnttggggggggggtcttggtggcattgggtgggaatgggggggtatgggggggtatttggaaaaaaaaat

SEQ ID NO: 11812 - protein, 80 aa, Zea mays
  misc_feature: Ceres CLONE 1365944-F
  misc_feature (5)..(79): Pfam Name: CS Pfam Description: CS domain
  misc_feature (66)..(66): Xaa is any aa, unknown, or other
MSRHPEVKWAQRIDKVYITVQLPDAKDAKVNLEPDGVFTFSGSVGTNLYELKLDLNDKVNVEASKXSVGCQVHILYCRKS

SEQ ID NO: 11813 - DNA, 686 bp, Zea mays
  misc_feature: Ceres CLONE 1365946-F
  misc_feature: Encodes the peptide sequence at SEQ ID NO. 11814
tggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctggggacggtactgatcctcctcgcagggcgcttcatggggaagagagtggtgtttctcaagcagctcaagtctgggctggctcctatctctgggcctttcaagatcatggagtaccgatccgccggggtgaccagacctatgccatggctacatcaaccaaggttggactctctgggggtgagggccccagtttgatgacaatacttttcccgggaaaaaaaccaaaagggaaaaaacccggggccacttttttgaaaaaaaaaggggggttccaagtcctggctggattaaga

SEQ ID NO: 11814 - protein, 175 aa, Zea mays
  misc_feature: Ceres CLONE 1365946-F
  misc_feature (1)..(49): Pfam Name: Ribosomal_L6e_N Pfam Description: Ribosomal protein L6, N-terminal domain
MAPTSKLSTGIKRASRSHTYHRRGLWAIKAKNGGAFPKADKAAAAVEPKFYPADDVKPRVPSTRKPKPTKLRSSITPGDGTDPPRRALHGEESGVSQAAQVWAGSYLWAFQDHGVPIRRGDQTYAMATSTKVGLSGGEGPSLMTILFPGKKPKGKKPGATFLKKKGGFQVLAGLR

SEQ ID NO: 11815 - DNA, 655 bp, Zea mays
  misc_feature: Ceres CLONE 1365949-F
  misc_feature: Encodes the peptide sequence at SEQ ID NO. 11816
  misc_feature (247)..(247): n is a, c, t, g, unknown, or other
  misc_feature (329)..(329): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (409)..(409): n is a, c, t, g, unknown, or other
  misc_feature (512)..(512): n is a, c, t, g, unknown, or other
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcgaaaaactcacagctcaaaagcagccaaaacgctagctagctgcagcgatgatgtctcgctcctgctacctcgccgtgtcggtccttctcgcggtcgccgcgacagccagcggcgccatcgcgccggcgttgctgcacgagtggcgcctncgaggaggagggcctgctggtcgcggagggcgcgagggtggcgtccacctgggcgggcaaaaaggtctcgcgggcgagccgnaatggaggcgtggccgaagcggcggcgtggccacgcagggcgacgaccaaagctcgtcgggcggcggnnnaaacacgccnagggaggaggggagcagcaaggagggcgagaaagcagggcaggagctgcctcacccaaggaggagtgccacaagaagaaggtgctctgcggcaaggcctgcancgctctcggcgcacagcaagtgcgccgccaagtgcaccaaagtcctgtgtccctacctgctaggacccgccgacgaggaagctagtttctgtgatgaattgccaagatgatggnattaaggacgggtacttcttgatgcatgc

SEQ ID NO: 11816 - protein, 158 aa, Zea mays
  misc_feature: Ceres CLONE 1365949-F
  misc_feature (62)..(62): Xaa is any aa, unknown, or other
  misc_feature (85)..(85): Xaa is any aa, unknown, or other
  misc_feature (123)..(123): Xaa is any aa, unknown, or other
MMSRSCYLAVSVLLAVAATASGAIAPALLHEWRLRGGGPAGRGGREGGVHLGGQKGLAGEPXWRRGRSGGVATQGDDQSSSGGGXNTPREEGSSKEGEKAGQELPHPRRSATRRRCSAARPAXLSAHSKCAAKCTKVLCPYLLGPADEEASFCDELPR

SEQ ID NO: 11817 - DNA, 644 bp, Zea mays
  misc_feature: Ceres CLONE 1365959-F
  misc_feature (295)..(295): n is a, c, t, g, unknown, or other
  misc_feature (419)..(419): n is a, c, t, g, unknown, or other
  misc_feature (420)..(420): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
aaagctggagctccccgcggtggcggccgctctagaactagtggatcccccgggctgcaggaattcgcacgagaccattacctagaacatcctaatcgaaaagattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgctatcggntggcgcggtcggcggagccgtcggtaaccttcgtccctaaacccctaaacactaggcttgcagcatcaatccgtccgtgcgagccgcttcacccgtcggtggtttttttttttggtggaaggannataagtgtgcgattcaggaatcctctcgagctagctagtagctacatccctgggttgtgtggttagctagcggcagatgaataactaagtggcttttggtaagaggtactagtgcttaagtagcacatctggaggtgggagatatcgatgtcgaggtgggagattggttggcccccattggttgtggtctcaaaggctgtggcttggatttccgnnnccccctt

SEQ ID NO: 11818 - DNA, 690 bp, Zea mays
  misc_feature: Ceres CLONE 1365960-F
  misc_feature: Encodes the peptide sequence at SEQ ID NO. 11819
  misc_feature (569)..(569): n is a, c, t, g, unknown, or other
  misc_feature (625)..(625): n is a, c, t, g, unknown, or other
  misc_feature (654)..(654): n is a, c, t, g, unknown, or other
aaagctggagctccccgcggtggcggccgctctagaactagtggatcccccgggctgcaggaattcgcacgagaccattatctagaacatcctaatcgaaaaatctgatgccgtaacacaaggctgaatttttgttcggtctagccgacccgacgatggcgtccagcgacgggaaaccactgccaaccccggcctctgtggggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcggtctcatcggcgtggagtacatcgtggtcgaggaagatcttcgactcgctgccggcggaggagcagcggctgtggcactcgcacgcgcacgagatcaagtcaggcctgtggacgagccgncacgtggcggggctggctggagaaaggcggagctggaccacatggccgccacgttncggcaagttctgtggccaccctggcaggntggaccgcggcgacgggcctggccgctgggcgcccc

SEQ ID NO: 11819 - protein, 140 aa, Zea mays
  misc_feature: Ceres CLONE 1365960-F
  misc_feature (1)..(140): Pfam Name: DUF1264 Pfam Description: Protein of unknown function (DUF1264)
  misc_feature (100)..(100): Xaa is any aa, unknown, or other
  misc_feature (119)..(119): Xaa is any aa, unknown, or other
MGAAAMQSLRPVKQAKQHMCTFALYAHDPKRQVETHHYVSRLNQDFLQCAVYDSDKADARSHRRGVHRGRGRSSTRCRRRSSGCGTRTRTRSSQACGRAXTWRGWLEKGGAGPHGRHVXASSVATLAGWTAATGLAAGRP

SEQ ID NO: 11820 - DNA, 687 bp, Zea mays
  misc_feature: Ceres CLONE 1365965-F
  misc_feature: Encodes the peptide sequence at SEQ ID NO. 11821
tccccgcggtggcggccgctctagaactagtggatcccccgggctgcaggaattcgcacgagaccattacctagaacatcctaatcgaaaaaattccaacgacggagcacgacgcacgcacagccgcacagatccgccacactgcaagttttgaaaactgaactgtaagatggcatcagcagagctttcccgcgaggaaaatgtgtacatggcgaacctcgccgagtaggcagagaggtacgaggaaatggttgagctcatggagaaggcaccgaaaactgttgactcggaggagctcactgcgcaggagcgcaacctcctgtctgttgcatacaagaacgtcattggagcccgccgtgcctcatggcgcatcatctcctccatctagcagaacgaggagggtctaggcaatgaggaccgtgtaacactcatcaaggactaccgtgtcaagattgaaactgagctcaccaagatctgagatggcatcctcaagcttctcgaatctcaccttgagccgtcttccaccgctcccgagtccaaggtcttctatctcaagatgaagggtgactactacagataccttgctgagttcaagactgaagctgacagaaaggacgctgctgagaacaccatggtggcatacaagactgcccaggacattgctatggctgagcttgctccaactca

SEQ ID NO: 11821 - protein, 46 aa, Zea mays
  misc_feature: Ceres CLONE 1365965-F
MVELMEKAPKTVDSEELTAQERNLLSVAYKNVIGARRASWRIISSI

SEQ ID NO: 11822 - DNA, 697 bp, Zea mays
  misc_feature: Ceres CLONE 1365970-F
  misc_feature: Encodes the peptide sequence at SEQ ID NO. 11823
  misc_feature (530)..(530): n is a, c, t, g, unknown, or other
gctcttgaactagtggatcccccgggctgcaggaattcgcacgagaccattacctagaacatcctaatcgaaaaaactactccgtcactttgtttgcaaagctcctcctcgatccatcgatcactgcaccggtcggtggcaccgagctcgcaggggctagccaacgagaccgcagcaatggcggaccgtgaccgcagcgacatctacggaggcgctcacgtcacctacgggcagcagccccaacaggaaagacggaggcgcccgatgggtgagcaggtgaaggagatgctccccgacaaggggccgacgacgtcccaggcgctgacggaggccaggaatgttccccctggtgcggctgctgctggcgcctgtcgaagttggagcttaaaggccttacctccttcgtgttggcccgggcccccgccaaggaacctccacggcagccccgggctggggcccagggccgctgccccatcccaaaggaagacagtggcggttccaccgcccagtgccgctggcccttggggcgnctgtccctctatcaaggggcccaccctacccgaattgcccagccgcttccctggagaccccgggtttctctttatctgagggataccccaaaaaattccgtcttccccgccctccacacctcccacataagagcgaattctacttttaaacacatatcgcggagcgg

SEQ ID NO: 11823 - protein, 143 aa, Zea mays
  misc_feature: Ceres CLONE 1365970-F
  misc_feature (118)..(118): Xaa is any aa, unknown, or other
MADRDRSDIYGGAHVTYGQQPQQERRRRPMGEQVKEMLPDKGPTTSQALTEARNVPPGAAAAGACRSWSLKALPPSCWPGPPPRNLHGSPGLGPRAAAPSQRKTVAVPPPSAAGPWGXCPSIKGPTLPELPSRFPGDPGFLFI

SEQ ID NO: 11824 - DNA, 681 bp, Zea mays
  misc_feature: Ceres CLONE 1365975-F
  misc_feature: Encodes the peptide sequence at SEQ ID NO. 11825
tggagctccccgcggtggcggccgctctagaactagtggatcccccgggctgcaggaattcgcacgagaccattacctagaacatcctaatcgaaaaagattacgagatctgctacctatctataaagactactgcgccctactgtcttcaggctgactacgactcgacaccgctccgagaccagggccagacacggacggccccgaacgccggcgcgggagcatcaagttgtcgacctccgaccatctacccgccgcgatggacaagggaatagggcctcactcgccgctggtgggcggaattccgcgacgcctcgctcctcctcccccgtcgtccccgacccggccgggttcaccatatccgcgcccgaggcggacgacgccgctggagcgcgccagcgcaaggactccgaggctgcatggaaggcgcagaaagcttgggaagttgcgcaggctccgttcaagaacctgatgatgatgggatttatgatgtggatggcagggagcactgtccacctcttcagcatcggaattaccttctctgctctgtggcaacccctcaacgctctccgatctgttgggaaagtttttgaaccatttatcgaccccagggtggatactattgctcctaagttgctctttattgccctccatatggctgccatgcgattgcgtatatgg

SEQ ID NO: 11825 - protein, 70 aa, Zea mays
  misc_feature: Ceres CLONE 1365975-F
  misc_feature (1)..(70): Pfam Name: DUF1077 Pfam Description: Protein of unknown function (DUF1077)
MMMGFMMWMAGSTVHLFSIGITFSALWQPLNALRSVGKVFEPFIDPRVDTIAPKLLFIALHMAAMRLRIW

SEQ ID NO: 11826 - DNA, 633 bp, Zea mays
  misc_feature: Ceres CLONE 1365979-F
  misc_feature (203)..(203): n is a, c, t, g, unknown, or other
  misc_feature (208)..(208): n is a, c, t, g, unknown, or other
  misc_feature (215)..(215): n is a, c, t, g, unknown, or other
  misc_feature (225)..(225): n is a, c, t, g, unknown, or other
  misc_feature (229)..(229): n is a, c, t, g, unknown, or other
  misc_feature (453)..(453): n is a, c, t, g, unknown, or other
  misc_feature (456)..(456): n is a, c, t, g, unknown, or other
  misc_feature (457)..(457): n is a, c, t, g, unknown, or other
  misc_feature (485)..(485): n is a, c, t, g, unknown, or other
  misc_feature (585)..(585): n is a, c, t, g, unknown, or other
  misc_feature (589)..(589): n is a, c, t, g, unknown, or other
ggagctccccgcggtggcggccgctctagaactagtggatcccccgggctgcaggaattcgcacgagaccattacctagaacatcctaatcaaaaagagcctgtttagcagcgctatccgcttggcccaattcgtctactgctcctccagctcctccgctgcgccgccggtcgccgcccgacaccgccgaagaagagcagacngccgnagtttcnccaaaagggngggnaaaaaaaacccgggtttcgcgcccccgcggcggggggggggcccttcccggggggggaaaaacgggcgggggtgggttttggccacaatttccgggcggaagaggggaaaaaagggggttccgcggggaaaagaggtttttcccgcccttgtgggttttccgcggccccccccggggccgcgcggggagaaattctcgggggggaaaaaaccccggggtttttnggnncccaacccggggccccaatggggggggnaaaaaaaaaacccggggtttgggggcgcccccccccccccgggggggggggggtgttttttctccccgcccagaaaaaacccccccccttctcggggggngggncgacagaaaaaaaaacaatttttttttcccccccccccccccca

SEQ ID NO: 11827 - DNA, 612 bp, Zea mays
  misc_feature: Ceres CLONE 1365987-F
  misc_feature (238)..(238): n is a, c, t, g, unknown, or other
  misc_feature (308)..(308): n is a, c, t, g, unknown, or other
  misc_feature (313)..(313): n is a, c, t, g, unknown, or other
  misc_feature (327)..(327): n is a, c, t, g, unknown, or other
  misc_feature (353)..(353): n is a, c, t, g, unknown, or other
  misc_feature (360)..(360): n is a, c, t, g, unknown, or other
  misc_feature (367)..(367): n is a, c, t, g, unknown, or other
  misc_feature (371)..(371): n is a, c, t, g, unknown, or other
  misc_feature (423)..(423): n is a, c, t, g, unknown, or other
  misc_feature (425)..(425): n is a, c, t, g, unknown, or other
  misc_feature (448)..(448): n is a, c, t, g, unknown, or other
aaagctggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgncgtcacctctacggtcgcggcgcgctttggcctttttccgcgagccccgcgtcgtacgggttcgagcagncgggngcgcttccggcccntgcacacccgaaggctccggcccggncaattcnaagcggncgcntccgggcccgggcaaccccagcggcggcttccggccccggcaaaccaagcgncnccaccggggaagaaaaaaagcgnggggccccgggggggaaatccccgggggccccgggggggggtaaaagggaggggcgggggggtgggaacaaacggggaaacaggggggggccccaaaaacccggggccaaaggggggaacaaatttcacggggtttactcccccggggaaagcgcccggaattt

SEQ ID NO: 11828 - DNA, 647 bp, Zea mays
  misc_feature: Ceres CLONE 1365992-F
  misc_feature: Encodes the peptide sequence at SEQ ID NO. 11829
  misc_feature (262)..(262): n is a, c, t, g, unknown, or other
  misc_feature (311)..(311): n is a, c, t, g, unknown, or other
  misc_feature (365)..(365): n is a, c, t, g, unknown, or other
  misc_feature (379)..(379): n is a, c, t, g, unknown, or other
  misc_feature (389)..(389): n is a, c, t, g, unknown, or other
gctggagctccccgcggtggcggccgctctagaactagtggatcccccgggctgcaggaattcgcacgagaccattacctagaacatcctaatcgaaaactctcgctttctctagccatgacgctggtgaggatgccttgccgcctctgctgcttcctgctcgtcgtcgccgcctccgccgtctccgggcgggggcgggtggtcaccaccctcccgggctacgagggccgcctccccttccacctcgaaacagggtatgtgnaggtggacgaggacgcccgcgcggagctcttctactacttcgtccgggnccgagtccgcgccgacgacagcgacaacccgttcgtcctccggatccccgcggncaacgctgctccgncttcagcggnctcgcctacgagataagtcccatcatgtgtcggcgtggaggcctaccacggcagctttggcgcggctgggctacaaccccaactcgtgggacaaaggtggcgcatatttctttttgtggattcccaagtggggggccggggttttccctcttcccgagataggccaaagctacacgcctggggacgggatccaccacgctgcactttggggaaaatcctctacaagatggggttcaacgaaccattctggatgacatg

SEQ ID NO: 11829 - protein, 95 aa, Zea mays
  misc_feature: Ceres CLONE 1365992-F
  misc_feature: SWISSPROT Homolog: EC 2.3.1.91 Sinapoylglucose--choline O-sinapoyltransferase
  misc_feature (49)..(49): Xaa is any aa, unknown, or other
  misc_feature (65)..(65): Xaa is any aa, unknown, or other
  misc_feature (83)..(83): Xaa is any aa, unknown, or other
  misc_feature (88)..(88): Xaa is any aa, unknown, or other
  misc_feature (91)..(91): Xaa is any aa, unknown, or other
MTLVRMPCRLCCFLLVVAASAVSGRGRVVTTLPGYEGRLPFHLETGYVXVDEDARAELFYYFVRXRVRADDSDNPFVLRIPAXNAAPXSAXSPTR

SEQ ID NO: 11830 - DNA, 660 bp, Zea mays
  misc_feature: Ceres CLONE 1366014-F
  misc_feature: Translation starting site: 140
  misc_feature: Pfam Name: Rer1 Pfam Description: Rer1 family
  misc_feature (425)..(425): n is a, c, t, g, unknown, or other
  misc_feature (455)..(455): n is a, c, t, g, unknown, or other
  misc_feature (528)..(528): n is a, c, t, g, unknown, or other
  misc_feature (627)..(627): n is a, c, t, g, unknown, or other
  misc_feature (660)..(660): n is a, c, t, g, unknown, or other
aagctggagctccccgcggtggcggccgctctagaactagtggatcccccgggctgcaggaattcgcacgagaccattacctagaacatcctaatcgaaaaacgaaacctaagttacctaacccacccaagcggcaaccatggagccctcccccgtcggcgccagcggctcggcggagcggtggcgcgcggaggcggcgcgggcgttccagcactacctggaccgctcggcgccgcacacggcggggcggtgggcgggcacgctcgtggccgcggcggtgtacgcgctgcgggtctactacgtgcggggcttctacgtcgtcacctacgggctgggcatctacctgatcaacctcctcatcggcttcctctcccccatggtcgaaccggagctcgaggccgggcccgggctcccaaccagcggcntccgacgagttcaagcccttcatccgtcgnctccccgagtttcaaggtctgggtatgccgtcacaaaagccttttgcattgcctttgtcatgaccttcttctngggtatccgacgttccctgtcttttggcaatacttctctggttaatgggatggggctttttgtcctgacaatgaagcgacaatttgtgcatatgatcanggtaccagtatgtcccattcagcatagggaagn

SEQ ID NO: 11831 - DNA, 638 bp, Zea mays
  misc_feature: Ceres CLONE 1366021-F
  misc_feature: Encodes the peptide sequence at SEQ ID NO. 11832
tggagctccccgcggtggcggccgctctagaactagtggatcccccgggctgcaggaattcgcacgagaccattacctagaacatcctaatcgaaaaagtgcagacgcagcgcatgcaggtagcaatggcgggggagacgaagaagggcctggtgctactggacttctgggtgagcccgttcgggcagcgctgccgcatcgcgctggcggagaagggcatcgcctacgagtactcggagcaggagctgctgggcggcgccaagagcgacatcctcctccgctccaacccggtgcacaagaagatccccgtgctcctccacgacggccgccccgtctgcgagtccctcgtcatcctcaactacctcgaggaggccttcccggaggcctcccccaggctgctccccgacgccgcctacgcgcgcgcgcaggcccgcttctggggcggctactcccgacaggtctacgaggccggcacgcggctgtggaagctcaggggcgacgcgcgggcgcaggcgcgcgccgagatcgtgcaggtggtccggacctcgacggcgagctaggggacaggccttcttgggcggcgaggcgttcggggtcggggacgtggcgctcgtgcccttcgtgcgtggctcccagct

SEQ ID NO: 11832 - protein, 144 aa, Zea mays
  misc_feature: Ceres CLONE 1366021-F
  misc_feature (7)..(82): Pfam Name: GST_N Pfam Description: Glutathione S-transferase, N-terminal domain
  misc_feature: SWISSPROT Homolog: EC 4.4.1.5 Lactoylglutathione lyase
MAGETKKGLVLLDFWVSPFGQRCRIALAEKGIAYEYSEQELLGGAKSDILLRSNPVHKKIPVLLHDGRPVCESLVILNYLEEAFPEASPRLLPDAAYARAQARFWGGYSRQVYEAGTRLWKLRGDARAQARAEIVQVVRTSTAS

SEQ ID NO: 11833 - DNA, 655 bp, Zea mays
  misc_feature: Ceres CLONE 1366026-F
  misc_feature: Encodes the peptide sequence at SEQ ID NO. 11834
  misc_feature (548)..(548): n is a, c, t, g, unknown, or other
  misc_feature (613)..(613): n is a, c, t, g, unknown, or other
  misc_feature (614)..(614): n is a, c, t, g, unknown, or other
tggagctccccgcggtggcggccgctctagaactagtggatcccccgggctgcaggaattcgcacgagaccattacctagaacatcctaatcaaaaaactatcctaccaggcaccactcgcatcgtgtgctcagtcagatccccgtcccgcatttcctaaggccaggttagttggcattgaagacgatgactgcttctgcagctgctggtgtgcagatggtggctgcacgcccttgcatttcggcctcgccaggaattcttaccgcacgggtttctaggactgattgcatgctcagtaccactgctacattccccaaaatcagctgctcctggcctctaaggtttaagcgcaatgatgttgttgtaagagcaatatcggaagagtgtggcccgcaggggcttcccattgatctcagaggtaaaagggcattcattgctggagttgctgatgataatggctatggatgggcaattgcgaaggcacttgctgcggctggtgctgaaattcttgtgggtacatgggtgccggcacttaacatatttgagancagtctgagggcgtgaaagtttgatgaaatcacgaagctgccagatggatctcttatggatattnngtaagtctatcaacttgatgctgtctacgatccccctgatg

SEQ ID NO: 11834 - protein, 125 aa, Zea mays
  misc_feature: Ceres CLONE 1366026-F
  misc_feature: SWISSPROT Homolog: EC 1.3.1.9 Enoyl-[acyl-carrier-protein] reductase (NADH)
  misc_feature: The sequence is a functional homolog of SEQ ID NO 2 in US patent 7141721
  misc_feature (121)..(121): Xaa is any aa, unknown, or other
MTASAAAGVQMVAARPCISASPGILTARVSRTDCMLSTTATFPKISCSWPLRFKRNDVVVRAISEECGPQGLPIDLRGKRAFIAGVADDNGYGWAIAKALAAAGAEILVGTWVPALNIFEXSLRA

SEQ ID NO: 11835 - DNA, 662 bp, Zea mays
  misc_feature: Ceres CLONE 1366032-F
  misc_feature: Translation starting site: 206
  misc_feature: Pfam Name: Skp1_POZ Pfam Description: Skp1 family, tetramerisation domain
  misc_feature: Pfam Name: Skp1 Pfam Description: Skp1 family, dimerisation domain
  misc_feature (335)..(335): n is a, c, t, g, unknown, or other
  misc_feature (376)..(376): n is a, c, t, g, unknown, or other
  misc_feature (487)..(487): n is a, c, t, g, unknown, or other
  misc_feature (489)..(489): n is a, c, t, g, unknown, or other
  misc_feature (490)..(490): n is a, c, t, g, unknown, or other
  misc_feature (527)..(527): n is a, c, t, g, unknown, or other
  misc_feature (542)..(542): n is a, c, t, g, unknown, or other
  misc_feature (604)..(604): n is a, c, t, g, unknown, or other
  misc_feature (634)..(634): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcgaaaaccaatatatccccactcttcgcctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacnacggtatccctcttcctaacgtcaactccaagatcctatcncaggtaatcgagtactgcaacaagcacgtacatgccgccgccgccgccgcgcccgcctcgaaggccgtttccggacggacgtgggtgccgcctccgccaacagcaccgcgncnntccggtgaggacctcaagaaactgggatgcggacttncgtcaaggtcgacanggccacgcttttcgacctcatcttggctgcaaatattgaaaacatcaagggtctgctcgacntgacctgtcagaactgttgctgaacatgantcaggggcagacacccagaagagattcn

SEQ ID NO: 11836 - DNA, 695 bp, Zea mays
  misc_feature: Ceres CLONE 1366071-F
  misc_feature: Encodes the peptide sequence at SEQ ID NO. 11837
  misc_feature (371)..(371): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (627)..(627): n is a, c, t, g, unknown, or other
gctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctnatcctgggccggcaccgtgatcgcgctcacggtggcccacccccgtgctggtgactcgcgnnnnntttttttggtggcggcccgcccggcttgggggttggggctccttgggggggccgggtttcgtcccccctccggcgggcctccggcgtcccctggcgcttgcccgtgtttcttcctggggtggccccggtcccctggacgggccaaggcccccggccgggcgcccgccccagcttggacccacgccagggcngagggtggggggtcccaaggccccgcggacattcagggatgcaagcacaggcaaccgcatcgaaccag

SEQ ID NO: 11837 - protein, 76 aa, Zea mays
  misc_feature: Ceres CLONE 1366071-F
MADHHRGATGGGGGYGDLQRGGGMHGEAQQQQKQGAMMTALKAATAATFGGSMLVLSGLILGRHRDRAHGGPPPCW

SEQ ID NO: 11838 - DNA, 507 bp, Zea mays
  misc_feature: Ceres CLONE 1366072-F
  misc_feature (230)..(230): n is a, c, t, g, unknown, or other
  misc_feature (265)..(265): n is a, c, t, g, unknown, or other
  misc_feature (268)..(268): n is a, c, t, g, unknown, or other
  misc_feature (275)..(275): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (295)..(295): n is a, c, t, g, unknown, or other
  misc_feature (298)..(298): n is a, c, t, g, unknown, or other
  misc_feature (306)..(306): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (326)..(326): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
aaagctggagctccccgcggtggcggccgctctagaactagtggatcccccgggctgcaggaattcgcacgagaccattacctagaacatcctaatcgaaaaacggaaagaccaccgcaaacgccaccacgcccacgcctcgccgcgcaccacatctgaaacctccagcccgacgccggcgccggcgccgctgctcgcctgctcgtcacatttcctgggtgcccgcaagnccccgcgacctggggtccccaggtcccatcatcancgnctggaancggggaaatgggannnnncnaanaccttggnttcgnnnnnnnnnncggggnccccccccccccaaagggaaattcctgaaaaagggcggttggcccccaaacgggggttttgggggaacaaaaccccccggggggggcaccggggagcnnnaaaaaaattttgggggggggggggnnnnnnnngnnnccccccccccgggggaaaattttcttctccggggggggggagaaa

SEQ ID NO: 11839 - DNA, 665 bp, Zea mays
  misc_feature: Ceres CLONE 1366099-F
  misc_feature: Encodes the peptide sequence at SEQ ID NO. 11840
  misc_feature (340)..(340): n is a, c, t, g, unknown, or other
  misc_feature (613)..(613): n is a, c, t, g, unknown, or other
  misc_feature (645)..(645): n is a, c, t, g, unknown, or other
  misc_feature (647)..(647): n is a, c, t, g, unknown, or other
caaagctggagctccccgcggtggcggccgctctagaactagtggatcccccgggctgcaggaattcgcacgagaccattacctagaacatcctaatcgaaaaacagatctctctccctttcccccctctctctctctccgaactctaccccgcagtctcggccgcggccatggcggaggacgcccccaacgccgtcgccgagggcagccagcccgcggcctccgagggatccgccgacgccgccctgcgggctggcgcgggcgcaaggggcccgcggaggcgctgctcccgtcgctcagtatctgggctgccgtcgcagcgcacgcgcggacgccgtgntggcgccgcctcgtggcagacgctcgcgggggccagcgtcctctcccagggctacggggccgtcccggagcccgaggccgagcgggcccccgggggcctccaagggccaaggccttccccgggcggcttcaaatcccgccgccgccccccccaaaaggcccgccctccttcgaggggggggtaaagggggtttccggccctcttcccgggggggggcgcccgcgcccccctctagtttcccaaaaaaccggtccccccctttgtttggggggnccccccccccccccagaggggaagggccaaangnaaaagatcccccggagat

SEQ ID NO: 11840 - protein, 117 aa, Zea mays
  misc_feature: Ceres CLONE 1366099-F
  misc_feature (57)..(57): Xaa is any aa, unknown, or other
MAEDAPNAVAEGSQPAASEGSADAALRAGAGARGPRRRCSRRSVSGLPSQRTRGRRXGAASWQTLAGASVLSQGYGAVPEPEAERAPGGLQGPRPSPGGFKSRRRPPQKARPPSRGG

SEQ ID NO: 11841 - DNA, 645 bp, Zea mays
  misc_feature: Ceres CLONE 1366147-F
  misc_feature: Encodes the peptide sequence at SEQ ID NO. 11842
  misc_feature (172)..(172): n is a, c, t, g, unknown, or other
  misc_feature (428)..(428): n is a, c, t, g, unknown, or other
  misc_feature (523)..(523): n is a, c, t, g, unknown, or other
  misc_feature (527)..(527): n is a, c, t, g, unknown, or other
  misc_feature (529)..(529): n is a, c, t, g, unknown, or other
  misc_feature (532)..(532): n is a, c, t, g, unknown, or other
  misc_feature (533)..(533): n is a, c, t, g, unknown, or other
  misc_feature (618)..(618): n is a, c, t, g, unknown, or other
tggagctccccgcggtggcggccgctctagaactagtggatcccccgggctgcaggaattcgcacgagaccattacctagaacatcctaatcgaaaaaaaaaaaaataaaaatcgcagccaaaacacgcttctcccttcccatcttttcctttcccctcctccctcctcggntcgtctctgttcccctttccctcctgcgcacccgtcttctcctccccgcgtcaaaccccagcacaaaaagctaccgcccgccgcctcctcgttcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccagaagacaatgccnggcactacgtcaaggcgtccctctctacatgaacgcgctcgagtacttcaaaacccacctcagtacgagaagacccccaggatcaggagccatcnacgncnagnntcacgagtacctccgccgcgccgaagagatcccgggcgtcctcgatgagggcggcgcaggcctgggggccacggtggcgacgcanctgtcgccaccgcccaagaccagggaa

SEQ ID NO: 11842 - protein, 63 aa, Zea mays
  misc_feature: Ceres CLONE 1366147-F
  misc_feature (23)..(23): Xaa is any aa, unknown, or other
  misc_feature (24)..(24): Xaa is any aa, unknown, or other
  misc_feature (25)..(25): Xaa is any aa, unknown, or other
  misc_feature (26)..(26): Xaa is any aa, unknown, or other
  misc_feature (54)..(54): Xaa is any aa, unknown, or other
MNALEYFKTHLSTRRPPGSGAIXXXXHEYLRRAEEIPGVLDEGGAGLGATVATXLSPPPKTRE

SEQ ID NO: 11843 - DNA, 648 bp, Zea mays
  misc_feature: Ceres CLONE 1366151-F
  misc_feature: Translation starting site: 273
  misc_feature (477)..(477): n is a, c, t, g, unknown, or other
  misc_feature (485)..(485): n is a, c, t, g, unknown, or other
  misc_feature (505)..(505): n is a, c, t, g, unknown, or other
tggagctccccgcggtggcggccgctctagaactagtggatcccccgggctgcaggaattcgcacgagaccattacctagaacatcctaatcgaaaagtcgtcttgccgccgatcctttttccgaaacctagctcgcccgcccgacctccgaccttctagaaccttgcctccgaggtgccgccctccccgccccgcctgcgccgcttgctcatcgcttctctccccgcggcggcctcccagatccggttggatcgaggggcaaggtcaagagatggggcaggccttccgaaagctgtttgatgccttcttcggcaacaaggagatgcgggtggtgatgcttgggttggatgcagctgggaaaccaccatactctataagcttcacattggtgaagttctctccactgtccctaccataggtttcaatgttgagaaggttcaatacaagaatgtagtgttcaccgtgtgggatgttgntggccagnagaagctcaggcccctgtgnaggcactacttcaacacactgatgctctgatttacgtgattgattcactggatagagagagaatcggagagccagggcggagttttcagctataaatcatgaccctttatgcttacagtgtgttaattggtgtttgctaacaa

SEQ ID NO: 11844 - DNA, 673 bp, Zea mays
  misc_feature: Ceres CLONE 1366153-F
  misc_feature: Encodes the peptide sequence at SEQ ID NO. 11845
  misc_feature (399)..(399): n is a, c, t, g, unknown, or other
  misc_feature (404)..(404): n is a, c, t, g, unknown, or other
  misc_feature (405)..(405): n is a, c, t, g, unknown, or other
  misc_feature (413)..(413): n is a, c, t, g, unknown, or other
  misc_feature (434)..(434): n is a, c, t, g, unknown, or other
  misc_feature (435)..(435): n is a, c, t, g, unknown, or other
  misc_feature (443)..(443): n is a, c, t, g, unknown, or other
  misc_feature (456)..(456): n is a, c, t, g, unknown, or other
  misc_feature (529)..(529): n is a, c, t, g, unknown, or other
aaagctggagctccccgcggtggcggccgctctagaactagtggatcccccgggctgcaggaattcgcacgagaccattacctagaacatcctaatcgaaaaacggcccaccccgatctcataatcgtcgtcttctcccacttcgacgcggctagggccggcgctaccatctcctcttctcttccggcggcttctccgtcccgtcgatcaaccgcgccgccttcgccagtataccccgcattgagccgtcatcgttacctgcgccgaccggcacctctgtagcctcttctccaggggttgcacgaggaggaggaggttcgggcttcgccatgtcgaagtcgaacctagatgatctgcttctgcaggcagccggccggacggggaaagaacactcccggncgagnncacccgcntggaactctgggggaagcggnntcgacggnttcgacgacgacngactcggacgccgcgccgacctaatcgaggaaagaagccttcgccgcaggttcccgctcagaaagcggaccanccaaaaaaaggcggcccggctggaaatggcgggtgggaaggccgggaccaccggggccaaaacgggggtcccaaggggcggggaaggactcgcaaggccccctttgggggggggggggcctatccaggggtggggcgccaagga

SEQ ID NO: 11845 - protein, 114 aa, Zea mays
  misc_feature: Ceres CLONE 1366153-F
  misc_feature (24)..(24): Xaa is any aa, unknown, or other
  misc_feature (25)..(25): Xaa is any aa, unknown, or other
  misc_feature (26)..(26): Xaa is any aa, unknown, or other
  misc_feature (36)..(36): Xaa is any aa, unknown, or other
  misc_feature (43)..(43): Xaa is any aa, unknown, or other
  misc_feature (67)..(67): Xaa is any aa, unknown, or other
MSKSNLDDLLLQAAGRTGKEHSRXXXPAWNSGGSGXDGFDDDXLGRRADLIEERSLRRRFPLRKRTXQKKAARLEMAGGKAGTTGAKTGVPRGGEGLARPPLGGGGPIQGWGAK

SEQ ID NO: 11846 - DNA, 643 bp, Zea mays
  misc_feature: Ceres CLONE 1366159-F
  misc_feature: Encodes the peptide sequence at SEQ ID NO. 11847
ggagctccccgcggtggcggccgctctagaactagtggatcccccgggctgcaggaattcgcacgagaccattacctagaacatcctaatcgaaaagagattcgccgtctcaccccttccctgactgctccctcgtctaacaaaagcgggcagagtacagacggtggcggtaggccatcgaggactcccgctcaccgtcgtgtgccaccgcctcccaggtcaggggacgacggcgacggttggctagggccgctacaggtagtccgaggcgaggttgtgcattggagggcgtagagaggccacgccgtccggagtctccagttccgccaccacagcttcctgccgcgcctgggccgaggtaaacgatagggatcgaggaagaagtatcccccggagccccttcccccgaacccgaagggtccggaatggcgcactgcgttagcgacagtgatggcagtgacaactttgaatgggatagtgatggtaatgggagagagccagagaacttcactgctgctggtgccggctcatcagatctgagatcaacgaacactgatgctccagtgtcatcaacgacgtctgcgaatgccaatgggcatgctgagccatctgcctcgtcgggtcaaagtatatggacatgggt

SEQ ID NO: 11847 - protein, 72 aa, Zea mays
  misc_feature: Ceres CLONE 1366159-F
MAHCVSDSDGSDNFEWDSDGNGREPENFTAAGAGSSDLRSTNTDAPVSSTTSANANGHAEPSASSGQSIWTW

SEQ ID NO: 11848 - DNA, 672 bp, Zea mays
  misc_feature: Ceres CLONE 1366160-F
  misc_feature: Encodes the peptide sequence at SEQ ID NO. 11849
  misc_feature (178)..(178): n is a, c, t, g, unknown, or other
  misc_feature (179)..(179): n is a, c, t, g, unknown, or other
  misc_feature (186)..(186): n is a, c, t, g, unknown, or other
  misc_feature (199)..(199): n is a, c, t, g, unknown, or other
  misc_feature (247)..(247): n is a, c, t, g, unknown, or other
  misc_feature (250)..(250): n is a, c, t, g, unknown, or other
gagctccccgcggtggcggccgctctagaatagtggatcccccgggctgcaggaattcgcacgagaccattacctagaacatcctaatcgaaaagggagtcggcactcgggtctcgacgtctcgtctcgtctcgtctcgcctgcccgcagccccttggcttcgtccatccggcttctnncgcgcgncggagaggagggnatggcgcaccggctgctgcgggacgcgcaggcggacgggtggaagcgntcngacttcccatcatctgcgagtcatgcctcggcgacaacccctacgtccggatggtagagctgaatatgacgaagaatggcaaaattggtgcacgtccttttactgtattccccctggcgtcctggggcgagatgaaggtacaaagaagactgagatctggcagacatgttgacagctaaaagaatgtctgccaggcctgcctggctggatcttgaaatatggcctggcctgttcaggtccaagataccgcacttctctatcaattccaatggatgaaattcccagggaggggaggtcactcgcggaataatttgcaaaaagagattgataggagggccccaaagctgggcaaaaaacaatgatccttcccaagggggaaggcttccccccaaagggaacccatttctggaagcttcaaaagg

SEQ ID NO: 11849 - protein, 42 aa, Zea mays
  misc_feature: Ceres CLONE 1366160-F
MVELNMTKNGKIGARPFTVFPLASWGEMKVQRRLRSGRHVDS

SEQ ID NO: 11850 - DNA, 655 bp, Zea mays
  misc_feature: Ceres CLONE 1366162-F
  misc_feature: Encodes the peptide sequence at SEQ ID NO. 11851
aaagctggagctccccgcggtggcggccgctctataactagtggatcccccgggctgcaggaattcgcacgagaccattacctagaacatcctaatcgaaaactcccagctcctcctccctgtctgctcccctccactgctgtggcgctctccctctcccgtctcccctcaccttctccacctcccccattccgccaccgcacaagccgacctccctcaccaagaggagaaaagaaaggcagagcgaaggaggcaaaccaggtgagacagcaacgcgacgtgcttgctattctctcgagagagatgtcaattttataataaaaccccagcatgcgtcagctggcgaattatgacttgagctcatgcaaggtgtaagtcttactgcaagaagggcagctgagcatgctaagacccatacatagcctctcttgattacacagcacggggggtgaaaacttgagatacagttgatctcctgattcagagtatgggttcaaggtttgcatcgcatcagctgagcaatggcctgtatgtttctggtcgacctgagcaacctaaggagacggccccaaccattttttccactgcgatgccatatactggtcgtgacatcaagaaaatcagagagctgcggcaagatgtctgatctccatgg

SEQ ID NO: 11851 - protein, 52 aa, Zea mays
  misc_feature: Ceres CLONE 1366162-F
MGSRFASHQLSNGLYVSGRPEQPKETAPTIFSTAMPYTGRDIKKIRELRQDV

SEQ ID NO: 11852 - DNA, 703 bp, Zea mays
  misc_feature: Ceres CLONE 1366166-F
  misc_feature: Encodes the peptide sequence at SEQ ID NO. 11853
  misc_feature (298)..(298): n is a, c, t, g, unknown, or other
  misc_feature (328)..(328): n is a, c, t, g, unknown, or other
  misc_feature (365)..(365): n is a, c, t, g, unknown, or other
  misc_feature (413)..(413): n is a, c, t, g, unknown, or other
  misc_feature (418)..(418): n is a, c, t, g, unknown, or other
tccccgcggtggcggccgctctagaactagtggatcccccgggctgcaggaattcgcacgagaccattacctagaacatcctaatcaaaaactattccctctcaagtctcgagacccaccaccgcaccccgcgctcggcggactcttttgctgctgcacctgccatcgtcacgcaccggtgtgtggagcgaagccagcgagcgagaagtagccacagagcggcctgtgcgtgcgtgcagatcgagagagagacgtgcagatcgagagagagagacgaacagagagagcgattcatggntagtgcgatgcgcgccggagccatggagtnggaggaccgcctggccacccttcctcgcttccgcggngatcacgatgccgacgggcagggaaaggaggacaggggacggtatggnacgcnaacggctcacatcatcacggcgggggatcggctcccggcgtgctgtcccttggcgtgggcaatgccccaactggggtgggtggcccgggccccttgacccctggggttctttcggggggaaaaaccttttaaaccctggggggcccccctccaaaacgggtacccgggggggcgaccccccgggggggggaaaaggaaataaacccccaaacccgagaggcggtaaaaaaaaaccgcggggggggggggaaacactggggtttcggggggtttttggcaaaaaaa

SEQ ID NO: 11853 - protein, 73 aa, Zea mays
  misc_feature: Ceres CLONE 1366166-F
  misc_feature (2)..(2): Xaa is any aa, unknown, or other
  misc_feature (12)..(12): Xaa is any aa, unknown, or other
  misc_feature (42)..(42): Xaa is any aa, unknown, or other
MXSAMRAGAMEXEDRLATLPRFRGDHDADGQGKEDRGRYGTXTAHIITAGDRLPACCPLAWAMPQLGWVARAP

SEQ ID NO: 11854 - DNA, 640 bp, Zea mays
  misc_feature: Ceres CLONE 1366168-F
  misc_feature: Encodes the peptide sequence at SEQ ID NO. 11855
tggagctccccgcggtggcggccgctctagaactagtggatcccccgggctgcaggaattcgcacgagaccattacctagaacatcctaatcaaaaaacagtcccacgccctccagtcaaagcaagccgctgcttggccggccgggaaggcgtcggtcgcagcgccgaggaatggcgtgcaagccggtcaccgtcggcgacctcatccaccgcgtcgcctcttcatgcctctccaaccgcctgccgtgcaaccactccttccgcgactccgtggacagcgactttgatgacgacgacgacgacgacgaccccttcgccgacgccgtctccagcaccgagaaatgccagcggtccccgcccgctgcggatggcgatgaacaggagcaggatgacgataagctcatgatctgcgcagagatgtagcattagaaggataggctgctcgccgcgtccaagggcgccgagcgcgcccgtgacgcggacgcgctgatggatgaggtgtcccacgccatcatcgggggcgcccctcctacgccgtgcttcaggatgcgcactgcccctgtgacccctaaagatgctgaccgcggactctgtcgtggtcgccgagttctgatactcgggggcttctgggacttgtact

SEQ ID NO: 11855 - protein, 83 aa, Zea mays
  misc_feature: Ceres CLONE 1366168-F
MACKPVTVGDLIHRVASSCLSNRLPCNHSFRDSVDSDFDDDDDDDDPFADAVSSTEKCQRSPPAADGDEQEQDDDKLMICAEM

SEQ ID NO: 11856 - DNA, 657 bp, Zea mays
  misc_feature: Ceres CLONE 1366171-F
  misc_feature (401)..(401): n is a, c, t, g, unknown, or other
  misc_feature (409)..(409): n is a, c, t, g, unknown, or other
  misc_feature (501)..(501): n is a, c, t, g, unknown, or other
ggagctccccgcggtggcggccgctctagaatagtggatcccccgggctgcaggaattcgcacgagaccattacctagaacatcctaatcaaaaaaccacgttgactccgtatctctcgcgcctttttcctttcctggttgcgacgagccgacgactgggaggacgccgttgccgccctacgtcaggtcttcatcgaccccttcgacgagcacacccaagattcagccgggaatgtggaatgcaaaccgtactttctgcgcatgaagatgtgatcagacgacttcatcagccttgacgcaccttgcgaggctgatgcgaaagatgatggcccagacgctcagatagacctcctgatgtaaatgagatgcagcgtctggtatcggatctctcagcagaagtncaagctgntgctgtgcgatataatcacatgacagctgctgatcatctgcatgttgaagagcctcaagcagcacatatgtacctcgcagatgatgacgccntggcttggacagatcagctattagatgctgccattcatcccgatagtactgttgcagctgggcagactgtgattagtcttaacgtctagctggacaagggggacgggcctcgaaatgaaatagttatgcctatacggcatctctagtgagaaaggc

SEQ ID NO: 11857 - DNA, 664 bp, Zea mays
  misc_feature: Ceres CLONE 1366172-F
  misc_feature: Encodes the peptide sequence at SEQ ID NO. 11858
  misc_feature (638)..(638): n is a, c, t, g, unknown, or other
aaagctggagctccccgcggtggcggccgctctagaactagtggatcccccgggctgcaggaattcgcacgagaccattacctagaacatcctaatcaaaaaatccgctccccgccttccgcttccctaccccccgcatcacctaccaacgccgacaccatgggggccttcgcgaatgaggagcaccagttcctcgccgagctcggcctcgcgcagcgcaacccgggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgacgccgctaagacatggatggcgattcctgctccaaagcgaggagagatcgttaggcaaatcggtgatgcactgagagcaaagctccatcaccttggcaggcttgtgtcacttgagatggggaaaattcttcctgaagggatcggtgaggttcaggaaatcattgacatgtgtgattatgctgtgggactaagtcgccaactaaatggatccattataccatctgaacgacaaacatagattggatgaggtgtgaatccccttggaagatttgtggntgttataacggcatttaatttccctg

SEQ ID NO: 11858 - protein, 146 aa, Zea mays
  misc_feature: Ceres CLONE 1366172-F
  misc_feature: SWISSPROT Homolog: EC 1.2.1.3 Aldehyde dehydrogenase (NAD(+))
MGAFANEEHQFLAELGLAQRNPGAFACGAWGGSGPTVTSTSPTNNQVIAEVVEASVHDYEEGMRACFDAAKTWMAIPAPKRGEIVRQIGDALRAKLHHLGRLVSLEMGKILPEGIGEVQEIIDMCDYAVGLSRQLNGSIIPSERQT

SEQ ID NO: 11859 - DNA, 666 bp, Zea mays
  misc_feature: Ceres CLONE 1366177-F
  misc_feature: Encodes the peptide sequence at SEQ ID NO. 11860
  misc_feature (509)..(509): n is a, c, t, g, unknown, or other
  misc_feature (552)..(552): n is a, c, t, g, unknown, or other
  misc_feature (574)..(574): n is a, c, t, g, unknown, or other
  misc_feature (635)..(635): n is a, c, t, g, unknown, or other
  misc_feature (653)..(653): n is a, c, t, g, unknown, or other
  misc_feature (666)..(666): n is a, c, t, g, unknown, or other
aaagctggagctccccgcggtggcggccgctctagaactagtggatcccccgggctgcaggaattcgcacgagaccattacctagaacatcctaatcgaaaaatctcctttctctctctacacatactcagacgagcagaagcagctagggacaccataggcaaactacttcagcaagaaattaaactatctcctacgcaagatcagaagaaactgtgtatggagcaagaagaggttggcctcgccctgggcctctccctcggctccggccaccaccaccaggagctcaagccccaacatccgtcgcatccgtgtgcggcgttgttggagccttctctgtcgctcagcggcccggcgaccaaggatgatggcccgaccgcaccgggtgaggaggttcgctgccgtgaagagggagctgcagacgatggaggggaacgacgacgagccaccggcagggatgcaccccccgggggggggcccccccggggggggtttactgccgacgacgnacgaagggtgcaacagcagccggaagaagctgaggctgtccanggagcagtcggcgcctgctggnaggaccacttcaaggagcacagcaccctcaaccctaagcagaaggctgctttggccagacnactgacctgagccagggnaagggggggaggn

SEQ ID NO: 11860 - protein, 141 aa, Zea mays
  misc_feature: Ceres CLONE 1366177-F
  misc_feature (97)..(97): Xaa is any aa, unknown, or other
  misc_feature (111)..(111): Xaa is any aa, unknown, or other
  misc_feature (119)..(119): Xaa is any aa, unknown, or other
  misc_feature (139)..(139): Xaa is any aa, unknown, or other
MEQEEVGLALGLSLGSGHHHQELKPQHPSHPCAALLEPSLSLSGPATKDDGPTAPGEEVRCREEGAADDGGERRRATGRDAPPGGGPPRGGFTADDXRRVQQQPEEAEAVXGAVGACWXDHFKEHSTLNPKQKAALARXLT

SEQ ID NO: 11861 - DNA, 691 bp, Zea mays
  misc_feature: Ceres CLONE 1366178-F
  misc_feature (336)..(336): n is a, c, t, g, unknown, or other
  misc_feature (350)..(350): n is a, c, t, g, unknown, or other
  misc_feature (351)..(351): n is a, c, t, g, unknown, or other
  misc_feature (364)..(364): n is a, c, t, g, unknown, or other
  misc_feature (365)..(365): n is a, c, t, g, unknown, or other
  misc_feature (375)..(375): n is a, c, t, g, unknown, or other
  misc_feature (376)..(376): n is a, c, t, g, unknown, or other
  misc_feature (388)..(388): n is a, c, t, g, unknown, or other
  misc_feature (390)..(390): n is a, c, t, g, unknown, or other
  misc_feature (392)..(392): n is a, c, t, g, unknown, or other
  misc_feature (395)..(395): n is a, c, t, g, unknown, or other
  misc_feature (399)..(399): n is a, c, t, g, unknown, or other
  misc_feature (407)..(407): n is a, c, t, g, unknown, or other
  misc_feature (408)..(408): n is a, c, t, g, unknown, or other
  misc_feature (453)..(453): n is a, c, t, g, unknown, or other
  misc_feature (477)..(477): n is a, c, t, g, unknown, or other
  misc_feature (478)..(478): n is a, c, t, g, unknown, or other
  misc_feature (481)..(481): n is a, c, t, g, unknown, or other
aaagctggagctccccgcggtggcggccgctctagaactagtggatcccccgggctgcaggaattcgcacgagaccattacctagaacatcctaatcgaaaagcgtttctttaccctaagcttttagctggtccaacgaaaggcacacagcccgacagccgccgctgtttcttcatcttcctcgcagcgccggcgctccttcttccgctccctctccgattcgcgctcggcacgcaggcgacggcggcggcgctcgtgctcgggctctcagcgacggcgggcagtcccagactcggtgtcggcgtcagcggtcccccctttccgctgtcacaatcngctcgcgccctcgnnctcgggtctccgnnacacgacggnngccctggggtgnangnctnccgntcccctcnntggctcccgggggaccgtcgacggggctcgggacccggaaggctnactggcccgccgcgggggaacggnnggncaacggggaaccagcaacccgcgccgttttggggaagcttaaatccccccaatggaatcctaacggcccgttaactctttagggggctgagaacggggcgttaaggggccaatttttggacccgggggtgggggggggggttttaaaaaaaaacgggaatatgggggaacccccatggggtgggaaattttttttccccgggaggggggg

SEQ ID NO: 11862 - DNA, 886 bp, Zea mays
  misc_feature: Ceres CLONE 1366181-F
  misc_feature (40)..(40): n is a, c, t, g, unknown, or other
  misc_feature (773)..(773): n is a, c, t, g, unknown, or other
  misc_feature (871)..(871): n is a, c, t, g, unknown, or other
tgttattccccccccccacctctcgccacccctccccccnttgccgcccgttcaaagctggagctccccgcggtggcggccgctctagaatagtggatcccccgggctgcaggaattcgcacgagaccattacctagaacatcctaatcgaaaagtgctttcttagaggtgggttggcttctcctccccctccggttcgggttcgggttcgtgaggttctccggggctcggcttcgtggggtgagcggatcgagatggcggcgtcggatgttgagtaccgctgcttcgtcggcggcctcgcctgggccacggacgaccactccctccacaaggccttcaggcacctacggtgaggccctcgagtccaagatcatcctccattggggagaggcacagggcccccgcggcttcggttgccggcccccttctcccccggaaggaaggcgatggcggaaccgccccttcgaagggcattaaacgggcaaagggaagcttgggaccggcccggcaaacatccccccgtccaacggaggtgccccgggtccccgcgtgtgggccccggagagagaagggccaatagcccgggtggcccatacccggggggtagggacctgatgctaaggtcgcccggacgatataacgctagcgaagggaccgggcccgccagtggctcggacgaggagtccgcctttaacccgcggcacagctgagcccccgcaatctacggagggtgcggcccggcggggtttacccggggggagcgaccgccacgngggccctacccggatgatgtgttaacccgagtggtgtgcccccctggaactggctaatcttatgtcccttgcaatccgggctgccacctggataaggnacggccacccctccc

SEQ ID NO: 11863 - DNA, 653 bp, Zea mays
  misc_feature: Ceres CLONE 1366183-F
  misc_feature: Encodes the peptide sequence at SEQ ID NO. 11864
  misc_feature (535)..(535): n is a, c, t, g, unknown, or other
aaagctggagctccccgcggtggcggccgctctagaactagtggatcccccgggctgcaggaattcgcacgagaccattacctagaacatcctaatcgaaaatcaacctctatgcctcccagaaaaattcctcccaccgcgacggcgacgagcacggggaccctcctccgtctcagcctccgcctctccgagagcggtctccgcaccgcagcgacgacgacccctccgacctccctgtcgaccaccgacgcgccgaagtccgccctccgccgccgccgccgcagggacgggatcggtctcctctggaagctctcttacggccgcgcgtcgtcacgccccatggaagcactgacgtctctgcaggaaccacgtcgtcgagggcccggccccggacatagccgaccagttcgacaacgaagttacgggcgaacttcctcgtgtccagcttcatgcaggcgccgctcaccacgatgctcgagtactccggtatcctccgacccgatgcaggatgcggaacccaagaggatgagtcctncccatggacctccgaggcggcaactcataatggtggaccgggcaaggttgatactccttcttacaggcccaggaagggttcactaaggaaaagaatcaatatggtcttgacctgagac

SEQ ID NO: 11864 - protein, 169 aa, Zea mays
  misc_feature: Ceres CLONE 1366183-F
  misc_feature (142)..(142): Xaa is any aa, unknown, or other
MPPRKIPPTATATSTGTLLRLSLRLSESGLRTAATTTPPTSLSTTDAPKSALRRRRRRDGIGLLWKLSYGRASSRPMEALTSLQEPRRRGPGPGHSRPVRQRSYGRTSSCPASCRRRSPRCSSTPVSSDPMQDAEPKRMSPXHGPPRRQLIMVDRARLILLLTGPGRVH

SEQ ID NO: 11865 - DNA, 598 bp, Zea mays
  misc_feature: Ceres CLONE 1366186-F
  misc_feature: Encodes the peptide sequence at SEQ ID NO. 11866
  misc_feature (292)..(292): n is a, c, t, g, unknown, or other
  misc_feature (295)..(295): n is a, c, t, g, unknown, or other
  misc_feature (296)..(296): n is a, c, t, g, unknown, or other
  misc_feature (306)..(306): n is a, c, t, g, unknown, or other
  misc_feature (361)..(361): n is a, c, t, g, unknown, or other
  misc_feature (363)..(363): n is a, c, t, g, unknown, or other
  misc_feature (365)..(365): n is a, c, t, g, unknown, or other
  misc_feature (389)..(389): n is a, c, t, g, unknown, or other
aaagctggagctccccgcggtggcggccgctctagaactagtggatcccccgggctgcaggaattcgcacgagaccattacctagaacatcctaatcgaaaatggctgtttctgggagtgggcagcaacatggcagtgtttattggaagaagggcagccatgctgtgttatcctccttggatgctagtaaaagcttgttatctcaactcaaggatgcattttctacaatgaactcaccattatggatggatagtagcacaacaaagcaatgcagagaaatagagaatgcagntgnnagtgcactgnagtttagcaaactgacaggatctcgtgcgtatgaaagatcactggcccccagatnangnagatctatcagacagcgcctgatngttatgaagataccgagagatatcttttggtgagctcgttcatggcatctatacccttgtggagctatagcagtattgatgaaactggatgtgcgggggatgaacttgattgatattcagcaaagggacttgtcccagtctggcttaaaagcaactgcgtctggacctgaaacaagctttgaaatctggcaccagctaatcagctggtt

SEQ ID NO: 11866 - protein, 106 aa, Zea mays
  misc_feature: Ceres CLONE 1366186-F
  misc_feature: SWISSPROT Homolog: EC 2.7.1.17 Xylulokinase
  misc_feature (64)..(64): Xaa is any aa, unknown, or other
  misc_feature (65)..(65): Xaa is any aa, unknown, or other
  misc_feature (69)..(69): Xaa is any aa, unknown, or other
  misc_feature (87)..(87): Xaa is any aa, unknown, or other
  misc_feature (88)..(88): Xaa is any aa, unknown, or other
  misc_feature (96)..(96): Xaa is any aa, unknown, or other
MAVSGSGQQHGSVYWKKGSHAVLSSLDASKSLLSQLKDAFSTMNSPLWMDSSTTKQCREIENAXXSALXFSKLTGSRAYERSLAPRXXRSIRQRLXVMKIPRDIFW

SEQ ID NO: 11867 - DNA, 734 bp, Zea mays
  misc_feature: Ceres CLONE 1366191-F
  misc_feature: Encodes the peptide sequence at SEQ ID NO. 11868
  misc_feature (305)..(305): n is a, c, t, g, unknown, or other
gctggagctccccgcggtggcggccgctctagaactagtggatcccccgggctgcaggaattcgcacgagaccattacctagaacatcctaatcaaaaaaacatagcgaacaaacatcgagtacagccggctaggtaatctggtacgacgacccacgacgacatggcggcggccaccaccaccagcagcagcaagaagtcgtcgtcgccgtcgtcctcgagctcggcgcagcgggcagcagctgccgccctgctcgtggcggtgtccgtcctggtggtgggcgcggcggcggtgtgcgacatgancaacgagcagttcatgtcgtggcagccccgcggcggccaagacgacggacccgccggccgcgccgtcgcaggcgtgctgcgacgcgctggcgggggcggacctcaagggcttgggcggctacaagaactcggcggggatggggggtttacaaattcgaccccaaagggcggcatggaggttgccggccaaggggcggcctccgccacgccgcccggattgttagcccaagccaagaggggaagggccccccgcatttgtaaggtggaaggggggggggggtgggcttttggcaaggagggggagggggcccccaaagaacacgggcccctctctctccttcttctttgccaccatatgggaggggggggggggtcccaaaaaaataaaaaaggtcttttggcaacactaggggggaagaagtggccaag

SEQ ID NO: 11868 - protein, 190 aa, Zea mays
  misc_feature: Ceres CLONE 1366191-F
  misc_feature (48)..(48): Xaa is any aa, unknown, or other
MAAATTTSSSKKSSSPSSSSSAQRAAAAALLVAVSVLVVGAAAVCDMXNEQFMSWQPRGGQDDGPAGRAVAGVLRRAGGGGPQGLGRLQELGGDGGFTNSTPKGGMEVAGQGAASATPPGLLAQAKRGRAPRICKVEGGGGWAFGKEGEGAPKEHGPLSLLLLCHHMGGGGGSQKNKKGLLATLGGKKWP

SEQ ID NO: 11869 - DNA, 743 bp, Zea mays
  misc_feature: Ceres CLONE 1366195-F
  misc_feature: Encodes the peptide sequence at SEQ ID NO. 11870
aaagctggagctccccgcggtggcggccgctctagaactagtggatcccccgggctgcaggaattcgcacgagaccattacctagaacatcctaatcaaaaaactagttgctagtgctaccaggaacaggaaggaaacaccgccgccgccgcgccttccattccagtactcgcggaggaaaggacaccagccagcgccatggtcacgtcgacgaccgccgccgccgtgctgtccccgccgtccgtggccggtcttcgcctggcgccgtctccccgggcgcgcgtggcgttccgcgcggcgcggccgcagcggtccgtgccggagcgcgcggagctgaacccgtcgctggtgatcaccctgagcaacggcgtgtcgctcttcctgggaccgcttcgtctgcttcaacttccatccggaagaacgtgcaaaaaccaggggcccccactgaaaagggaaaaaacgcactttcaaccgccggtcgacgagcgcgccccaaggaggtccttgggccctggttaaaaggccaaacgacccccgggaggttttcaaacctcgtcgaaccttccttcgccctgggggttccgctacggccaacattcggcccccctacttacatcccctcccccccttccaagggaacgggataaccaccccccacttttctttcttaaaaggcacggcctttgggggattgggttcttaaaaccccgggcctggaatgtctaacaccccggggggggggg

SEQ ID NO: 11870 - protein, 106 aa, Zea mays
  misc_feature: Ceres CLONE 1366195-F
MVTSTTAAAVLSPPSVAGLRLAPSPRARVAFRAARPQRSVPERAELNPSLVITLSNGVSLFLGPLRLLQLPSGRTCKNQGPPLKREKTHFQPPVDERAPRRSLGPG

SEQ ID NO: 11871 - DNA, 648 bp, Zea mays
  misc_feature: Ceres CLONE 1366199-F
  misc_feature: Encodes the peptide sequence at SEQ ID NO. 11872
  misc_feature (602)..(602): n is a, c, t, g, unknown, or other
  misc_feature (645)..(645): n is a, c, t, g, unknown, or other
tccccgcggtggcggccgctctagaactagtggatcccccgggctgcaggaattcgcacgagaccattacctagaacatcctaatcgaaaacatctcacacacttgggttggtgactagctaggttgctcttatccgcctgcagtccatgggcaccgtcagtctcgcgctctcgctgcgattcgcgccgtcgtcgcgaccgctgagtctccaccgcaggaggcccgacgccgtgacctgccgcgcgaccaccaccacgttccaccggctcgacgccgtcacagtgagagaggaagagtctaaatttcggagggccgcgccggagggctgtaacttggtgccgatcacgagaagcattttctctgatcatcttactccggtgctcgcgtaccgttgcctagtcaaagaagatgatcgtgaggcgcctagctttctgttcgaatccgtataacaaggctcagaatgtacaaatatgggaaggtatagcgttgtcgcgccccagcctgctatggaggtattgtcgaaggctaacaaagtcacggtgatggaccatgagttgaagtcgaggagcgagcacttggtgcctgatcccatgaagatccnaggaccatcatggaacagtgggacccgccgcaagtactgtggnccc

SEQ ID NO: 11872 - protein, 100 aa, Zea mays
  misc_feature: Ceres CLONE 1366199-F
  misc_feature: SWISSPROT Homolog: EC 4.1.3.27 Anthranilate synthase
MGTVSLALSLRFAPSSRPLSLHRRRPDAVTCRATTTTFHRLDAVTVREEESKFRRAAPEGCNLVPITRSIFSDHLTPVLAYRCLVKEDDREAPSFLFESV

SEQ ID NO: 11873 - DNA, 682 bp, Zea mays
  misc_feature: Ceres CLONE 1366206-F
  misc_feature: Encodes the peptide sequence at SEQ ID NO. 11874
aaagctggagctccccgcggtggcggccgctctagaatagtggatcccccgggctgcaggaattcgcacgagaccattacctagaacatcctaatcgaaaactagacccaccgccccccctacgaatgtcagaggatttgccaagctcttcaaggaccccagcgaggagcagagggatcacgctgaaaagctcatgaagaaccaaaatgaacttgtaggcatatggatcctccaatcgatcgtcacgcctttaaccgagtgtgaccaccctgagaaagacacgctgtgtacgctatgcatctaggatctgctcctgcaaaagctgctcaatgaccagctgcacaacctgtatgtagtggcagctaggcgcactgatgctcatctgacagagttcatccagagtgatctcatcgaggagcagtcgaatgcatagacaggaatctcaggcatatcgctcatgtgaggagagtgtgcaggcgcaacgggtgcgtgacttcaatcagatgctgctcgagaaagaccctatgatgaccaacgtcatgatcatgaagaaactggtgcgtatgattatcaggcaatgcatatggggcaactgacaactttggtacaggcattgtcaggtagttcgttttttaattccaaaaggggtcccccccttcaaaaggggttgaacctttatctt

SEQ ID NO: 11874 - protein, 36 aa, Zea mays
  misc_feature: Ceres CLONE 1366206-F
  misc_feature: SWISSPROT Homolog: EC 1.16.3.1 Ferroxidase
MKNQNELVGIWILQSIVTPLTECDHPEKDTLCTLCI

SEQ ID NO: 11875 - DNA, 698 bp, Zea mays
  misc_feature: Ceres CLONE 1366209-F
  misc_feature: Encodes the peptide sequence at SEQ ID NO. 11876
aaagctggagctccccgcggtggcggccgctctagaactagtggatcccccgggctgcaggaattcgcacgagaccattacctagaacatcctaatcgaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgaatattatctatctagcttgggggggggttggaacatattaagggaggccgaactgcctgccaataataggtatggtggtggggtggggaaaaaaaaaaaaaacaaattcctcaggttgctatccccccccggctgggttgggggcaagcttttgtgctcatggaccgaacgggggccacccggcatgggggttaaccccattgccttcggttgaaacaaaatttaatttggccccccgaggaaagagtttgcacccattaaaaaaaa

SEQ ID NO: 11876 - protein, 76 aa, Zea mays; identical to SEQ ID NO: 8464
  misc_feature: Ceres CLONE 1366209-F
  misc_feature (1)..(76): Pfam Name: Metallothio_2 Pfam Description: Metallothionein

SEQ ID NO: 11877 - DNA, 696 bp, Zea mays
  misc_feature: Ceres CLONE 1366210-F
  misc_feature: Encodes the peptide sequence at SEQ ID NO. 11878
  misc_feature (291)..(291): n is a, c, t, g, unknown, or other
aaagctggagctccccgcggtggcggccgctctagaactagtggatcccccgggctgcaggaattcgcacgagaccattacctagaacatcctaatcgaaaattagccgcgcggacgcccaccagcagctgcccccttgctgtcgccgcctctccgcgcgaccgatctaccgccgccgccaccatgtcgctgatcgccggcgaggacttccaacatattctgcgtctgctgaacaccaacgtggatgggaagcagaagatcatgttcgccatgacctccataaggggtgtngggcgccgcttctccaacatcgtctgcaagaaggccgacatcgacatgaacaagagggccggtgagctgacgcctgaacagctgaagcgcctgatgacggtcgtggcaaaccttagggagttcaaggtgccggactggttccctcacagggaagaaggattacagggacggaaggttctcaacaggtcgtctcccacgccctcgacatggaggctcagggaccacccccaagaggctcaagaagatcaggaaaccacccgtggcctgggtaactactgggggcctcccgggccgggggccagcacacccaaaaccctggggagggggggaaaaaactggttggtggccccaaaaaaggaaaaacctacttatcctttcgacaaatccccaaaaggaacaaggggg

SEQ ID NO: 11878 - protein, 171 aa, Zea mays
  misc_feature: Ceres CLONE 1366210-F
  misc_feature (14)..(105): Pfam Name: Ribosomal_S13 Pfam Description: Ribosomal protein S13/S18
MSLIAGEDFQHILRLLNTNVDGKQKIMFAMTSIRGVGRRFSNIVCKKADIDMNKRAGELTPEQLKRLMTVVANLREFKVPDWFPHREEGLQGRKVLNRSSPTPSTWRLRDHPQEAQEDQETTRGLGNYWGPPGPGASTPKTLGRGGKNWLVAPKKEKPTYPFDKSPKGTRG

SEQ ID NO: 11879 - DNA, 745 bp, Zea mays
  misc_feature: Ceres CLONE 1366212-R
  misc_feature: Translation starting site: 195
  misc_feature (1)..(1): n is a, c, t, g, unknown, or other
ncgattgggtaccgggccccccctcgaggtcgacggtatcgataagcttttttttttttttttttaagaaacacggcatttcctattccattcggaatgacataaagcaacttgagcgaagcatgatacacagccaatcacattgcccgcttacaacctacacatgacaacttcgagatccgcctccaaaccctatgccttcttgggggacttggcggccttcttgggcgacttggcctccttgctcccgccgctggacgccttctccgccgactgcttgggcagcaggaccgggttgatgttgggcaacacgccgccgtgggcgatggccacgccggtcaccagcttcccgagctcctcgccgttgcggatcgacagcagcacgtggcgccggacgatagcgcctcttcttggcgtccttggcagcgttgcctgctagctccaagacctcagcggcgaggcactccaggactgccactaggcagacagaggcaccgatgccgacgcgctgcgcgtagcgcaccttcttgaggtagcgcccgatgctgccgacggggaactggagcccggccttcacggacctcgtaaccgacatcttcctcggcccgtcggccttgcgaccggccgctcccttcttcgccttccctacatcatcaatgccggtggcgtccatggccacagctgcgcttctcggagctgaggatgtcttgccagatggcagcactcgttcaaagcaagatattcc

SEQ ID NO: 11880 - DNA, 792 bp, Zea mays
  misc_feature: Ceres CLONE 1366213-F
  misc_feature: Encodes the peptide sequence at SEQ ID NO. 11881
  misc_feature (313)..(313): n is a, c, t, g, unknown, or other
  misc_feature (314)..(314): n is a, c, t, g, unknown, or other
  misc_feature (348)..(348): n is a, c, t, g, unknown, or other
  misc_feature (442)..(442): n is a, c, t, g, unknown, or other
  misc_feature (447)..(447): n is a, c, t, g, unknown, or other
  misc_feature (472)..(472): n is a, c, t, g, unknown, or other
  misc_feature (473)..(473): n is a, c, t, g, unknown, or other
  misc_feature (508)..(508): n is a, c, t, g, unknown, or other
  misc_feature (750)..(750): n is a, c, t, g, unknown, or other
  misc_feature (757)..(757): n is a, c, t, g, unknown, or other
aaagctggagctccccgcggtggcggccgctctagaactagtggatcccccgggctgcaggaattcgcacgagaccattacctagaacatcctaatcgaaaacgagctgcccgcgcgcggcagttaagctcacacatcagctagctcaccttggacggccgaccaggtacgttgcgagcgatggcgggatacaaagcgtcgggcggcacggcgctcggcgtcgtcctggctgttgccgcgctcctcgccgcggcggcgatggcggtggacgacgagcacatgtaccactggaagtgctttcactcgtgcacgnngaagtgccgcgacgaggacgcctttgacgacggncacccgttccggggattcgaacgtctcttcccgtcgtctctgggggaaagtgcaaacaacagggggcctcagggagtgggcttcaaggacctgncgggncattttggtaacaacaaggggggtnntaaagaagggggctttgttttccccccccttttancaaaaaaaaaaacagttggggctgaagaaagttggtgtaacaaaaggggtttcccccagggcccccccagtgccgtgggtcttgggcccaaaaacaagagggcccaatgggtttgggcccccaaaaaaccccgtcccccaaaaaaaaaaaaagagggccgcgcgggaaaaaaaccccaccaaccacgggggggcccccccaccaaaaaaaaaacggctcctcccccccccccccgggggggngaaaganagcgcggccgcaaaaaaaattgttttctttggggg

SEQ ID NO: 11881 - protein, 204 aa, Zea mays
  misc_feature: Ceres CLONE 1366213-F
  misc_feature (45)..(45): Xaa is any aa, unknown, or other
  misc_feature (88)..(88): Xaa is any aa, unknown, or other
  misc_feature (98)..(98): Xaa is any aa, unknown, or other
  misc_feature (110)..(110): Xaa is any aa, unknown, or other
  misc_feature (193)..(193): Xaa is any aa, unknown, or other
MAGYKASGGTALGVVLAVAALLAAAAMAVDDEHMYHWKCFHSCTXKCRDEDAFDDGHPFRGFERLFPSSLGESANNRGPQGVGFKDLXGHFGNNKGGXKEGGFVFPPLLXKKKTVGAEESWCNKRGFPQGPPSAVGLGPKNKRAQWVWAPKKPRPPKKKKEGRAGKKPHQPRGGPPTKKKTAPPPPPRGGERXRGRKKNCFLWG

SEQ ID NO: 11882 - DNA, 684 bp, Zea mays
  misc_feature: Ceres CLONE 1366216-F
  misc_feature: Encodes the peptide sequence at SEQ ID NO. 11883
  misc_feature (432)..(432): n is a, c, t, g, unknown, or other
  misc_feature (444)..(444): n is a, c, t, g, unknown, or other
  misc_feature (445)..(445): n is a, c, t, g, unknown, or other
  misc_feature (492)..(492): n is a, c, t, g, unknown, or other
  misc_feature (564)..(564): n is a, c, t, g, unknown, or other
  misc_feature (591)..(591): n is a, c, t, g, unknown, or other
  misc_feature (617)..(617): n is a, c, t, g, unknown, or other
  misc_feature (621)..(621): n is a, c, t, g, unknown, or other
aaagctggagctccccgcggtggcggccgctctagaactagtggatcccccgggctgcaggaattcgcacgagaccattacctagaacatcctaatcgaaaactgctaacgccgctcgcgcatcctattgccctcgcgccaccgtcgccgccgctgcagcgagccaccgccctgccgtcgcctgaggtagacaccaagccaccgccatggggcgtatgcacagccgcgggaagggtatctcttcatcggcgctgccgtacaagaggactcctccgatctggctcaagacagctaccaccgaggtggaggagatgattaccaaggctgcgaagaagggccagatgccgtcgcagattggtgttctgctccgtgaccagcacggcatcccgctcaagagcgtgactggtagcaagatcctccgcatcctcaggncccatgggttgnncgccgagatccgggaggatctctacttcctcattaagaaggccgtgncgattaggaagcatctggagaggaacaggaagggacaggactccaaattcagactcattctttgtgagagcnagatccaccgccttgcccgctactacnagcgtaccaagaagctcccaccccanctgnaagtacgagtcaacccacggcgagcactctggtggcctaagtgatatcctctgatggcttgtc

SEQ ID NO: 11883 - protein, 152 aa, Zea mays
  misc_feature: Ceres CLONE 1366216-F
  misc_feature (1)..(60): Pfam Name: Ribosomal_S13_N Pfam Description: Ribosomal S13/S15 N-terminal domain
  misc_feature (64)..(141): Pfam Name: Ribosomal_S15 Pfam Description: Ribosomal protein S15
  misc_feature (76)..(76): Xaa is any aa, unknown, or other
  misc_feature (80)..(80): Xaa is any aa, unknown, or other
  misc_feature (96)..(96): Xaa is any aa, unknown, or other
  misc_feature (120)..(120): Xaa is any aa, unknown, or other
  misc_feature (129)..(129): Xaa is any aa, unknown, or other
  misc_feature (137)..(137): Xaa is any aa, unknown, or other
  misc_feature (139)..(139): Xaa is any aa, unknown, or other
MGRMHSRGKGISSSALPYKRTPPIWLKTATTEVEEMITKAAKKGQMPSQIGVLLRDQHGIPLKSVTGSKILRILRXHGLXAEIREDLYFLIKKAVXIRKHLERNRKGQDSKFRLILCESXIHRLARYYXRTKKLPPXLXVRVNPRRALWWPK

SEQ ID NO: 11884 - DNA, 862 bp, Zea mays
  misc_feature: Ceres CLONE 1366218-F
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (497)..(497): n is a, c, t, g, unknown, or other
gcccccccccttttttagtgacgcccnncnnnnnncgtgggnnngtcaaaactggagctccaccgcggtggcggccgctctataatagtggatcccccgggctgcaggttttcgcacgagaccattacctagaacatcctaatcaaaaaacctatggaccacaattctcgcgctggtagcctggtacagacgtacagtacagtcgctgcatcaaaagggggatcccgcgaggcgagatgcagctctccccggtggggaggtgacccgacctccccgaggacatcagtgtaaccgacgactcctggctccaggaggccgacgcctgccgcgctcggaggatgctcgcggtcccggggcacagccggcgacgccggacggcccggggagaagactcatcggcggcccggggcccccccggctggggggggggggggggccttctgcacggggaggggaaacgtcccccccccccaggtaggcaccgacagacccgcccnggcgcgccccctccgcccggaggtctcgaacccggcgcggcccccgcccgcactttatttattcgagggccattcgggagataccggacccccctccccccggggcagatgactccggcagggataaaaggccacgcgggagccacgcgaaaccaaacgagccgccacgggatgcgcacgccagtcccccacccctggccctcccccaggaacgaaaacacccccggaatacaaggaccgactgtgtcgacaaaccgccacgcgccccatgttggccactccctggccttagccgcccccccgaccgccccgctgagtcacccggacggaactcattgcccaaggatgatcgtagcacacgccgg

SEQ ID NO: 11885 - DNA, 701 bp, Zea mays
  misc_feature: Ceres CLONE 1366222-F
  misc_feature: Encodes the peptide sequence at SEQ ID NO. 11886
  misc_feature (325)..(325): n is a, c, t, g, unknown, or other
  misc_feature (387)..(387): n is a, c, t, g, unknown, or other
  misc_feature (413)..(413): n is a, c, t, g, unknown, or other
  misc_feature (438)..(438): n is a, c, t, g, unknown, or other
  misc_feature (439)..(439): n is a, c, t, g, unknown, or other
  misc_feature (470)..(470): n is a, c, t, g, unknown, or other
  misc_feature (471)..(471): n is a, c, t, g, unknown, or other
  misc_feature (475)..(475): n is a, c, t, g, unknown, or other
aaagctggagctccccgcggtggcggccgctctagaactagtggatcccccgggctgcaggaattcgcacgagaccattacctagaacatcctaatcgaaaaatcacacactaatcaacaagcaggaccagctagctagctcctctcactgctatcacccgcccagccatctcgcaaagagaaaagcgcagccatgaagactactagctcgggcattgcagtcgtcctactggtggccatgctggcagtccattccgcgttggccgacatctcgtgctccgacgtgctcaacgacctgtcgccgtgcctgcccttcctgcagggncaggcagccaaacccagcgagagcaacaaccagtgctgcgacggcgtgagggccctgtacgncggcgcggacaccaggcccgacaggncagccacgtgctgcctcagggcggnnctacgtcagggtcacgctgtgctctccgcgnngcangagctgcccggggactgcggcctctcgttggcctacaacatcacccccgacttcgactgggaaaagatcgaatgaagggaaactggtccccttaccaaatcataacgacgggatggggatgttcagggccctgctaacaaaaggctgcttccggcctgggggcctaaaaaaagggattgggggatgttggggcctataaagggggccccccgggacccgggggact

SEQ ID NO: 11886 - protein, 118 aa, Zea mays
  misc_feature: Ceres CLONE 1366222-F
  misc_feature (28)..(114): Pfam Name: Tryp_alpha_amyl Pfam Description: Protease inhibitor/seed storage/LTP family
  misc_feature (65)..(65): Xaa is any aa, unknown, or other
  misc_feature (74)..(74): Xaa is any aa, unknown, or other
  misc_feature (82)..(82): Xaa is any aa, unknown, or other
  misc_feature (93)..(93): Xaa is any aa, unknown, or other
  misc_feature (94)..(94): Xaa is any aa, unknown, or other
MKTTSSGIAVVLLVAMLAVHSALADISCSDVLNDLSPCLPFLQGQAAKPSESNNQCCDGVRALYXGADTRPDRXATCCLRAXLRQGHAVLSAXXELPGDCGLSLAYNITPDFDWEKIE

SEQ ID NO: 11887 - DNA, 701 bp, Zea mays
  misc_feature: Ceres CLONE 1366227-F
  misc_feature: Encodes the peptide sequence at SEQ ID NO. 11888
  misc_feature (441)..(441): n is a, c, t, g, unknown, or other
  misc_feature (490)..(490): n is a, c, t, g, unknown, or other
aagctggagctccccgcggtggcggccgctctagaactagtggatcccccgggctgcaggaattcgcacgagaccattacctagaacatcctaatcaaaaaatcaactcgcaattccgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccaggnacaaacagaagactcgcattattccgcgccacgtgcttctggcgatccngaaacgacgagagcttgggaaagctgtggggcgcgtgaccatcgctcacggcggtgtggctcccaatatcaaccctggtctgctgcccaaaaagacagcggaaaaggcgtcagtgccggaagcaggaggcaaggcccccaaaaaaggccgccaatcccctaaaaaggataaactgactgtccgaaggattttgtgtttaaaaagacttggt

SEQ ID NO: 11888 - protein, 172 aa, Zea mays
  misc_feature: Ceres CLONE 1366227-F
  misc_feature (31)..(104): Pfam Name: Histone Pfam Description: Core histone H2A/H2B/H3/H4
  misc_feature (86)..(86): Xaa is any aa, unknown, or other
  misc_feature (102)..(102): Xaa is any aa, unknown, or other
MDSTGTGAGGKGKKGAAGRKVGGPRKKSVSRSVKAGLQFPVGRIGRYLKKGRYAQRVGTGAPVYLAAVLEYLAAEVLELAGNAARXKQKTRIIPRHVLLAIXKRRELGKAVGRVTIAHGGVAPNINPGLLPKKTAEKASVPEAGGKAPKKGRQSPKKDKLTVRRILCLKRLG

SEQ ID NO: 11889 - DNA, 599 bp, Zea mays
  misc_feature: Ceres CLONE 1366228-F
aaagctggagctccccgcggtggcggccgctctagaactagtggatcccccgggctgcaggaattcgcacgagaccattacctagaacatcctaatcgaaaaacagccagggaaatcttccggtctcaaaccaacctaggcaattctccgcagcctctcaccctcgggagtcccgacctcccgcagccgccgcacagatggcacccacggcgaagaagaagccggcgaccaagaaggccgcggaggaggagccctcgacagagaaggtggataatgctcccgcgacttattaatcccatggacgtacatgcgcctccgggcgagggaaagtccagggagggcgggggaggggaaataatgggaaaaaaaaataggggccaaaaagcccggggggggggcccaaacaatttttaacctttttcccgggggggtataaaaaagggggtttcccccccagaaaaattatttttctcccccccaaaagcccggggggaaaaaaaaagaactcccttcttttaaaaaaaaaaatttttttaaaaaaaaattgggggggggggaaaaaccccccccccaagggggtggggggcggggagaaaaaa

SEQ ID NO: 11890 - DNA, 737 bp, Zea mays
  misc_feature: Ceres CLONE 1366233-F
  misc_feature: Encodes the peptide sequence at SEQ ID NO. 11891
  misc_feature (360)..(360): n is a, c, t, g, unknown, or other
  misc_feature (480)..(480): n is a, c, t, g, unknown, or other
  misc_feature (706)..(706): n is a, c, t, g, unknown, or other
  misc_feature (707)..(707): n is a, c, t, g, unknown, or other
aagctggagctccccgcggtggcggccgctctagaactagtggatcccccgggctgcaggaattcgcacgagaccattacctagaacatcctaatcgaaaaacatgcacgctagtggctagcactgccgcagtaggtcagtcgggtgtacgtacggtgccatggcctcggcctcgctgccgctcctcgtcatcgtcctcctcgtctcggtcgtcggagcttgcactcgtgctgccgaggcggcggctacccgtaggaaggacgatgtcatcacaacaaccaccagcagcagccgtggatcatcctcaccgtcgtcgtcaccctccccaggagcagcagcagagaagaaagagaagcccangggcggtggcggcgcgacgtccgcgaagaagccgtcgccgccggccaagtgcgtgacgagcaaggactgcccactcaggcggcttgtgtggcgccaggaggtgcaccatggccccacacnacaagtgcgccggcaaggtgttccaattcttggaacgcccttcccattttgcacctagttgactggcatggttatgtaacccccagtaaaaaatttatttatttaaaaaaagggaccccctggcctggaattccaaccggaattggacccctgggacatcaaaaggggatggggattggggtcctatcccccctttttaaaaaaaaaaaaaaaaaagttttttttnnttttttaagagggggggggggggggggggg

SEQ ID NO: 11891 - protein, 125 aa, Zea mays
  misc_feature: Ceres CLONE 1366233-F
  misc_feature (67)..(67): Xaa is any aa, unknown, or other
  misc_feature (107)..(107): Xaa is any aa, unknown, or other
MASASLPLLVIVLLVSVVGACTRAAEAAATRRKDDVITTTTSSSRGSSSPSSSPSPGAAAEKKEKPXGGGGATSAKKPSPPAKCVTSKDCPLRRLVWRQEVHHGPTXQVRRQGVPILGTPFPFCT

SEQ ID NO: 11892 - DNA, 689 bp, Zea mays
  misc_feature: Ceres CLONE 1366235-F
  misc_feature: Encodes the peptide sequence at SEQ ID NO. 11893
ctccccgcggtggcggccgctctagaactagtggatcccccgggctgcaggaattcgcacgagaccattacctagaacatcctaatcgaaaaatggcaaattaaaaacaagccacctgctgtctgctgcccgctgcgctgagcgtgagagctagctactaccttattacctctctccggtctccgcagctgtaggcggcggcgaccatggacttcgtgctccaggtcctgctgcgagtgctgatgacaacaagcatccgcaggctgcaagaggtcgctgacatcgccgtggacatcggcacggctgtcttcgtggccgtgcgtgtctccggcctcgtcttccgccgccggctgcccacgccgactacgacatcgtcgtcggcgacaacgtactactacctccccggagacgtccctcctcgatcgggatgcatgtccaggaggattaattatttggccaggcactagatgagctagctagctagctagggccagaagatgtatacttctcgcgggtggggcatgtaacaaccaggtcctatatcctgggcgttcttttttgggaatcaaaactatttccctagctccccaaaaaaaaaaaaaaaaaggttatcgataccgtcgacctcaaaggggggcccggtacccaatttcccctaatgggggagccgaatacgccggcctcctgcc

SEQ ID NO: 11893 - protein, 86 aa, Zea mays
  misc_feature: Ceres CLONE 1366235-F
MDFVLQVLLRVLMTTSIRRLQEVADIAVDIGTAVFVAVRVSGLVFRRRLPTPTTTSSSATTYYYLPGDVPPRSGCMSRRINYLARH

SEQ ID NO: 11894 - DNA, 732 bp, Zea mays
  misc_feature: Ceres CLONE 1366238-F
  misc_feature: Encodes the peptide sequence at SEQ ID NO. 11895
  misc_feature (247)..(247): n is a, c, t, g, unknown, or other
  misc_feature (264)..(264): n is a, c, t, g, unknown, or other
  misc_feature (323)..(323): n is a, c, t, g, unknown, or other
  misc_feature (350)..(350): n is a, c, t, g, unknown, or other
  misc_feature (394)..(394): n is a, c, t, g, unknown, or other
  misc_feature (395)..(395): n is a, c, t, g, unknown, or other
  misc_feature (405)..(405): n is a, c, t, g, unknown, or other
  misc_feature (521)..(521): n is a, c, t, g, unknown, or other
aaagctggagctccccgcggtggcggccgctctagaactagtggatcccccgggctgcaggaattcgcacgagaccattacctagaacatcctaatcgaaaaatcacacactcgactctcctctctcgcatccgcagcctttcgagctctactccaccccctcgatctcgaagcgcagcagcagcagtcaggcggccatggacgcgagcgcagccggagccggcgggaaggcgaagaagggcgcggncgggcgcaaggccggcnggccgagtaagaagtcggtgacgaggtccgtcaaggccgggctgcagtttcccgtcggnccgcatcggcggtacctgaagaagggncggtacgcgcagcgcgtcggcacgggcgcccccgtctaactggnncgcgtcctcnagtacctgggccgcgagatgctggagctggcccgcaacgctgccaaggaaaaaaagaagaacgggatcatccgggggcacgtggttcttggcatccgcaaagacgaggagctcggnaaggtggttgcccgggttccccttcgccccggggggggcctccccaaaattaaaccggtggccctggcaaaaaaaccctttaaaaggggggggccaggggggccaatcccccaaaaagggcgccaatccccaaaaaggaaaagggggggggccgccttacccgggggggggggagcgggcggggaaaaaaaattattcggggggggggggt

SEQ ID NO: 11895 - protein, 63 aa, Zea mays
  misc_feature: Ceres CLONE 1366238-F
  misc_feature (17)..(17): Xaa is any aa, unknown, or other
  misc_feature (23)..(23): Xaa is any aa, unknown, or other
MDASAAGAGGKAKKGAXGRKAGXPSKKSVTRSVKAGLQFPVGPHRRYLKKGRYAQRVGTGAPV

SEQ ID NO: 11896 - DNA, 702 bp, Zea mays
  misc_feature: Ceres CLONE 1366239-F
  misc_feature: Encodes the peptide sequence at SEQ ID NO. 11897
  misc_feature (392)..(392): n is a, c, t, g, unknown, or other
  misc_feature (420)..(420): n is a, c, t, g, unknown, or other
aaagctggagctccccgcggtggcggccgctctagaactagtggatcccccgggctgcaggaattcgcacgagaccattacctagaacatcctaatcgaaaaatcgcacaaatcctcttcctcgagttctcctcaaccaaattcaaagtcacagcggcgaaactctcggcgatgtctggccgcggcaaggtcgtcaagggtctgggcaagggcggcgccgagcgccaccgcaaggtgctgcgtgacaacatccagggcatcaccaagccggagatccgcaggttggcgaggcagggcggcgtcaagcgcatctccgggctcatctacgacgagacccgcagcgtgctcaagatcttgctcgagaacgtcatccgcgacgcggtcacctacancggagacacccgtcgcaagactgtgacngtcatggacgttcgttaaccttttcagggccagggccgcacctctagggtttctgcgggtaggccccccctttcccggggggaaatacttgcggggagggggcggcccgagttggttcttggccaaaaagacttgggggtctttaatccggcccctttttttggggggggggacgcgcccttccatgttaaaagcgggggggaaaaatatcctttttttaaaaaagggggcgcccctttcgcccctaaaaaaaaaaaaaaatttttttccccgccccccggg

SEQ ID NO: 11897 - protein, 88 aa, Zea mays
  misc_feature: Ceres CLONE 1366239-F
  misc_feature (25)..(89): Pfam Name: Histone Pfam Description: Core histone H2A/H2B/H3/H4
  misc_feature (74)..(74): Xaa is any aa, unknown, or other
MSGRGKVVKGLGKGGAERHRKVLRDNIQGITKPEIRRLARQGGVKRISGLIYDETRSVLKILLENVIRDAVTYXGDTRRKTVTVMDVR

SEQ ID NO: 11898 - DNA, 709 bp, Zea mays
  misc_feature: Ceres CLONE 1366242-F
  misc_feature: Encodes the peptide sequence at SEQ ID NO. 11899
  misc_feature (328)..(328): n is a, c, t, g, unknown, or other
  misc_feature (404)..(404): n is a, c, t, g, unknown, or other
aaagctggagctccccgcggtggcggccgctctagaactagtggatcccccgggctgcaggaattcgcacgagaccattacctagaacatcctaatcgaaaagttgttgcggaagtaaatataaactgcgagctatcatatcaagttactgtgaagagtgaagagatatcacagggacctcttcaggcttcaaggcagatccgcagcagatggaggcgaacagcaggctgccggaggtgaccatcgtcccggcggcacggccgttggctgacgacggcacagtcgacgcggcaaaggcggcggcaggcaaggagcccgtaagcccggncactccgtcctcggtggtcgccggccgcatcacctgttaggaaaggcgcgcgttggaccgcttccccctgcctggntggaagctccaccccctctgccaggagtcctggccgtcgcccggccataaggggccgcttcccctactacttcttgaacttcccggtggagtccttgcgggatcaaagtctttgacggggaaatttgggggatggtccttacaactggagggggtccttggggggtttccctggccagggttccccttttgggggacggggtgggaggggggaaaatgggtttggggggaaaaaaaaacggggaccctttggaaaaaccaaaaaggaaaccccccgcaaacggggggaaagggggaaaccgccat

SEQ ID NO: 11899 - protein, 52 aa, Zea mays
  misc_feature: Ceres CLONE 1366242-F
  misc_feature (40)..(40): Xaa is any aa, unknown, or other
MEANSRLPEVTIVPAARPLADDGTVDAAKAAAGKEPVSPXTPSSVVAGRITC

SEQ ID NO: 11900 - DNA, 684 bp, Zea mays
  misc_feature: Ceres CLONE 1366243-F
  misc_feature: Translation starting site: 172
aaagctggagctccccgcggtggcggccgctctagaactagtggatcccccgggctgcaggaattcgcacgagaccattacctagaacatcctaatcaaaagatacacttcccataccctattctcccggagtcgtgagcggtttctcatcatcgccaacagcatccgaagatggtgaatatcctcatgcccgccaagggcgttatcctcctccaggagcgcttcaccggcaggaaggcagttatcgtgcgcgtgttcaaggaggacacccgcgaccgcccctatgagcactgcctcgtcgtaggcctcgccaagtatccaaagaaggtgatccacagggactccgccaagaagactgcgaacaagtcgcgcgtcaagcgcttcatcaggctcgtcaacttcactcacttaatgcccacccgttactgcctctgactgcgatttcaaggatgacgcctccggtgatcccgacgcactctctactcacgacaagaaggtcgccgcctgtaagacagccaaagcgcgccttgacgatcagttcaagaccggtgataacaggtgtttctttagctaggttcgcttatagatgctcggactaccgaatagtcgtgctttagctgtcgattagtcgatcaggaacactgcatctctgctttgaagtacatagagattgtctgatagtcc

SEQ ID NO: 11901 - DNA, 731 bp, Zea mays
  misc_feature: Ceres CLONE 1366244-F
aagctggagctccccgcggtggcggccgctctagaactagtggatcccccgggctgcaggaattcgcacgagaccattacctagaacatcctaatcgaaaactcttcttcgcattgcctttcccttcagttgcaccgacctccagacgaaaccacccaagacgcgtgcttccattcctagcccaacagaagcgaagcacgccaccgaccaccggcctcgaagggatcatcttctctacaactcgtcctcgtggccttgttcctcctcttgtataggggactgcggcggagtggagatccgtgccgacatagaccgacttcttcgctcgctgcctacgattgatggcctcaccttcaccaaccgaagaggtcagcaggggaagcagctccgtcagtctctgatcgggatctcccaggccacttcgggaagaacccctttccccgcagaacggggggaggaacccggccgattctcctgcggaaaaaaaagggaaaacccgggccgatggggggggacaaggttcaaatggaaggtggggggtccttcaagagactgggcttttgggagccccaaccgtgggaaggggcccccccgagagggggccccggttaaaccaaaccggggggtctcccgggcccaaattggggaaacccaagggaaacagggggttgggcggataccctggaagaggggaaaattgggggtgcgccggctttaaaaaggggggcgcc

SEQ ID NO: 11902 - DNA, 917 bp, Zea mays
  misc_feature: Ceres CLONE 1366245-R
  misc_feature (498)..(498): n is a, c, t, g, unknown, or other
gggtaccgggccccccctcgaggtcgacggtatcgataagcttttttttttttttttttcttttttttttttttttttttttttttttttttttttttttttttttttttgaaggttgcccaatcatccttgggccccatagggttacaaatgattgacagtttgtacaaataaaagcgcatgggcaaaacgacttgtgtctggattctctcagtgacaatggtaattgaaaaatatactagtcatagtagcagtacttaatagtaatacatcccatccatctgatcgggcaaaaatgccaacatgcccatccattccacgcgatccctccctaattccgtacaagttggcctaatccagtctactcctctctggtcgaaggagccattccagctgaagggctgtctgcgaagtactccgcgtgtttcaagttcacgccgtgctcccgcaaagctttagaaagatcatccattgtttaatacaaaacgtctatccctncggcggtttggccttattggctttgaaaaggggctggaacccctgggctttgcattgcctgaaaaaaatcccctagcaaatggccgaaaaagaacttccggggggggcaaacacaaccattcccctttagggcccaggttcggggcaaaggaaacccccttccgcccaaagtaatgcccccccccacccccccggaaaatctgggggggggttctcccctggagggaaaaaaaaaaaacccgggaaaggaaaccctctttgtttgtggggggccgttccccccctctcaaacaatttttggtaaaactaggccccccccaggggggccccgcgaacacccccccccccggtttgtgttttaaaacccgggagaacccccattttttgttgtgtcctattttccccccccccccgaataa

SEQ ID NO: 11903 - DNA, 694 bp, Zea mays
  misc_feature: Ceres CLONE 1366247-F
  misc_feature: Encodes the peptide sequence at SEQ ID NO. 11904
  misc_feature (482)..(482): n is a, c, t, g, unknown, or other
aagctggagctccccgcggtggcggccgctctagaactagtggatcccccgggctgcaggaattcgcacgagaccattacctagaacatcctaatcgaaacctgcagtatcgggcaagcctacaggcccaaacggaaaaagaggacctgagccgactccgccgaggtcggcggcggcggcggtgagcatggccgcgcatagggagaagaccgcggacgtcgcggccgggccagcacacggcgctgcggtatcggggtctccttctccttcgtcctcatccggaggcccggcggcggcgtcctcgtcgggaagcggcggaagcgccgcgatcgggaacctgggggagctccggcgccaacgtggacgcgctgcataagatgctcggacggaaggactgtcatacgtcgacgatgacattcttctccaaggacttccctcgcccgcccgaccaggcccgcaaccattaaaaggtctttgaccanaagggggcacgcctctgggacgcgaaactccatgcccggcattttctgggagcaggtccgagctcgctacacataaacgaaagggtcgaagctttggcacgaaacttgccacgttacccacacaggggggtcccccagggacttggggaacactgcggaaagggtttcagctgcaccactggaagaaattttgggctgaaccaagaggaaat

SEQ ID NO: 11904 - protein, 62 aa, Zea mays
  misc_feature: Ceres CLONE 1366247-F
MAAHREKTADVAAGPAHGAAVSGSPSPSSSSGGPAAASSSGSGGSAAIGNLGELRRQRGRAA

SEQ ID NO: 11905 - DNA, 693 bp, Zea mays
  misc_feature: Ceres CLONE 1366255-F
  misc_feature: Encodes the peptide sequence at SEQ ID NO. 11906
aaagctggagctccccgcggtggcggccgctctagaactagtggatcccccgggctgcaggaattcgcacgagaccattacctagaacatcctaatcgaaaaaccgtccatccgtattcccgtcacgcccccaacacccccacaacccgaagcagcgaaagctcccctaaccctctccgcgcatccgatcgcaaggaagaagagggagatgagctactacgggcagcagccccccgtcggcgtcccgccgcagcaaggctacccgggcaaggacggctacccgccagcggggtacccgccggccggctaccccccgccggcgcagggctaccctccgcagggctacccgccgcagtacgcgcagccgccgcctccacagcagcagcagagcagcgggccttccttcatggagggatgcttggctgccctctgctgctgctgcctcctggacgcctgcttctgagagtgagaggggccgaccgacggattcgacacggcgacaagtgaaactactagctttctatgcgagggaaaagagagagagagctggaaactggattgagcctggaatgctatcgtgctattctagctttggcagagcatatatgtcgccctagttttttatttctctctgccaatgttgacgggatcaaacggtgtgtgtgaatcctgcctggggatgtcccgggtttc

SEQ ID NO: 11906 - protein, 84 aa, Zea mays
  misc_feature: Ceres CLONE 1366255-F
MSYYGQQPPVGVPPQQGYPGKDGYPPAGYPPAGYPPPAQGYPPQGYPPQYAQPPPPQQQQSSGPSFMEGCLAALCCCCLLDACF

SEQ ID NO: 11907 - DNA, 719 bp, Zea mays
  misc_feature: Ceres CLONE 1366319-F
  misc_feature: Encodes the peptide sequence at SEQ ID NO. 11908
agagctggagctccccgcggtggcggccgctctagaactagtggatcccccgggctgcaggaattcgcacgagaccattacctagaacatcctaatcaaaaatcgcacaaatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctactaggagacccgcggcgtgctcaagatcttcctcgagaacgtcatccgcgacgccgtcacctacaccgagcacgcccgccgcaagactgtgaccggcatggacgttgtctacgctcctcagggccaggggccgcaccctctacggtttcgggggtaaagccgcccctcccccgggggaaattacgtggtggccgtggccggccgggttgggtcctgggccaactaagcccgggggggccttaacgggggctgtttctacgggggggggggacttgcacccgtttaaatttccacccccgaggagtggaaaaatcccccccggggaaaccaaggggaagggcccccgctttcccccgcccgaaaaaaaaaaaaaaaaaaaaaatcttttccgctc

SEQ ID NO: 11908 - protein, 52 aa, Zea mays
  misc_feature: Ceres CLONE 1366319-F
MSGRGKGGKGLGKGGAKRHRKVLRDNIQGITKPAIRRLARRGGVKRISGLIY

SEQ ID NO: 11909 - DNA, 715 bp, Zea mays
  misc_feature: Ceres CLONE 1366320-F
aagctggagctccccgcggtggcggccgctctagaactagtggatcccccgggctgcaggaattcgcacgagaccattacctagaacatcctaatcgaaaaatgaatgtatcttgtcatcacaacgaacaaaagctctcgatctcaccgacaccgaggaagaagagatcagtgctgcccgataagggagtctgtgatctgcgtgcacagcaaggctgagtttgacgcactcatgaccaaggccctcgaagtcggaaaggtggtggtcatcgacttcgctgtcgcctggtgaggtacatgtcgagccatgcgccccactgtacgactgacactctcattagttcactctcgtccacttgctgaaggtgaacgtgcataagggaaggcgtaatcccgccctacaagggggaggagaggctcaccatccatgtcctgaaaaaggggatgacggtctcgaccatcgtgggtggcctgaatggacaactcctggccctgaccaaacaaatatgcccctccccgggaccggggattgggtttggcaaaaaagaaaacaatcatgggggccccctaaaaaacgcccaacacaaaagcttccaaaggggtcgcaaccggacgggtttttcctttggagtgcgtttgcgagcaacacctgtatttttccaaccgagccggggggatttttaccctgggaaatttttgagaggccgtttaaaaag

SEQ ID NO: 11910 - DNA, 698 bp, Zea mays
  misc_feature: Ceres CLONE 1366321-F
  misc_feature: Translation starting site: 194
  misc_feature (459)..(459): n is a, c, t, g, unknown, or other
  misc_feature (503)..(503): n is a, c, t, g, unknown, or other
aaagctggagctccccgcggtggcggccgctctagaactagtggatcccccgggctgcaggaattcgcacgagaccattacctagaacatcctaatcgaaaaaccggccaccgcgaatccagagccccacgccccgtccgaaccccagagcagagcaaagcctcctcgacctccctgtccccagccttccccgatggcccgcacgaagcagacggcgcgcaagtcgacgggcggcaaggcgccgcggaagcagctggcgacgaaggcggcgcgcaagtcggcgccggcgacgggcggcgtgaagaagccgcaccgcttccgcccgggcaccgtcgcgctgcgcgagatccgcaagtaccagaagagcacggagctgctgatcccgcagctcccgttccagcgcctggtccgcgagatcgcgcaggacttcaagacggacctccgctttcagtcctccgnccgtcgcgcgctgcaggaagcccgccgaggcctacctggtgggnctcctcgaggacaccaacctctggtgcatccacgcccagggcggccacatcatgccaagggaatccaggtcgggcggcgcatccggggggagggcgcctaaggggttcgggttgggggcctggtcccttatggtgggagggggttatttaaccccccaggggtggggataaggggggggtgttttttaaaaaggg

SEQ ID NO: 11911 - DNA, 711 bp, Zea mays
  misc_feature: Ceres CLONE 1366323-F
  misc_feature: Encodes the peptide sequence at SEQ ID NO. 11912
  misc_feature (324)..(324): n is a, c, t, g, unknown, or other
  misc_feature (329)..(329): n is a, c, t, g, unknown, or other
agagctggagctccccgcggtggcggccgctctagaactagtggatcccccgggctgcaggaattcgcacgagaccattacctagaacatcctaatcaaaaaatattcgcaagccaccgcaaccgaagcgcgccttcgccgccgcccccgcccccgccgcctctgcgatccccgcaaggtcgcaaacatgtctaccgtgctccagcgcccgacccccggcacggtccagtgcttcggccgcaagaagacggctgtggtcgtcgcctacaccaagccggggcgcgggctgatcaaggtgaacggcgtcccgattgagctcatcangccgnagatgctccgactcaaggccttcgagcccatcctgctggcggggcgctccaggttcaaggacatcgacatgaagatccgcgtcccaagcggggggaagacgtcgaagatctaacgcatcccgccaggccgtccccaaggggttcgccccctaaaaccaaaaatacttcaacgagggccccaaaaaaggaggtaaagaaaatttccaccgggaagaaccgacccttttcctttccgaacccggggggttggaaacaaaaaaaatcccggggggcggggccccccgcccgggtcccaaaaaccccccccgaaagccgccccctgccccctttttgggaaaaaaatcccttgtgttgcccccatttggaaaaaaaagacccggcc

SEQ ID NO: 11912 - protein, 84 aa, Zea mays
  misc_feature: Ceres CLONE 1366323-F
  misc_feature (17)..(84): Pfam Name: Ribosomal_S9 Pfam Description: Ribosomal protein S9/S16
  misc_feature (46)..(46): Xaa is any aa, unknown, or other
  misc_feature (48)..(48): Xaa is any aa, unknown, or other
MSTVLQRPTPGTVQCFGRKKTAVVVAYTKPGRGLIKVNGVPIELIXPXMLRLKAFEPILLAGRSRFKDIDMKIRVPSGGKTSKI

SEQ ID NO: 11913 - DNA, 687 bp, Zea mays
  misc_feature: Ceres CLONE 1366324-F
  misc_feature: Encodes the peptide sequence at SEQ ID NO. 11914
  misc_feature (518)..(518): n is a, c, t, g, unknown, or other
agagctggagctccccgcggtggcggccgctctagaactagtggatcccccgggctgcaggaattcgcacgagaccattacctagaacatcctaatcgaaaaaagtacacggctcaccagactcggcgagtccgatcgagatcgggcgaagctgcaaccctttcctcttcggccccccgctctctcggtgccccaagccggagtacggaggacgggagtcgaacccccggcgtaccgttccttgctcgccccaacttggccgccgcgtcgccctcggctcctagcgatggctggtggtaacgcgtggtcgccgctcccttcgcacggagttgaatccgactccagcgtcatggagagccgcgcaggcgaccctgtggagaggaccaacagcagcggagatggcggcatcagaaaggactcagacaacttcgagagcaacatctggctggacctgacgcaggatcccgtggccaccctctggggacacctcttctgctggccgtgtctctacgagtggntcaacgtgcacgcgcactcccaggagtgccacgtctgcaaggccaacgtcgaggagggtaagctcgtccctctctacggtcgtgaaggaactccacctcaccccgggcaggtctggtggccgggtggaaatcccgagcaggccgatcgggtagcggcccctcactggcc

SEQ ID NO: 11914 - protein, 133 aa, Zea mays
  misc_feature: Ceres CLONE 1366324-F
  misc_feature (78)..(78): Xaa is any aa, unknown, or other
MAGGNAWSPLPSHGVESDSSVMESRAGDPVERTNSSGDGGIRKDSDNFESNIWLDLTQDPVATLWGHLFCWPCLYEWXNVHAHSQECHVCKANVEEGKLVPLYGREGTPPHPGQVWWPGGNPEQADRVAAPHW

SEQ ID NO: 11915 - DNA, 747 bp, Zea mays
  misc_feature: Ceres CLONE 1366325-F
  misc_feature: Encodes the peptide sequence at SEQ ID NO. 11916
  misc_feature (453)..(453): n is a, c, t, g, unknown, or other
  misc_feature (721)..(721): n is a, c, t, g, unknown, or other
aaagctggagctccccgcggtggcggccgctctagaactagtggatcccccgggctgcaggaattcgcacgagaccattacctagaacatcctaatcgaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacggggcgagtcccgggcgactacggctgggacacccgcggggctgtcggccggacccggagaacgtccgccaagaacgggnagctgggaggtcatccactcccccctgggccatgctgggccgcttgggcttgcgggtttcccggaggtggctccccccaaagggggcaaaattccggcaaggcccgggggggtaaagggcgcggtcccaaaaatctttagggaggggggggtgtggaatacccccgtaacccggggttggataccccggaaaaaaaacccctccccacctttgggccccgaaaggggggttctttgggcgccaccaaagggagcaccccgccccccgncgcccctccttaaaggaaggcgccca

SEQ ID NO: 11916 - protein, 142 aa, Zea mays
  misc_feature: Ceres CLONE 1366325-F
  misc_feature (97)..(97): Xaa is any aa, unknown, or other
MASSTMALSSTAFAGKAVNVPSSLFGEARVTMRKTAAKAKPAASSGSPWYGPDRVLYLGPLSGAPPSYLTGRVPGDYGWDTRGAVGRTRRTSAKNGXLGGHPLPPGPCWAAWACGFPGGGSPQRGQNSGKARGGKGRGPKNL

SEQ ID NO: 11917 - DNA, 702 bp, Zea mays
  misc_feature: Ceres CLONE 1366326-F
  misc_feature: Encodes the peptide sequence at SEQ ID NO. 11918
agagctggagctccccgcggtggcggccgctctagaactagtggatcccccgggctgcaggaattcgcacgagaccattacctagaacatcctaatcgaaaagtctagatgacaacatggtgacctcaagcaatggcaaggtatgtgtaaccggggcctcaggctttgttagcctcttggcttattctgctcctcctcgagtctggatatcatgtggtagggactgtcaggaacccacgaaatcaccaaacaacagcccacctttggaaattacctgctcgctaaagagaggctgcaaatcgtgcgacctgatctgttgcaagaaaggagcttcgacagcgccgtgatggcctgtgagcttgtattccactctgaatcccccgacctcgctaaaccctactctactactacggaggacacgctcgttcctgaggtgaacgtcactctgaacgtgctgacatcgggcaagaaaaaccccttcctgaaaagagcgtccctacatcttaggcgtctgcggtgtggatcatgcacgatggtgtacagacccacagtcacatctcgctggacgaaacgacatggagctccgtgcccctctgcttgaggatgcacctatggaatgccctagtcatggtattttgccaaacaaagagggggggcacgtccccaaggaaacccgaatccgactttgtgacttgcctcccc

SEQ ID NO: 11918 - protein, 84 aa, Zea mays
  misc_feature: Ceres CLONE 1366326-F
MACELVFHSESPDLAKPYSTTTEDTLVPEVNVTLNVLTSGKKNPFLKRASLHLRRLRCGSCTMVYRPTVTSRWTKRHGAPCPSA

SEQ ID NO: 11919 - DNA, 874 bp, Zea mays
  misc_feature: Ceres CLONE 1366333-F
  misc_feature: Encodes the peptide sequence at SEQ ID NO. 11920
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
gggtgcccaccccccctcccccccccccccccctnntntngggggnnagggcagagctgcaactccccgcggtggcggccgctctagaactagtggatcccccgggctgcaggaattcgcacgagaccattacctagaacatcctaatcaaaaacacccaagaatcacacaacagcagctcaaaaaacccaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcggccgacgacaaggcgagtggagccgcggcgggtgggggggcccacgcgcacctacgtcccacgacgcgcgcgccatggcggcccacccccgggcccgaggtcaaggaagctcccggggggcggacgtcgttccccgcggggaacatgcacggggctgggggaacggggcgagaatcgagggtggcaagggtggcaaggaaccgaacacgagaagggtggggggaatccaagagggcgcaagcgggccgacccgtgggagggaagcgcgccaaggaaaccccaaagagtcaccttgcgcgccttggaagcacggacccggatggggccaaagtttacattggcgcccaagcgctcggcgggctggcccggcaacaaatcggccggaacattgagaaacaagaactctccaggcgaggtggtggcaagggtcaacggggccgcggcttcgccccggtgaacccgggatagaaagaaaagttgagcccccccgggccacgagggcccgccagaacaacgctccgggggaccgcaggcg

SEQ ID NO: 11920 - protein, 184 aa, Zea mays
  misc_feature: Ceres CLONE 1366333-F
MDGRMFGLETPLMVALQHLLDVPDGDAGAADDKASGAAAGGGAHAHLRPTTRAPWRPTPGPEVKEAPGGRTSFPAGNMHGAGGTGRESRVARVARNRTREGWGESKRAQAGRPVGGKRAKETPKSHLARLGSTDPDGAKVYIGAQALGGLARQQIGRNIEKQELSRRGGGKGQRGRGFAPVNPG

SEQ ID NO: 11921 - DNA, 680 bp, Zea mays
  misc_feature: Ceres CLONE 1366334-F
  misc_feature (516)..(516): n is a, c, t, g, unknown, or other
  misc_feature (533)..(533): n is a, c, t, g, unknown, or other
  misc_feature (560)..(560): n is a, c, t, g, unknown, or other
  misc_feature (562)..(562): n is a, c, t, g, unknown, or other
  misc_feature (564)..(564): n is a, c, t, g, unknown, or other
agagctggagctccccgcggtggcggccgctctagaactagtggatcccccgggctgcaggaattcgcacgagaccattacctagaacatcctaatccaaaaacgactcaatagccgtggaatccatcccggccacggtcggaggaagtgactccgccgcgggccgccatcttcgtcggtgatcttttctcctcaagtcaacaatcaaggcaacgatctaccacaaaactttgttgatctaccagatggcgatcaagacaacgatcaagaaaatgtacaaggcaataatcttagagatgcaatagcacaagaaacgtggaatgattaccaacaacataaaaattagtggtacatttgttgagctatttgttcgtagaaactgtctttgtttattgttgcttcctaatgaaaaacatgttacagatgagcttactttgaagatatggttccctgtaaccactatgcctcctaattatgtcatggtgctgtttatgtcatatatgttgcttcctaaantagtggtacatttgtgngggattgttgcttcctaaaatctgtgngngngtattgcttactctgaagatctgggtggtttgtaactacaagtaggacatagattcttttattttgtgaatgtttcagttatagcaagttttataaacagcggcattcatcgtttt

SEQ ID NO: 11922 - DNA, 701 bp, Zea mays
  misc_feature: Ceres CLONE 1366335-F
  misc_feature: Encodes the peptide sequence at SEQ ID NO. 11923
  misc_feature (701)..(701): n is a, c, t, g, unknown, or other
agagctggagctccccgcggtggcggccgctctagaactagtggatcccccgggctgcaggaattcgcacgagaccattacctagaacatcctaatcggaaaaaaaaaccgagacaccgcgtgcgaaccaagcagaccccagcagaagaagcgaagtcgtcgccggagcaggaggaagagcgaggagcaacatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggacttcgatgaacctggaactcttgcaccaactggtctttttgttggaggtaccaagtacatggtgatccaaggtgaacctggagttgtcatccgaggaaagaagggcactggaggtattactatcaaaaaaactggcatgtccttgattatccggatctatgatgacccaatgactccagggcaatgcaatatggtgctggagagggtgcgcgaattactggatcgaacaggggcttttagggggggtgtttgggttttgaggaattcactccctcccaaaatggtgggggggggcattcttgggctccctttccctctaaattttgggggggaaatgaccccctatttcttn

SEQ ID NO: 11923 - protein, 169 aa, Zea mays
  misc_feature: Ceres CLONE 1366335-F
  misc_feature (2)..(126): Pfam Name: Profilin Pfam Description: Profilin
MSWQAYVDDHLLCDIEGQHLSAAAIVGHDGSVWAQSENFPELKPEEVAGMIKDFDEPGTLAPTGLFVGGTKYMVIQGEPGVVIRGKKGTGGITIKKTGMSLIIRIYDDPMTPGQCNMVLERVRELLDRTGAFRGGVWVLRNSLPPKMVGGGILGLPFPLNFGGEMTPYF

SEQ ID NO: 11924 - DNA, 705 bp, Zea mays
  misc_feature: Ceres CLONE 1366337-F
  misc_feature: Encodes the peptide sequence at SEQ ID NO. 11925
agagctggagctccccgcggtggcggccgctctagaactagtggatcccccgggctgcaggaattcgcacgagaccattacctagaacatcctaatcgaaaaatcttctcccccagctccccagcaccagtccccaattatttggcctccgtcagagaggggagaaagacccgttcgaggcggcggcgatgtcggggcgcggcaagggcggcaagggtctgggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggacgtcgtctacgcggtccagcggcagggccgcaccctctacggattcggaggctaggcgcctcctccctaattggggaatgctagggggaatacccgtcttctgtcccttggggcccaaaaggttgctggggtcccgggaggaaacccatttaatttttcccgaaaggaaaaaaatcttggaaaaaatgtttccccggaaaaaaaaaaaaaaaaaaagtttttttaacccccccacccccccggggggggccccccacccc

SEQ ID NO: 11925 - protein, 103 aa, Zea mays
  misc_feature: Ceres CLONE 1366337-F
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVVYAVQRQGRTLYGFGG

SEQ ID NO: 11926 - DNA, 689 bp, Zea mays
  misc_feature: Ceres CLONE 1366339-F
  misc_feature: Encodes the peptide sequence at SEQ ID NO. 11927
  misc_feature (534)..(534): n is a, c, t, g, unknown, or other
  misc_feature (571)..(571): n is a, c, t, g, unknown, or other
  misc_feature (572)..(572): n is a, c, t, g, unknown, or other
  misc_feature (659)..(659): n is a, c, t, g, unknown, or other
aaagctggagctccccgcggtggcggccgctctagaactagtggatcccccgggctgcaggaattcgcacgagaccattacctagaacatcctaatcgaaaaatcacaattcacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagagacgcgcatcgtcccgcgacacttgctcctggcgattcgtaacgacgttgagctcggcaagctgctgtctggcgtcaccatcgcgcacggnggtgtcctccccaacatcaacccggttctcctgcccnnagaagtggcggagaaggcgtccagcggcggcagcaaggaagagcagtcccctaagaagggccgcccagtccccaaagaggcagccangtccccgagaaaggctaagaaattagtcct

SEQ ID NO: 11927 - protein, 166 aa, Zea mays
  misc_feature: Ceres CLONE 1366339-F
  misc_feature (29)..(100): Pfam Name: Histone Pfam Description: Core histone H2A/H2B/H3/H4
  misc_feature (117)..(117): Xaa is any aa, unknown, or other
  misc_feature (130)..(130): Xaa is any aa, unknown, or other
  misc_feature (159)..(159): Xaa is any aa, unknown, or other
MDASGAGSKAKKGAAGRKAGGPRKKSVSRSVKAGLQFPVGRIGRYLKKGRYAQRVGTGAPVYLAAVLEYLAAEVLELAGNAAKDNKRRASSRDTCSWRFVTTLSSASCCLASPSRTXVSSPTSTRFSCPXKWRRRRPAAAARKSSPLRRAAQSPKRQPXPRERLRN

SEQ ID NO: 11928 - DNA, 683 bp, Zea mays
  misc_feature: Ceres CLONE 1366340-F
  misc_feature: Encodes the peptide sequence at SEQ ID NO. 11929
agagctggagctccccgcggtggcggccgctctagaactagtggatcccccgggctgcaggaattcgcacgagaccattacctagaacatcctaatcgaaaaaaccttcccctacaccagaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgctcgccgcaagaccgtgaccgccatggacgtcgtctacgcgctcaagcgccagggacgcaccctctacggcttcggaggctaggctaggcgcctcttcatagtcggcgactgcttaggggacatgtctctgtgtgatgctttctgacgtagcattgctgcaatagctgcgtaatccatcgcttctgcaatgaagcgctctgaagcatgctacgtatgatgtgtctgtgggtgattgtatgtctggcactaacagtgattcttcctgaagtttggataatacaagctcattc

SEQ ID NO: 11929 - protein, 103 aa, Zea mays; identical to SEQ ID NO: 6459
  misc_feature: Ceres CLONE 1366340-F
  misc_feature (25)..(94): Pfam Name: Histone Pfam Description: Core histone H2A/H2B/H3/H4

SEQ ID NO: 11930 - DNA, 689 bp, Zea mays
  misc_feature: Ceres CLONE 1366342-F
  misc_feature: Encodes the peptide sequence at SEQ ID NO. 11931
  misc_feature (588)..(588): n is a, c, t, g, unknown, or other
  misc_feature (589)..(589): n is a, c, t, g, unknown, or other
  misc_feature (625)..(625): n is a, c, t, g, unknown, or other
agagctggagctccccgcggtggcggccgctctagaactagtggatcccccgggctgcaggaattcgcacgagaccattacctagaacatcctaatcaaaaatatttgttaagtttcaggcagagagaaagatagaggagcaaacagcaactccagaagatgagtctccctcgcctccgccaccttgtcctgctcgcctgcctcctggtcttcctcgtcttcgccgcgtccgcgtcgacgagttccgccgaggtggccccgagcgtggcggtggacttcgtgcggcggtcgtgccggtcgacagagtacccgcgcgtgtgcgagagcacgctggtcccctgcgcggctggcgtggggcgcaacccgcgcctgctggcgcgagcggcgctggtggttggcgccgaccgcgcgcgcaactgctcctcctacatccgcggcggcggcggcggcgcgatgaaggactgcgcggagctggcgcgcgacgcggaggagcggctgcggcagtccgcggcagagatggagcggatgggccgtgccggcacaccgcgcttcgcttggtccctcagcaacgtccagaactgggccagnngcgcgctcaccgacacctcccactggctcgactccntcgcccagcagtcccgcggtggcaagaacagcgacgacgccgttagggtgaagaggaggggtgg

SEQ ID NO: 11931 - protein, 176 aa, Zea mays
  misc_feature: Ceres CLONE 1366342-F
  misc_feature (35)..(172): Pfam Name: PMEI Pfam Description: Plant invertase/pectin methylesterase inhibitor
  misc_feature (143)..(143): Xaa is any aa, unknown, or other
  misc_feature (144)..(144): Xaa is any aa, unknown, or other
  misc_feature (156)..(156): Xaa is any aa, unknown, or other
MSLPRLRHLVLLACLLVFLVFAASASTSSAEVAPSVAVDFVRRSCRSTEYPRVCESTLVPCAAGVGRNPRLLARAALVVGADRARNCSSYIRGGGGGAMKDCAELARDAEERLRQSAAEMERMGRAGTPRFAWSLSNVQNWAXXALTDTSHWLDSXAQQSRGGKNSDDAVRVKRRG

SEQ ID NO: 11932 - DNA, 689 bp, Zea mays
  misc_feature: Ceres CLONE 1366344-F
  misc_feature: Pfam Name: MAM33 Pfam Description: Mitochondrial glycoprotein
agagctggagctccccgcggtggcggccgctctagaactagtggatcccccgggctgcaggaattcgcacgagaccattacctagaacatcctaatcgaaaaaaaacggccgccgattaccccgtcctagagagcgaccagattctacggctctaaggccatgcccgcggcgtctgtcatagctgggatcctacgaacgtgtcgtattgacctcttcctctccactctcggctcttgcccgcggtgggctcgtgacatcagggctcgcggtcccctcctccgccgaatccctgcggcgacctcatcgagggggacgaccaccggacggagctttctggcgtggaatgctccggcgtcctgctccacgagcttctccggatgataacctgatgcacatctcaagaacatgaaatcgagggtgctgtccagacggaggagagaaacaccgacaagcacattgatctaccagaggacttcccttgtgatatcatacacacatacctgaagatcagccactaggcctccaaggggagagtgcaggacatattattaaagctgtaatatacacctactttgatacacatgaacatttggatgacgaagatgacaaaagtgccagagatgagcaatctttcacacactactaccgatggatgtctctgatgacaaatcatgacgtacagtcgtag

SEQ ID NO: 11933 - DNA, 674 bp, Zea mays
  misc_feature: Ceres CLONE 1366349-F
  misc_feature: Encodes the peptide sequence at SEQ ID NO. 11934
  misc_feature (540)..(540): n is a, c, t, g, unknown, or other
  misc_feature (619)..(619): n is a, c, t, g, unknown, or other
aaagctggagctccccgcggtggcggccgctctagaactagtggatcccccgggctgcaggaattcgcacgagaccattacctagaacatcctaatcgaaaacacaagcagcatccgcacactcccaattcccctcgagcgccgcagcgagcccaagaagccgaccgccgagccccctctccagtccagtccgcggtctcggtttcttgcttacccggcgcccaatcttcagggagctccttctcgtcgtctgtctccatggccgcctcgaccaagaccgtcgccgtcctcctcgccgcggtgctcctcgcgctggtcgcgtccgcggcagccagcaggaagctggaggaggaggacgcactcctgggaagcctggccccagcccccgcgccggccgttggcggttccgcggggctgcctggcgccaggccgggggcgtgggccgtcgccgccctggtctctctcgtcgccttcctcgtgaactgagggtgtgggcatcgtgctgcgcagcgcgggagatgggagggacgaatcctgcanccttggatcacgtgggagaggagagggggatatttatgttcgttctgtttgttctagggtgcctctcttttgcctgtantagagaggatcatgaattttttttataataataccgtttatttgtcattcttttt

SEQ ID NO: 11934 - protein, 75 aa, Zea mays; identical to SEQ ID NO: 6082
  misc_feature: Ceres CLONE 1366349-F

SEQ ID NO: 11935 - DNA, 697 bp, Zea mays
  misc_feature: Ceres CLONE 1366350-F
  misc_feature: Encodes the peptide sequence at SEQ ID NO. 11936
  misc_feature (697)..(697): n is a, c, t, g, unknown, or other
cagagctggagctccccgcggtggcggccgctctagaactagtggatcccccgggctgcaggaattcgcacgagaccattacctagaacatcctaatcgaaaaaaccaccagtccgctcaatcatcgccatctcttctcttcttttgctcgctctatacatataccagagaggtaggtagctagctagctagtggtgaaaatacaatggcgcagcggcagggaagaggcagtggtgctgtggcccttgcggcggcggcggcggtgctcctctgcgtgctccttcatgcccacgtcgcggagtcggccgtgttcaccgtcggcgaccgtggcggctggagcttcagcaccggcacctggactaatggcaagcgcttcaaagctggggacgtcctagtgttcaagtacgactcgacggcgcacaacgtggtggcggtgaacgcggccggctacaaaggctgctcggcgccgcggggtgccaaggtgtacacgtccggcaacgaccgcgtcacgctggcccgcggcaccaactacttcatctgcagcatccccggccactgccagtccggcatgaagatcgccgtccacgccgactgagtcctgaccgatcgcggctgccgccggaacgcctgctgccgcgggctacatacatctacctatcgactgcctgattgtcagtttgactggcttgaatcaacn

SEQ ID NO: 11936 - protein, 129 aa, Zea mays
  misc_feature: Ceres CLONE 1366350-F
  misc_feature (44)..(122): Pfam Name: Cu_bind_like Pfam Description: Plastocyanin-like domain
MAQRQGRGSGAVALAAAAAVLLCVLLHAHVAESAVFTVGDRGGWSFSTGTWTNGKRFKAGDVLVFKYDSTAHNVVAVNAAGYKGCSAPRGAKVYTSGNDRVTLARGTNYFICSIPGHCQSGMKIAVHAD

SEQ ID NO: 11937 - DNA, 804 bp, Zea mays
  misc_feature: Ceres CLONE 1366351-R
  misc_feature: SWISSPROT Homolog: EC 3.1.3.48 Protein-tyrosine-phosphatase
ccgagtctggtgcgagttatggtgcagttctctcgaggagttgccacccaataatatgtcgcgtgtcaatcattttaatgagttttaatgaggtgaagtaaccaccgacaagagaaacgcgacaccttgccgatccttggttgttcaaggcctaacagagatataaactcgtgtgcttaacaaacgtccctttgcaatgagcgtcggtgcgactgcagacaggctgccctgaaacctcccatccggtaaacacgcgctccagtaccatgatgttctttatccctgaatcctccttggtctccgatacatagtctgagaacatacgagcacaagttggacctcgtacctggctcagcgcgcaatgtaaaacgagggtgtccttgccgctggaggaccgcaccaactccggcatccgcgcctcgaagctgccgctggcgaaatggtgcgaaccctcgatgtgagcctgggagctcctctcctcatccctgacgtcgatgatggcaaggcggggattgcctctcgccatggataccagcttcgccgccgaaacgtacgatactctccgtgccatcccgttgtcaaccctcactcctcatcgtgggtgaaagggacaaaaaatcagcattttttttctcgattaggatgttctaggtaatggggctcgtggagaattcatgcggacacggggggatcccctattttcctagagcgggacgccaccggcggatggagcttcaagcttttttcttcccttttaggggagggattcaattgcgcccctttgggggtaaaccacgggccatg

SEQ ID NO: 11938 - DNA, 676 bp, Zea mays
  misc_feature: Ceres CLONE 1366351-F
  misc_feature: Encodes the peptide sequence at SEQ ID NO. 11939
aaagctggagctcaccgcggtggcggccgctctagaactagtggatcccccgggctgcaggattcgcacgagaccattacctagaacatcctaatcgaaaaaaaattctgattatttgcttccttcacctacggagagtagcgaggtctaataactccatgcgatgtagagtatcgtacgtatcagcgaggaagctgtgatccatggcgcgagggaatccccgcctcaacatcatcaacgtcacggatgaggacaggagctaccagcctcacatcaagggttcgcaccacttcgtcaaggccagcttccaggttcccgatgcccgaactggtgcggacctccagagggaacgacaccctcattttccactgccggctgagccaggtaacatgtccaacttgtgctcgtatgtgctcagactatctatcggagatcgacgaggattctgcaataacaaacatcatgaccactggtaatcccgggtctacggtatgcttaggcttcaggagcagactggtatgcaggtggagctgatgttcattggaaacggacgcctccttaggaaaaccactccatatttctcctagggctccaaccaccaaagaatcggaagaactccgtttcccctggcggcgggtaactccacatggttaaaaattcttcacaaagatggcca

SEQ ID NO: 11939 - protein, 71 aa, Zea mays
  misc_feature: Ceres CLONE 1366351-F
  misc_feature: SWISSPROT Homolog: EC 3.1.3.48 Protein-tyrosine-phosphatase
MPELVRTSRGNDTLIFHCRLSQVTCPTCARMCSDYLSEIDEDSAITNIMTTGNPGSTVCLGFRSRLVCRWS

SEQ ID NO: 11940 - DNA, 686 bp, Zea mays
  misc_feature: Ceres CLONE 1366355-F
  misc_feature: Encodes the peptide sequence at SEQ ID NO. 11941
aaagctggagctccccgcggtggcggccgctctagaactagtggatcccccgggctgcaggaattcgcacgagaccattacctagaacatcctaatcgaaaaattcttcctcaacgcctaggccgcctgtatatcacatacactatggcgaaggctgtagctgagcttggtagcaacgatgctggcaagggcaccatctttttcacccaagagggagatggaccaaccgctgtcaccgtaattgcctatggactcaaccctggcctccatggactccatgatacatgcacttgtcgacaccaacaatgcatgcatgtcaactgaaccacactacaatcctgcgagcaaggatcatggactaccacaacatcacaaccgacatgctggtgatattgtaaactctaacgctgcattatacgatattgctaatatcaacgtcaccgacagccacatcccaatgactgagccaaactctagcataggcatagctgctgccgaccacgctcatcctgatgatcatgtaaagtacgtccacatagctcagcaagagcactgaagacgacgatgaccgtgcacgattgtgatatcataggactgcactgctgacaacatctacgtactcgcggatgcctgagaatgccgtctcctgtcgtccgcaatagactatcctgaacattcttatacat

SEQ ID NO: 11941 - protein, 95 aa, Zea mays
  misc_feature: Ceres CLONE 1366355-F
  misc_feature (1)..(86): Pfam Name: Sod_Cu Pfam Description: Copper/zinc superoxide dismutase (SODC)
  misc_feature: SWISSPROT Homolog: EC 1.15.1.1 Superoxide dismutase
MDSMIHALVDTNNACMSTEPHYNPASKDHGLPQHHNRHAGDIVNSNAALYDIANINVTDSHIPMTEPNSSIGIAAADHAHPDDHVKYVHIAQQEH

SEQ ID NO: 11942 - DNA, 685 bp, Zea mays
  misc_feature: Ceres CLONE 1366358-F
  misc_feature: Encodes the peptide sequence at SEQ ID NO. 11943
  misc_feature (352)..(352): n is a, c, t, g, unknown, or other
agagctggagctccccgcggtggcggccgctctagaactagtggatcccccgggctgcaggaattcgcacgagaccattacctagaacatcctaatcgaaaaacagactccagtctcctctagccgtctcgcgcgcttcaccttccccaccccgccgccgccatcgcacgcccgcagccgcatccgctatgggtgcgtacaagtacgtctcggagctatggcggaggaagcagtccgatgtgatgcggttcgtgcagcgcgtgcgctgctgggagtacaggcagcagccggccatcgtccgcctcacaaggcccactcgccctgacaaggcgcgccgcctcggctacaaggncaagcagggttatgttgtttaccgtgtccgtgttaggcgtggtggcagaaagaggcctgtgcctaaaggtattgtctatggcaagcccaaagcacagggtatcacccagctcaagttcagaagaacaagaagtctgttgctgaggaaagggctgaacaaaagctgggggaactcaggttcctcactctactgggggaatgagataccactaacaagccttgaaaaccttctggtgaggggcccacctccatcccaaaggatcaaggatcactggtattgaactggggccaaaccccgagattccgggttccccccccaagaaaaaattccggg

SEQ ID NO: 11943 - protein, 147 aa, Zea mays
  misc_feature: Ceres CLONE 1366358-F
  misc_feature (2)..(145): Pfam Name: Ribosomal_L15e Pfam Description: Ribosomal L15
  misc_feature (55)..(55): Xaa is any aa, unknown, or other
MGAYKYVSELWRRKQSDVMRFVQRVRCWEYRQQPAIVRLTRPTRPDKARRLGYKXKQGYVVYRVRVRRGGRKRPVPKGIVYGKPKAQGITQLKFRRTRSLLLRKGLNKSWGNSGSSLYWGNEIPLTSLENLLVRGPPPSQRIKDHWY

SEQ ID NO: 11944 - DNA, 725 bp, Zea mays
  misc_feature: Ceres CLONE 1366360-F
  misc_feature: Encodes the peptide sequence at SEQ ID NO. 11945
  misc_feature (437)..(437): n is a, c, t, g, unknown, or other
  misc_feature (438)..(438): n is a, c, t, g, unknown, or other
aagctggagctccccgcggtggcggccgctctagaactagtggatcccccgggctgcaggaattcgcacgagaccattacctagaacatcctaatcgaaaaaagttcctcagacgcaaagaagatcgagtctgcagcccacaccatagtgcgagcagattgcgtccaataggcgcaaagggagatgggggtggccgctggacgagcggcggccatggtggctgcggcggcggcggcggcggcggtgctgctgctgctcgcgggcggcgcgcacgcggactgctacgacgactgcttcaaggactgcatggccaggttcaagtccatgagagactactgcagctacgcgtgcgagaaggtctgcgatccggacgccacgcttcagcgccccctcgccgttgtggggccagcagcagcgttgggcgaccacccacccgnntggacagaagcatggtgctgtctgggcccggcgcgttgcccgaccatccttttcacaaaacgcacggtgacctctaagcgggaggggagcccgaacccagttaaggacggtgtcccgtcgggaaaggggccccgtcctccccctgaaaccccccgggaaagaaaggccgcgaatgttaaccccttcgccctgggcccccttttttaaaccctaaaacaaaggggggggtgggggcaaaagtaaaaaaatggccttacattttctcccgttttggaaaaaaaaaaaaa

SEQ ID NO: 11945 - protein, 153 aa, Zea mays
  misc_feature: Ceres CLONE 1366360-F
  misc_feature (85)..(85): Xaa is any aa, unknown, or other
MGVAAGRAAAMVAAAAAAAAVLLLLAGGAHADCYDDCFKDCMARFKSMRDYCSYACEKVCDPDATLQRPLAVVGPAAALGDHPPXWTEAWCCLGPARCPTILFTKRTVTSKREGSPNPVKDGVPSGKGPRPPPETPRERKAANVNPFALGPLF

SEQ ID NO: 11946 - DNA, 696 bp, Zea mays
  misc_feature: Ceres CLONE 1366364-F
  misc_feature: Encodes the peptide sequence at SEQ ID NO. 11947
agagctggagctccccgcggtggcggccgctctagaactagtggatcccccgggctgcaggaattcgcacgagaccattacctagaacatcctaatcgaaaaatcactgccaaatcccccagaaagtcaactcctccccaattccacgctgccaccaactcgccgtcctccgcgccaagcaccaaagctccgatggcccgcacgaagcagacggcgcgcaagtcaacgggcggcaaggcgccccgcaagcagctggcgaccaaggcggcgcgcaagtctgcgccggccaccggcggcgtgaagaaaccccaccgcttccgccccggaccgtcgcgctccgggagattcgtaagtacagaagtagcacgagctgctcatccgcaagtgccccttccaggcgctcgtcgtgagatcgcccaggacttcaagaacgatctccgtttccagccctcccgcgtccctggcctggaggagggcgcccagccctacctccggggttctttgaggaacctacctgggcgccttccaagcaaagcggggtccctttttgccaagagaatccctttgcggcccaaatcggggaaaaagggcctgagaaaggggaccccctcccccgaggggggcctttttggtctcccccccggggaaaaaagggcttcccgggtccccttgggggggggggggctctccccaatg

SEQ ID NO: 11947 - protein, 168 aa, Zea mays
  misc_feature: Ceres CLONE 1366364-F
MARTKQTARKSTGGKAPRKQLATKAARKSAPATGGVKKPHRFRPGPSRSGRFVSTEVARAAHPQVPLPGARREIAQDFKNDLRFQPSRVPGLEEGAQPYLRGSLRNLPGRLPSKAGSLFAKRIPLRPKSGKKGLRKGTPSPEGGLFGLPPGEKRASRVPLGGGGLSPM

SEQ ID NO: 11948 - DNA, 654 bp, Zea mays
  misc_feature: Ceres CLONE 1366365-F
  misc_feature: Encodes the peptide sequence at SEQ ID NO. 11949
aaagctggagctccccgcggtggcggccgctctagaactagtggatcccccgggctgcaggaattcgcacgagaccattacctagaacatcctaatcaaaaaaactacggtaactcgtctgctcgcatttcctcccaatccatcccgcctccaaacccgaactccaagtcgccccgcatcgatggcgcccaaggccgagaagaagcccgcggcgaagaagccggcggaggaggagcccgcggccgagaaggcgccggccgggaagaagcccaaggcggagaagcgtgtcccagcgggcaagtccgccggcaaggagggcggtgagggaaagaggggccggaagaagggcaagaagagcgtggagacttacaagatctacattttcaaggtgctgaagcaagtgcacccggacatcggcatttcctccaaggccatgtccatcatgaactccttcatcaacgacatcttcgagaagctcgctgccgaggccgccaagctcgcgcggtacaacaagaggcccacatcacctcccgcgagatcagacttcgtgcgcctcgtcctccccgggagctcgcaagcacgccgtcttcgagggcaccaggccggcaccaagtcacctcctcctaggtgggcaacctccggtggaggcttccc

SEQ ID NO: 11949 - protein, 157 aa, Zea mays
  misc_feature: Ceres CLONE 1366365-F
  misc_feature (57)..(137): Pfam Name: Histone Pfam Description: Core histone H2A/H2B/H3/H4
MAPKAEKKPAAKKPAEEEPAAEKAPAGKKPKAEKRVPAGKSAGKEGGEGKRGRKKGKKSVETYKIYIFKVLKQVHPDIGISSKAMSIMNSFINDIFEKLAAEAAKLARYNKRPTSPPARSDFVRLVLPGSSQARRLRGHQAGTKSPPPRWATSGGGF

SEQ ID NO: 11950 - DNA, 691 bp, Zea mays
  misc_feature: Ceres CLONE 1366367-F
  misc_feature: Encodes the peptide sequence at SEQ ID NO. 11951
aaagctggagctccccgcggtggcggccgctctagaactagtggatcccccgggctgcaggaattcgcacgagaccattacctagaacatcctaatcgaaaagaggtcgtccgtcggattcggaggctcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaacggcgagccagggcctgcgcagaacgtcgacaagtccaccagcctggcccggaaagtgttccggctctgtaagttcgtcaacgatctgcacgctttgatcagccctccctgcaaggggactccgctcccgctgatcctactccggaagtccagaacgcgatgctgtcgactttcctcttccctgacaaatcgtgtgggcggggaggacaggatatacaagaacaggagcgggcggagtttctcggaagaaaaggttttactgtttcccgggttccaaacctggagggcattttgagattaaccgattgaacggtgttccccttaataaaaaacttgaaaaagggcttaaaaccccaaggtttacaaaaaacggcaatccccttgtaatttccaaaataaaaaaaggggttgtg

SEQ ID NO: 11951 - protein, 137 aa, Zea mays
  misc_feature: Ceres CLONE 1366367-F
  misc_feature (11)..(134): Pfam Name: PEX11 Pfam Description: Peroxisomal biogenesis factor 11 (PEX11)
MASLDAVRGDLALLILYLNKAEARDKICRAIQYGSKFISNGEPGPAQNVDKSTSLARKVFRLCKFVNDLHALISPPCKGTPLPLILLRKSRTRCCRLSSSLTNRVGGEDRIYKNRSGRSFSEEKVLLFPGFQTWRAF

SEQ ID NO: 11952 - DNA, 704 bp, Zea mays
  misc_feature: Ceres CLONE 1367609-F
  misc_feature: Encodes the peptide sequence at SEQ ID NO. 11953
  misc_feature (392)..(392): n is a, c, t, g, unknown, or other
  misc_feature (425)..(425): n is a, c, t, g, unknown, or other
tggagctccccgcggtggcggccgctctagaactagtggatcccccgggctgcaggaattcgcacgagaccattacctagaacatcctaatcgaaaaagccttccccgtctctcctcttctgccgaacgagacagaccgggttatgtagcctgcctcgctttcggcgagagaggaagaggcggaggagatcagggcaatgggcggggcggaggcgctgggccagccggacggccatgcgaacggggccgtggtggaggagaagctggacttgctgcggcggcagctggggaaggcggacggcgacccgctccggatcgtcggcgtcggggcgggcgcctggggtagcgtcttctgcgcgctgctgcaggacgcgtacggccacctccgcgancaggcgcaggtccgcatctggccgcgcccgggncgaggcgtcgaaccgggccaccgccgaggacctcttcgacggcatcaacgcgggggaggacgtccttgggccgctggatcggccctgggcctaccccaagaaagtcaaggggggggccccgggacccggcggttttaccccgaagaaaaacccgggggaggttttctggccacaaaatgaaaaaacacgccctttttgcccccccaaggggcgcccccccccttgaaggaggccccctgggggcccttttaattttggttaaaggggcgcgcctccccc

SEQ ID NO: 11953 - protein, 135 aa, Zea mays
  misc_feature: Ceres CLONE 1367609-F
  misc_feature (65)..(65): Xaa is any aa, unknown, or other
MGGAEALGQPDGHANGAVVEEKLDLLRRQLGKADGDPLRIVGVGAGAWGSVFCALLQDAYGHLRXQAQVRIWPRPGRGVEPGHRRGPLRRHQRGGGRPWAAGSALGLPQESQGGGPGTRRFYPEEKPGGGFLATK

SEQ ID NO: 11954 - DNA, 672 bp, Zea mays
  misc_feature: Ceres CLONE 1367628-F
  misc_feature: Encodes the peptide sequence at SEQ ID NO. 11955
  misc_feature (404)..(404): n is a, c, t, g, unknown, or other
aaagctggagctccccgcggtggcggccgctctagaactagtggatcccccgggctgcaggaattcgcacgagaccattacctagaacatcctaatcgaaaactctagccaaaaccctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcagctcgtgatgaagaagtcaagtgctcatgacggacttgtgaagggtctccgtgaggctgccaaggccatcgagaagcacgccgctcagctttgcgtgcttgctgaggactgtgaccagccagattacgtncagctggtgaaggcactctgcgctgagcacaatggtcacctggtcactggtcctgcccgcgagactcttggcgagtgggccgggctttgcagattgactcttgaggcaaggcaagaaaggtgtaagcctgctccggggccctcgccaggactacggggaagaattgagggcctaactaaggcaggagatggcaggcccctaaatggggaacggttcaggagacctttgattggcccgggctaaaataggctttgcctccgggttgcca

SEQ ID NO: 11955 - protein, 151 aa, Zea mays
  misc_feature: Ceres CLONE 1367628-F
  misc_feature (25)..(117): Pfam Name: Ribosomal_L7Ae Pfam Description: Ribosomal protein L7Ae/L30e/S12e/Gadd45 family
MAEQEAPVVVEAPTPVLGEPMDLMTALQLVMKKSSAHDGLVKGLREAAKAIEKHAAQLCVLAEDCDQPDYVQLVKALCAEHNGHLVTGPARETLGEWAGLCRLTLEARQERCKPAPGPSPGLRGRIEGLTKAGDGRPLNGERFRRPLIGPG

SEQ ID NO: 11956 - DNA, 689 bp, Zea mays
  misc_feature: Ceres CLONE 1367643-F
  misc_feature: Encodes the peptide sequence at SEQ ID NO. 11957
  misc_feature (481)..(481): n is a, c, t, g, unknown, or other
  misc_feature (529)..(529): n is a, c, t, g, unknown, or other
  misc_feature (531)..(531): n is a, c, t, g, unknown, or other
  misc_feature (532)..(532): n is a, c, t, g, unknown, or other
  misc_feature (574)..(574): n is a, c, t, g, unknown, or other
  misc_feature (645)..(645): n is a, c, t, g, unknown, or other
  misc_feature (647)..(647): n is a, c, t, g, unknown, or other
  misc_feature (651)..(651): n is a, c, t, g, unknown, or other
caaagctggagctcaccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcngcagctcttccatcctgagcagctcatcagtggcaagggagatgcagncnnacacttcgctcgtggtcactacaccattgggcaagagattgntgacctgtgccttgaccgcatccagaagcttgcagataattgcactgggctccaggcttcctcggctcaangnttgntgggggaggacgggctctgggctgggtcctccctttgg

SEQ ID NO: 11957 - protein, 153 aa, Zea mays
  misc_feature: Ceres CLONE 1367643-F
  misc_feature (49)..(151): Pfam Name: Tubulin Pfam Description: Tubulin/FtsZ family, GTPase domain
  misc_feature (84)..(84): Xaa is any aa, unknown, or other
  misc_feature (100)..(100): Xaa is any aa, unknown, or other
  misc_feature (101)..(101): Xaa is any aa, unknown, or other
  misc_feature (115)..(115): Xaa is any aa, unknown, or other
  misc_feature (139)..(139): Xaa is any aa, unknown, or other
  misc_feature (141)..(141): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYXQLFHPEQLISGKGDAXXHFARGHYTIGQEIXDLCLDRIQKLADNCTGLQASSAQXLXGEDGLWAGSSLW

SEQ ID NO: 11958 - DNA, 678 bp, Zea mays
  misc_feature: Ceres CLONE 1367646-F
  misc_feature: Encodes the peptide sequence at SEQ ID NO. 11959
  misc_feature (371)..(371): n is a, c, t, g, unknown, or other
  misc_feature (459)..(459): n is a, c, t, g, unknown, or other
  misc_feature (496)..(496): n is a, c, t, g, unknown, or other
  misc_feature (506)..(506): n is a, c, t, g, unknown, or other
  misc_feature (513)..(513): n is a, c, t, g, unknown, or other
aaagctggagctccccgcggtggcggccgctctagaactagtggatcccccgggctgcaggaattcgcacgagaccattacctagaacatcctaatcgaaaacatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgatgccgccnagacatggatggcgattcctgctccaaagcgaggagagatcgttaggcaaatcggtgatgcactgagagcaaagctccatcacctggncagggcttgtgtcacttgagatggggaaaatcttccntgaaggatcngtgaggntcaggaaatcatcaactggggggatatgctggggggctaagccgcaactaatggatcatttatccctccggacggccaaccctttggtggtggggggggggaaccccctgggagttgggggggtaaaacggatttaaattcccctggggggggggtggggggagg

SEQ ID NO: 11959 - protein, 105 aa, Zea mays
  misc_feature: Ceres CLONE 1367646-F
  misc_feature: SWISSPROT Homolog: EC 1.2.1.3 Aldehyde dehydrogenase (NAD(+))
  misc_feature (71)..(71): Xaa is any aa, unknown, or other
  misc_feature (100)..(100): Xaa is any aa, unknown, or other
MGAFAKEEHQFLAELGLAQRNPGAFACGAWGGSGPTVTSTSPTNNQVIAEVVEASVHDYEEGMRACFDAAXTWMAIPAPKRGEIVRQIGDALRAKLHHLXRACVT

SEQ ID NO: 11960 - DNA, 688 bp, Zea mays
  misc_feature: Ceres CLONE 1367658-F
  misc_feature: Encodes the peptide sequence at SEQ ID NO. 11961
tggagctccccgcggtggcggccgctctagaactagtggatcccccgggctgcaggaattcgcacgagaccattacctagaacatcctaatcaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttggccgtatgcgtcaagacgtacccgctaacttgctcgtgctttgatcgggttgagcgctgctccgacgcctgtaaggagtgcgtggaaacggaggactcgcgccacgtctgcgtcgacaggtaccgtggcgaccccgggcccaggtgccacgacgaggacgggaggagcggcggacccgctgacgacgacgctggtgggcaagcgacgccgacggcagtgatggcagatgacaagaaagcaggcggcggcgacgacgacaagaagaagaggccgtggaaatgctgcgacgtgcccatc

SEQ ID NO: 11961 - protein, 169 aa, Zea mays
  misc_feature: Ceres CLONE 1367658-F
MAMGAASILLMMVSLEALLLAAAAGGGTIRLPSDVGGVAADLVTAMARARARAKHQLRDEERPWGECCDLAVCVKTYPLTCSCFDRVERCSDACKECVETEDSRHVCVDRYRGDPGPRCHDEDGRSGGPADDDAGGQATPTAVMADDKKAGGGDDDKKKRPWKCCDVPI

SEQ ID NO: 11962 - DNA, 710 bp, Zea mays
  misc_feature: Ceres CLONE 1367679-F
  misc_feature: Encodes the peptide sequence at SEQ ID NO. 11963
tggagctcaccgcggtggcggccgctctagaactagtggatcccccgggctgcaggaattcgcacgagaccattacctagaacatcctaatcgaaaaatcttttccgtcgcccatggtgaacgagccaccaccggagctgtagtttgccaaggacttcgctgctggtacgtccccgtcgtaccaaactgtggctgatcgccacacgccgaccccgccctctgctggatcctacggcaacctccgccaagaaaataaaactcgatttgcgacgctgacctccagtactggatggatgaaaagtacctacatatctgcttcgggaccagcgccgacttggttacaataaaagttatcgctgataggcataaacgagagcgagacgggtatggatctgatgagttcttctctcatgcatcagaacatcaaagctcttcatgattttactggtcattgggaatgcaaatactgaccggccattttaaattgaacggcgcatctcatagcatgtgcgaaaaacgatctgaactggatgctgatcaccccgaaattggatggccaactagttgccgaaccaactgaacaaagctgggggaaagtttcccccaaaaccccgcttttggaaggactaaagttttattgatcaaacccgggccgttcaaaggaataagaattgcagggttggaacgaaaaccccattttatggttgggg

SEQ ID NO: 11963 - protein, 49 aa, Zea mays
  misc_feature: Ceres CLONE 1367679-F
MDEKYLHICFGTSADLVTIKVIADRHKRERDGYGSDEFFSHASEHQSSS

SEQ ID NO: 11964 - DNA, 622 bp, Zea mays
  misc_feature: Ceres CLONE 1367696-F
  misc_feature: Encodes the peptide sequence at SEQ ID NO. 11965
  misc_feature (336)..(336): n is a, c, t, g, unknown, or other
  misc_feature (346)..(346): n is a, c, t, g, unknown, or other
  misc_feature (347)..(347): n is a, c, t, g, unknown, or other
  misc_feature (360)..(360): n is a, c, t, g, unknown, or other
  misc_feature (367)..(367): n is a, c, t, g, unknown, or other
  misc_feature (472)..(472): n is a, c, t, g, unknown, or other
  misc_feature (492)..(492): n is a, c, t, g, unknown, or other
aaagctggagctccccgcggtggcggccgctctagaactagtggatcccccgggctgcaggaattcgcacgagaccattacctagaacatcctaatcgaaaatttctctcaatctctctcttctcctcgcctcgccttggtgttcacgccgtcgctagcgcctgccgcggcgaagcttctgtcctccccggcgccgggctcgggtcgtcgtcggccaggaagatggctggcggcttcagggtactgcatctggtcaggccttttctggctttcttgccagaggtgcagagcgcggataggaagatacctttcagagaaaaaagtatatacactggntattcccctnnctcatttcctggnctgcagncagcttccactctatggcattcattcaacaactggagctgatcctttctactgggatggcgtgttatcctcgcatcaaccgtgcactggaatgggagaattgggnaattactcccattgtgaatncttgggatgggtatgggcacttcctgtgggatcagaaaacatttgtgaattgacacagtggagaaaaagggaccgggtcttgctgaaggggcacaaaaaatggcttggaatcctgattgtattgggggga

SEQ ID NO: 11965 - protein, 61 aa, Zea mays
  misc_feature: Ceres CLONE 1367696-F
  misc_feature (42)..(42): Xaa is any aa, unknown, or other
  misc_feature (49)..(49): Xaa is any aa, unknown, or other
MAGGFRVLHLVRPFLAFLPEVQSADRKIPFREKSIYTGYSPXSFPGLQXASTLWHSFNNWS

SEQ ID NO: 11966 - DNA, 695 bp, Zea mays
  misc_feature: Ceres CLONE 1367705-F
  misc_feature: Encodes the peptide sequence at SEQ ID NO. 11967
  misc_feature (396)..(396): n is a, c, t, g, unknown, or other
aaagctggagctccccgcggtggcggccgctctagaactagtggatcccccgggctgcaggaattcgcacgagaccattacctagaacatcctaatcgaaaaaatcaccaccactgggtcttcataccattacctttatctactccagagcgaacaacaacccgatcgacaccatgagggtgatgctcgctgccctcgctctcctggctctcgctgcgagcgccacctccacgcatactagcggcggatgcggctggcagccaccgccgtcggttcatctaccgccgcaggagcatctgccaccgtcggtcacatgccactgcggtgcatatcccactgccggtccactgggcgcgacggtctactgccaccagctgtcatgtgcagacgcagttngtctgctcgtcgcacatggcactccctagtaaacgcccgggcttgcctcatccctagccacctatgccggggcacatgcgatccatgccagggcaggtgtaggaacctggcggtttggtaaccccgatctggcacagggggaaatttctgagggaatgtgggcccgaggtaaacctaaggtgtggaaagggcggtttttgaaaaagggttcccttttttttggggggggcggggccccggccacaaaattttgggaggttttccaaaaataggaaaccccaaaaggggggggggggggt

SEQ ID NO: 11967 - protein, 83 aa, Zea mays
  misc_feature: Ceres CLONE 1367705-F
  misc_feature (75)..(75): Xaa is any aa, unknown, or other
MRVMLAALALLALAASATSTHTSGGCGWQPPPSVHLPPQEHLPPSVTCHCGAYPTAGPLGATVYCHQLSCADAVXLLVAHGTP

SEQ ID NO: 11968 - DNA, 661 bp, Zea mays
  misc_feature: Ceres CLONE 1367713-F
  misc_feature: Translation starting site: 155
  misc_feature: Pfam Name: DUF1264 Pfam Description: Protein of unknown function (DUF1264)
  misc_feature (447)..(447): n is a, c, t, g, unknown, or other
  misc_feature (540)..(540): n is a, c, t, g, unknown, or other
aagctggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcngtctcatcggcgtggagtacatcgtggtcgaggaagatcttcgactcgctgccggcggaggagcagcggctgtggcactcgcacgcgcacagnatcaagtcaggcctgtggacgagccgccacgtggcggggctgctggagaaggcggagctggacccatggccgcaccgttcggcaagttctggggcaccctggcaggtggaccgcggcgccg

SEQ ID NO: 11969 - DNA, 654 bp, Zea mays
  misc_feature: Ceres CLONE 1367733-F
  misc_feature: Encodes the peptide sequence at SEQ ID NO. 11970
  misc_feature (405)..(405): n is a, c, t, g, unknown, or other
  misc_feature (444)..(444): n is a, c, t, g, unknown, or other
  misc_feature (447)..(447): n is a, c, t, g, unknown, or other
  misc_feature (454)..(454): n is a, c, t, g, unknown, or other
  misc_feature (470)..(470): n is a, c, t, g, unknown, or other
  misc_feature (493)..(493): n is a, c, t, g, unknown, or other
  misc_feature (523)..(523): n is a, c, t, g, unknown, or other
  misc_feature (540)..(540): n is a, c, t, g, unknown, or other
  misc_feature (606)..(606): n is a, c, t, g, unknown, or other
  misc_feature (607)..(607): n is a, c, t, g, unknown, or other
tggagctccccgcggtggcggccgctctagaactagtggatcccccgggctgcaggaattcgcacgagaccattacctacaacatcctaatcgaaaaaacaaagaaagtcgcggcggagcaatgtgctgcaacgcgaaggtctcgccactgccggttgagatggacacctccgcctccaaagtgctcaccaacgacgatctccttcacgacatccttctccgcctaggatgcccgagctgcctcgtcagtgccgcgctcaccagcaagtgctggctgcgtggcgcctccgatcaggtcttcgcgcgcgacttctgcgcggaccaccagccgcgcctacttgggatctacgtctccagcagcggcatctctgggtcggagttcatcccattcaggcaacctgctgntggctctaggccggaggtgagtactgtcctcaaccatgnccngattcgntttggcgacctgccgncgccgagcgtttgggactgccgnaacggcatggtcctcttcccaggtcgtggncgagactttaacccggntggtctcgctgcgcgttccccgctgctggatcctacatgcaccaaaaggtgggtgctcccgccgtnnccgaaaccgtctaaatttcccggagaccctcacgggaggttcctcca

SEQ ID NO: 11970 - protein, 177 aa, Zea mays
  misc_feature: Ceres CLONE 1367733-F
  misc_feature (95)..(95): Xaa is any aa, unknown, or other
  misc_feature (108)..(108): Xaa is any aa, unknown, or other
  misc_feature (109)..(109): Xaa is any aa, unknown, or other
  misc_feature (117)..(117): Xaa is any aa, unknown, or other
  misc_feature (140)..(140): Xaa is any aa, unknown, or other
  misc_feature (162)..(162): Xaa is any aa, unknown, or other
MCCNAKVSPLPVEMDTSASKVLTNDDLLHDILLRLGCPSCLVSAALTSKCWLRGASDQVFARDFCADHQPRLLGIYVSSSGISGSEFIPFRQPAXGSRPEVSTVLNHXXIRFGDLPXPSVWDCRNGMVLFPGRGRDFNPXGLAARSPLLDPTCTKRWVLPPXPKPSKFPGDPHGRFL

SEQ ID NO: 11971 - DNA, 614 bp, Zea mays
  misc_feature: Ceres CLONE 1367734-R
  misc_feature: Pfam Name: Adenine_glyco Pfam Description: Methyladenine glycosylase
tcgaggtcgacggtatcgataagcttttttttttttttttttaaagagttaatagaagtattacatttacatcataacttaccatacaaactctatacaatttcacacacaatcccaccgaacatttctggagctggagcagtctcaaataagatctaaatttcaaaccttttaatagtgcagatttaatttccccttttttaatatggaaaaaaaaagaagcggcttgctgctgttgcagaaggccgaagccacttgcatgcagtcctattagttcagtactacttttcattggcaaagagttaatagaagtattacatcataacttagtagagtacatactctacgtaatttcacacacaattccgatctccaaacaaaaaaacaataacaacacccagaagaaggtgtgaaaaacttggagaggcatgcatgcacagatattgaggggccggctggctacgcctacgcggcgacgttggtgatgccccaggagcgctcggcgaggcggacgcagtcgtgcaaacggaagcagtcgacgaggtggtcgatggccatgccggcggcctgcatgaaagagtagacgatgacggggccgacgaggcggaagcccc

SEQ ID NO: 11972 - DNA, 627 bp, Zea mays
  misc_feature: Ceres CLONE 1367734-F
  misc_feature: Encodes the peptide sequence at SEQ ID NO. 11973
  misc_feature (319)..(319): n is a, c, t, g, unknown, or other
  misc_feature (418)..(418): n is a, c, t, g, unknown, or other
  misc_feature (456)..(456): n is a, c, t, g, unknown, or other
  misc_feature (576)..(576): n is a, c, t, g, unknown, or other
aagctggagctccccgcggtggcggccgctctagaactagtggatcccccgggctgcaggaattcgcacgagaccattacctagaacatcctaatcgaaaaattccgagctctcttcattggatcatagataggtagctcgcctcccaaaaacactctgccctcgtgcgtgtgaggagcacggacacgatgatcagcacagcgcacagacggcagcagcaccatgtcttcgagaagagccctgtctacagccacatgaagagcatcgatcggaagctgcatcacgacatgagccagtgcgctcagcagtacatgcatangatctaccctctaggcatgcagaggagcagctccagcctcacattgtcatcagctctggctgtcgcaagactccaacgactcctccatcagtagatccnactctcgtgtgaacccaagggggccgttggttctacgncgggtactttcgccagtggggggacctaatgatgtcttcggaagactaagctggcaaggaccatgacaagcgtcattgccatgacccccaaagggggttaaagagggacttggacctganggagaacagggagcccttgggaaactgggaacctggattccaagaaaagtg

SEQ ID NO: 11973 - protein, 74 aa, Zea mays
  misc_feature: Ceres CLONE 1367734-F
  misc_feature (44)..(44): Xaa is any aa, unknown, or other
MISTAHRRQQHHVFEKSPVYSHMKSIDRKLHHDMSQCAQQYMHXIYPLGMQRSSSSLTLSSALAVARLQRLLHQ

SEQ ID NO: 11974 - DNA, 799 bp, Zea mays
  misc_feature: Ceres CLONE 1367735-R
tcgaggtcgacggtatcgataagctttttttttttttttttttgggttaactggcatcttcaaattatgatggttcagagtgtactgcttcttactatatattccatcaaatgtgtaatggctggcaatgaagctggagacgcaaaagcctaacgtctctccctaattagatagagcaatgttgaaccacaaagaaaagcacggttgcagtggcgtccacgaaacaactcgggatgagcattgccatgtcttccggttggacggttcctgtccagatgccccagtgccgtcgcgcctccacggtaagagggtaagtcccaatccctgcggccgggggggagttttggggggtggggacgaaaccgaagaatgcgtagtaaggatagggtggttgtgggccccccggatatcactgtgtacggtaggggtgcctaattcattttgaatctcataaacccgcatttctctcgggccgcacggggcttcctcgagataatcccataattgggggttgaaaaatattacccactgctatccttgggtggggggtgcgccacgtctcagcgatccctgcctctcttggatggtaccgattggagagggcgtgtgtcctccacctgctaggacccctcttgcgggagaaacctagtcatacagtctgccgtagccaatagttttcgccggcgggggggcacccagtccacagctcttattgaatagacttgtaatagtgggcccaagagagatcgagccgtgtccgtaagatcagaaactatattcaggggtcgcggcctccttc

SEQ ID NO: 11975 - DNA, 1017 bp, Zea mays
  misc_feature: Ceres CLONE 1367735-R2
  misc_feature (1017)..(1017): n is a, c, t, g, unknown, or other
tggggacgaggccccccctcgaggtcgacggtatcgataagcttttttttttttttttttggggttaactggcatcttcaaattatgatggttcaaaatgtactgtttcttacgatatattccatcaaatgtgttatggctggcaatgaaactgggagacgcaaaagcctagcgtctctccctaatttaatagaggaatgttaaaacaaaaaaaaaaacacggttgcagtcggctccaccaaaaaaatccgagataaaaattccccattttcttttcagcttgagaccccttcctgtccatatttcccaattgaattccccccctaagggttccaggggaaatgtccatacttgcttccagggggaactttcccttttttacgtccggaaccattttaaaattaataattgccccgcctttcttttaaaaaaatggaaacccaatttgttttttaaaataccttgagttttctccgccaaagcaaaaaagggggggcgtccaaaaaataaaaagcaacaaaattccgttttctgtcaaaaggacatctccccccctcccctaatgatcaaattgttctcaaccccccccaaactaaaaaccgcaaaaccacttttaatgtttttacggcctaaaagaacaaaaatttcaccccgaatttttgttttcctccccaccccctgcaaaaaaagaagacactttataatccccgctgtgacagaatatctcttttctaaaaaattttttttaaacaatgaatccccaccagcgcgtctgtggtgggaaaattctttagccgcccttatcatacccgtggagagggggcttttatatttatatatgagccctgaaaactctgtgaaggataaacttattatttctctaccccggtgtgcgccacaatattgtcgtttgtttttaaatagtgaatttaaatcccgcttctttctatttttccccaaaataaatatgttttaactcttccacacgaatatactcagcatttattcttagaaagn

SEQ ID NO: 11976 - DNA, 647 bp, Zea mays
  misc_feature: Ceres CLONE 1367754-F
  misc_feature: Encodes the peptide sequence at SEQ ID NO. 11977
  misc_feature (539)..(539): n is a, c, t, g, unknown, or other
  misc_feature (580)..(580): n is a, c, t, g, unknown, or other
tggagctccccgcggtggcggccgctctagaactagtggatcccccgggctgcaggaattcgcacgagaccattacctagaacatcataatcgaaaactgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggccatgaggtcttgctgtttgaagctcttcgtgaggccttgatggaagagatggaattagatccaacagtgtgtgtatttggtgaagatgttggccattacggtggttcttacaaggtgacaaaaggtttggctgatacgtttggagaaccttcgagttctggacacccctattgcggagaactcgtttactggcatgggaagtggagcgggatgaaaaggctgaggncccgtcgttgaagcatgaacatgggattcctgctccttgcnttacacagatctcaaaaaactgtggcatgctcattacactccccggcgccagtcaaatcccacttgg

SEQ ID NO: 11977 - protein, 138 aa, Zea mays
  misc_feature: Ceres CLONE 1367754-F
  misc_feature (80)..(109): SWISSPROT Homolog: EC 1.2.4.1 Pyruvate dehydrogenase (acetyl-transferring)
  misc_feature (80)..(126): SWISSPROT Homolog: EC 1.2.4.4 3-methyl-2-oxobutanoate dehydrogenase (2-methylpropanoyl-transferring)
  misc_feature (136)..(136): Xaa is any aa, unknown, or other
MATAFSLRAAAPATAPRAVSRSTSAARVVPVASALAGRGRLVARAAVTAKADVPSSTSDGHEVLLFEALREALMEEMELDPTVCVFGEDVGHYGGSYKVTKGLADTFGEPSSSGHPYCGELVYWHGKWSGMKRLRXRR

SEQ ID NO: 11978 - DNA, 664 bp, Zea mays
  misc_feature: Ceres CLONE 1367764-F
  misc_feature: Encodes the peptide sequence at SEQ ID NO. 11979
  misc_feature (328)..(328): n is a, c, t, g, unknown, or other
  misc_feature (353)..(353): n is a, c, t, g, unknown, or other
  misc_feature (354)..(354): n is a, c, t, g, unknown, or other
  misc_feature (432)..(432): n is a, c, t, g, unknown, or other
  misc_feature (435)..(435): n is a, c, t, g, unknown, or other
  misc_feature (458)..(458): n is a, c, t, g, unknown, or other
  misc_feature (467)..(467): n is a, c, t, g, unknown, or other
  misc_feature (468)..(468): n is a, c, t, g, unknown, or other
  misc_feature (470)..(470): n is a, c, t, g, unknown, or other
  misc_feature (494)..(494): n is a, c, t, g, unknown, or other
  misc_feature (495)..(495): n is a, c, t, g, unknown, or other
aagctggagctccccgcggtggcggccgctctagaactagtggatcccccgggctgcaggaattcgcacgagaccattacctagaacatcctaatcgaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtccctcgagtcaagatcatcctcgatcnggagacgcagaggtcccgcgggttnncgcttcgtcaccttctccacggagggaggcgatgcggaccgccatcgagggcatgaacggggcaggagcttgggacgncgnaacatcacggtcaacgaggccantcccggggnngnccggggaggcggccggcgcccccnnttacgggggggcccggggagggggggtttacggggggggggggcccctgaagggggggcggtttagggggggggggggggtataggggggggggggggggggatagggggggggggggggggggttaacggggggggaaaggggggggggtataagaaacttccgggga

SEQ ID NO: 11979 - protein, 69 aa, Zea mays
  misc_feature: Ceres CLONE 1367764-F
  misc_feature: SWISSPROT Homolog: EC 5.2.1.8 Peptidylprolyl isomerase
  misc_feature (43)..(43): Xaa is any aa, unknown, or other
  misc_feature (51)..(51): Xaa is any aa, unknown, or other
  misc_feature (52)..(52): Xaa is any aa, unknown, or other
MAASDVEYRCFVGGLAWATDDHSLHNAFSTYGEVPRVKIILDXETQRSRGXXLRHLLHGGRRCGPPSRA

SEQ ID NO: 11980 - DNA, 662 bp, Zea mays
  misc_feature: Ceres CLONE 1367794-F
  misc_feature: Encodes the peptide sequence at SEQ ID NO. 11981
  misc_feature (339)..(339): n is a, c, t, g, unknown, or other
  misc_feature (347)..(347): n is a, c, t, g, unknown, or other
  misc_feature (450)..(450): n is a, c, t, g, unknown, or other
  misc_feature (451)..(451): n is a, c, t, g, unknown, or other
  misc_feature (496)..(496): n is a, c, t, g, unknown, or other
  misc_feature (526)..(526): n is a, c, t, g, unknown, or other
  misc_feature (527)..(527): n is a, c, t, g, unknown, or other
  misc_feature (579)..(579): n is a, c, t, g, unknown, or other
  misc_feature (607)..(607): n is a, c, t, g, unknown, or other
  misc_feature (632)..(632): n is a, c, t, g, unknown, or other
aaagctggagctccccgcggtggcggccgctctagaactagtggatcccccgggctgcaggaattcgcacgagaccattacctagaacatcctaatcgaaaacttcccttctgtcgctgctcccacctctagcccgacaggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacnagatttgnttgtgcgatttaccaacaaggacatcacagcacaaatcatctctgctagtatagcaggtggatatggttcttgcttctgcttactcgcatgagttgcacgaanngggtcttgaagttggtctgaccaactatgcagctgcctactgccntgggccttctgttgggctcgccgtgtgtcnnaggaacccgtggtttagataaggaatatgagggcaatgttgaggccactggntgagggatttctctgttgagccagctgnatgagaggaaggcctttccgggtcntccctgggatggtggccttattaggactaa

SEQ ID NO: 11981 - protein, 70 aa, Zea mays
  misc_feature: Ceres CLONE 1367794-F
  misc_feature (51)..(51): Xaa is any aa, unknown, or other
  misc_feature (53)..(53): Xaa is any aa, unknown, or other
MGGFVKTHKSNAYFKRFQVKFKRRRAGKTDYRARIRLINQDKNKYNTPKYXIXLCDLPTRTSQHKSSLLV

SEQ ID NO: 11982 - DNA, 657 bp, Zea mays
  misc_feature: Ceres CLONE 1367824-F
  misc_feature: Translation starting site: 197
  misc_feature: Pfam Name: ECH Pfam Description: Enoyl-CoA hydratase/isomerase family
  misc_feature (408)..(408): n is a, c, t, g, unknown, or other
  misc_feature (621)..(621): n is a, c, t, g, unknown, or other
  misc_feature (657)..(657): n is a, c, t, g, unknown, or other
tggagctccccgcggtggcggccgctctagaactagtggatcccccgggctgcaggaattcgcacgagaccattacctagaacatcctaatcgaaaaaagtagcttgccagcacccaactccaagcaagccataactgcaagaaagcaacggcagcaagaaaccttgtaaacatcggagcatagatcgcggcggtgatggcggccaaggggaggacggagctggacgtgggcgccgacggcgtggccgtaatcaccatctacaatccgcccgtcaactcgctctccatcgacgtcttacatagcttaaaagaaagctatgaagaagcacttcggagaaacgatgttaaagctattgtcgttacagggaaaggagggaaaattttctggaggatttgatattagttccnttttggtgggtgttcaaggaggccaaacaatgcaaaccaaaggttggctacatagcaatagatattctcacagatactgtagaagctgcgacaaagccatcagtggcagcaattgatgtcttgccctttggggagggggttttaaaagtggccatggcatgcaagtgcacggattgcaactccacaggctcaattaggtcttccagaacttcnggttaggaattatcccagggatttggaggacacagn

SEQ ID NO: 11983 - DNA, 645 bp, Zea mays
  misc_feature: Ceres CLONE 1367832-F
  misc_feature: Encodes the peptide sequence at SEQ ID NO. 11984
  misc_feature (369)..(369): n is a, c, t, g, unknown, or other
  misc_feature (370)..(370): n is a, c, t, g, unknown, or other
  misc_feature (379)..(379): n is a, c, t, g, unknown, or other
  misc_feature (386)..(386): n is a, c, t, g, unknown, or other
  misc_feature (464)..(464): n is a, c, t, g, unknown, or other
  misc_feature (551)..(551): n is a, c, t, g, unknown, or other
  misc_feature (595)..(595): n is a, c, t, g, unknown, or other
ggagctccccgcggtggcggccgctctagaactagtggatcccccgggctgcaggaattcgcacgagaccattacctagaacatcctaatcgaaaaaggagacttggcttgtactgcatcgcaaaccgcaatcgcacgcggcacttgccccccgcgatcataacctcaccgcccgccaccagctgcagccacaagcgcagcgctcgacagcctcaccagccgccatcactcgcggcagtacccggccgctgggactgcaagagtggggagtgagacgctgctgctgttgccgagcgcgaggagacactactactcactcaagagtcaagactcaacagcagcaggggcgaccgagctctgcgtgcgtgnngagaacganaaggcancccagaggagggaggggagggagcgcgtgaaccaagctaggcgcagcagcatgggcgccgggatcaggttcctggcgncgctcttgggcgcgctcgcggcagccacccgccgcgtgacggcgcagctgcggcaggactactacgcggcggtgtgcccggacctgnagagcatcgggcgcgccgcggtgtccaagaaagtgcaggcgcanccccgtcgccgtgggcgccacatcccgcctctcttcacgacgggctcgtc

SEQ ID NO: 11984 - protein, 69 aa, Zea mays
  misc_feature: Ceres CLONE 1367832-F
  misc_feature (10)..(10): Xaa is any aa, unknown, or other
  misc_feature (39)..(39): Xaa is any aa, unknown, or other
  misc_feature (53)..(53): Xaa is any aa, unknown, or other
MGAGIRFLAXLLGALAAATRRVTAQLRQDYYAAVCPDLXSIGRAAVSKKVQAXPRRRGRHIPPLFTTGS

SEQ ID NO: 11985 - DNA, 664 bp, Zea mays
  misc_feature: Ceres CLONE 1367836-F
  misc_feature: Encodes the peptide sequence at SEQ ID NO. 11986
  misc_feature (347)..(347): n is a, c, t, g, unknown, or other
  misc_feature (571)..(571): n is a, c, t, g, unknown, or other
aaagctggagctccccgcggtggcggccgctctagaactagtggatcccccgggctgcaggaattcgcacgagaccattacctagaacatcctaatcgaaaaatggaatcctgtagcttccgtgccgcaaccgcgccttctccctttccctccgctccttcttcatcttcatccccgcgcgccccatgccccatactccgatttcccaggccaagaaaagggaggcagattggggtgcggaggagggcgtccggatttgatgccttcgcgtctttcgccggcaaggtcttcgtggatgaggcgattggagcggaatatggggagggcttcgaaacatttcgaatggnatggaccactcaaggttgatgtggattatctgaatgaaaaattgcaagagtgcttccttcaaaggataaggcatgctatgaagccggatggaggcgtttgggtctaattttttcgtgggacaatgttattgctgatacagactcgctaaagttgaatgcttggagacaacttgcttttggaggaaggtaaggatatcccaagtggtgctcaatgtccggaaagnatttattcatggtgctgctgacatgttccttaaaaaagggtttgtactgggcaaaagaggaagataaaatgggaaaaatggaggacgcccctt

SEQ ID NO: 11986 - protein, 87 aa, Zea mays
  misc_feature: Ceres CLONE 1367836-F
  misc_feature (82)..(82): Xaa is any aa, unknown, or other
MESCSFRAATAPSPFPSAPSSSSSPRAPCPILRFPRPRKGRQIGVRRRASGFDAFASFAGKVFVDEAIGAEYGEGFETFRMXWTTQG

SEQ ID NO: 11987 - DNA, 663 bp, Zea mays
  misc_feature: Ceres CLONE 1367838-F
  misc_feature: Translation starting site: 144
  misc_feature: Pfam Name: SOR_SNZ Pfam Description: SOR/SNZ family
  misc_feature (308)..(308): n is a, c, t, g, unknown, or other
  misc_feature (309)..(309): n is a, c, t, g, unknown, or other
  misc_feature (323)..(323): n is a, c, t, g, unknown, or other
  misc_feature (324)..(324): n is a, c, t, g, unknown, or other
  misc_feature (398)..(398): n is a, c, t, g, unknown, or other
  misc_feature (443)..(443): n is a, c, t, g, unknown, or other
  misc_feature (468)..(468): n is a, c, t, g, unknown, or other
  misc_feature (476)..(476): n is a, c, t, g, unknown, or other
  misc_feature (478)..(478): n is a, c, t, g, unknown, or other
  misc_feature (479)..(479): n is a, c, t, g, unknown, or other
  misc_feature (497)..(497): n is a, c, t, g, unknown, or other
  misc_feature (509)..(509): n is a, c, t, g, unknown, or other
  misc_feature (531)..(531): n is a, c, t, g, unknown, or other
  misc_feature (532)..(532): n is a, c, t, g, unknown, or other
aaagctggagctccccgcggtggcggccgctctagaactagtggatcccccgggctgcaggaattcgcacgagaccattacctagaacatcctaatcgaaaaattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtgtgcaccccggagcagggnncgcctcgcggagannggccggcgcgtgcgccgtgatggccgctggagcgggtccccgccgacatccgcgcgcaaggggcggcgtggcgncgcatggtcggacccgggcctcatccgcgacatcaagcgcgccgntcaccatcccggtcatggccaaggnccgcatcngnncacttcgtggaggccagnatcctggagggncgtgggcgtcgactacgtgacnnaagagcgaggtgctgacccccgccgacgacgcgcaccacatcaacagcacaactttcgcgtccccttcgtctgcggctgcgcgacctcgggaggcggtttcgcagggtgcgcgaggcgccgcctgatcgcc

SEQ ID NO: 11988 - DNA, 539 bp, Zea mays
  misc_feature: Ceres CLONE 1367865-F
  misc_feature: Encodes the peptide sequence at SEQ ID NO. 11989
  misc_feature (375)..(375): n is a, c, t, g, unknown, or other
ggagctccccgcggtggcggccgctctagaactagtggatcccccgggctgcaggaattcgcacgagaccattacctagaacatcctaatcgaaaaggtgcggaccaagggcctcttctccttctacgaggacggccaccaggagtgctgccgcgtgcgcaaggtgcggcccctgcgcagggcgctcagggggctcagggcgtggatcaccggccagaggaaggaccagtcccccggcaccagggccagcatccctctggtccaggttgacccttccttcgaaggcctggacggcggggctggtagcttggtcaagtggaaccccgtggccaacgtcgacggcaaggacatctggactttcctgcggaccatggnacgtcctgtcaacgccctgcacgcccagggctacgtgtccatcgggtgcgagccgtgcaccaggcctgtccctgcggggcagcacgagcgggaagggccggtgttgggtgggaggacccccaaggccaaggagtgcggccttcaacaagggccaacatcgaaac

SEQ ID NO: 11989 - protein, 56 aa, Zea mays
  misc_feature: Ceres CLONE 1367865-F
  misc_feature: SWISSPROT Homolog: EC 1.8.4.9 Adenylyl-sulfate reductase (glutathione)
  misc_feature (2)..(2): Xaa is any aa, unknown, or other
MXRPVNALHAQGYVSIGCEPCTRPVPAGQHEREGPVLGGRTPKAKECGLQQGPTSK

SEQ ID NO: 11990 - DNA, 670 bp, Zea mays
  misc_feature: Ceres CLONE 1367866-F
  misc_feature (399)..(399): n is a, c, t, g, unknown, or other
  misc_feature (400)..(400): n is a, c, t, g, unknown, or other
  misc_feature (467)..(467): n is a, c, t, g, unknown, or other
aaagctggagctccccgcggtggcggccgctctagaactagtggatcccccgggctgcaggaattcgcacgagaccattacctagaacatcctgatcggaaaactcttctcccctctctctcttccccgccccctctgtctcgacatcggtgccgtcatcttctcggcctctcgccggttggatccatcgggcgctggtcggatctgcctttcggtcgccgttgcccctccgccacgcctcgcgccagccggtcctgctgagcgccggcctgatccgcctccctctagtcggatctgcttggcgtcggcctctcgccgctactgctccgcatcctgggcttccctcacgatgcacgatcctggcacacgccacgccggtgtgctaccggctccttgcgnncgagcgacacatgggctgtgctcacgctgagcaggaaccacgatcggtcgcgttctcatcataaagncgactttctactcccaacgttggagcagttgacctccagggggggccggcgcccccttcccgggggggggtgtttccggggggccaggaaaggcccttttgccattgggtggggaaacggtaaaagggccccccccgggggttatatccccgggggtggaacaaaaaaaaaggggggggccccggggtgggggttacaccccc

SEQ ID NO: 11991 - DNA, 636 bp, Zea mays
  misc_feature: Ceres CLONE 1367882-F
  misc_feature: Encodes the peptide sequence at SEQ ID NO. 11992
aaagctggagctccccgcggtggcggccgctctagaactagtggatcccccgggctgcaggaattcgcacgagaccattacctagaacatcctaatcgaaaaaggagcttcatccaacagcccaagtgtccctgctacccccactggatcagcaagctagctacccagtggagagccacagccgaagccgaagccgaagctagagctagcaagcaatggctgcggcggctcctcctgcgcgtcctactagcagcatcagcagctgctgctgctgcatctcgcggcgcgccgccgccgtcgtgccggcgctgctgctgctggcgacgatggacgcctcctccggagacgcgcagccttccccggggtactacccgagctccagggtcaggccggtgccgatcaaccgggcgtacaccaacaagtggggtccgcagcaccagacgctctcgggcgaccattccgccctcaccatctgggtcgacagacctgcggtagtggtttcagtcgaagcacgcgtacagaaactgctacttctcactcgcatcatgctccccgcggatacacgtgggaccaacacgggcttcatctctcaacaaggagcgaccctggtttcacgacggatcgactggagtcctg

SEQ ID NO: 11992 - protein, 140 aa, Zea mays
  misc_feature: Ceres CLONE 1367882-F
MAAAAPPARPTSSISSCCCCISRRAAAVVPALLLLATMDASSGDAQPSPGYYPSSRVRPVPINRAYTNKWGPQHQTLSGDHSALTIWVDRPAVVVSVEARVQKLLLLTRIMLPADTRGTNTGFISQQGATLVSRRIDWSP

SEQ ID NO: 11993 - DNA, 651 bp, Zea mays
  misc_feature: Ceres CLONE 1367890-F
  misc_feature: Encodes the peptide sequence at SEQ ID NO. 11994
  misc_feature (584)..(584): n is a, c, t, g, unknown, or other
tggagctccccgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctgccctcgtgtttcgtgctctgattgttgagtcttcaatgagagctgattccagttatatagaggtgaacaagcttttgattatttcttttgttaatttggtgcaacatatagaggtgaacaagcttattaaaggaagatccttgtacaatcaagagttcatacnatagatgaaacgatattgtgattctctcaatggtggcttcatgagcaagcaatcattcaccttgttc

SEQ ID NO: 11994 - protein, 90 aa, Zea mays
  misc_feature: Ceres CLONE 1367890-F
MWTRCLRCERESGVPRSSRRVIMSAEAHYLSFGKFLELSFSSHSTARRLPICGHSLNTDCLRFFWVGLQSCNVPVFLSRNLQCLQTTAYS

SEQ ID NO: 11995 - DNA, 667 bp, Zea mays
  misc_feature: Ceres CLONE 1367891-F
  misc_feature: Translation starting site: 556
  misc_feature (402)..(402): n is a, c, t, g, unknown, or other
  misc_feature (404)..(404): n is a, c, t, g, unknown, or other
  misc_feature (459)..(459): n is a, c, t, g, unknown, or other
  misc_feature (525)..(525): n is a, c, t, g, unknown, or other
  misc_feature (561)..(561): n is a, c, t, g, unknown, or other
  misc_feature (589)..(589): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaagaacacatacctaattatcacctgtaagccagctgaaccacatctcgtcgtgcacatccggagcccgggaacacacacacacattgccatggccatgcccatgcccaagcccgtcctgagcctgctcgtgcacctacacgccgccgtcctgttccttcccgccccggccgggcggcgcggtctacaacgttctgcgctacggcgcgcgccccgacggcgtgagggacgcggcggggcccttccctccgcgcgtgggcggacgcctgccgctcgcccctcccggccggccgtgtacgtgcngnccagggaggtacctgggtgcggagcgccacgttcaccggcccgtgcccaagccgncgccgtaacgttcgccgtcgccgggcacggtcgtcgcccccgcggcctacggcgcgcgcggctcgntcgggggagggtggatcacgttcgagaaacatggangggcctcgtccgtcgcccggcggcggcnacgctggacgggccgcgggaagggcgctcttgggcctgcnagacagcgcgggccagcggcgactgtcccgacccccaa

SEQ ID NO: 11996 - DNA, 671 bp, Zea mays
  misc_feature: Ceres CLONE 1367892-F
  misc_feature: Pfam Name: AdoMetDC_leader Pfam Description: S-adenosyl-l-methionine decarboxylase leader peptide
  misc_feature (368)..(368): n is a, c, t, g, unknown, or other
  misc_feature (369)..(369): n is a, c, t, g, unknown, or other
  misc_feature (394)..(394): n is a, c, t, g, unknown, or other
  misc_feature (476)..(476): n is a, c, t, g, unknown, or other
aagctggagctccccgcggtggcggccgctctagaactagtggatcccccgggctgcaggaattcgcacgagaccattacctagaacatcctaatcgaaaaagagcagccgacaactctctaccgtccgagaccccaagcaccagcgcggcggcggcggcggcggcgaccatggctgtcgggaagaacaagaggatctccaagggaaagaagtttaagatctgttccacagatcacgcgtgcgcgctcgcgaatcgggggttccacacatagcttcgtcgttttgaatttgatgtactaatggagtctaagggtggcagaagtctagcagtagtcgttccatgatgtatgaagctccccttggctacnngcatgagggacgtcgacctgcccgnagcgcgaagaaagtccagtctgctgcttactcccactgcgcaaggagccatccggaaatccctttggctccctcgttcaagnaagtaaaggattccttttctgaactttcgattcttacaaatccccctgggctgtttggtttcgtgaaaatgaccgagtccccaggtttgcccccgggaggccccccccctccttccgggggggtgggttccactcccccgccacaaggggggttcttttgggggggggcccccccccgcccaaaatttgggtgtg

SEQ ID NO: 11997 - DNA, 604 bp, Zea mays
  misc_feature: Ceres CLONE 1367893-F
  misc_feature (174)..(174): n is a, c, t, g, unknown, or other
  misc_feature (200)..(200): n is a, c, t, g, unknown, or other
aagctggagctccccgcggtggcggccgctctagaactagtggatcccccgggctgcaggaattcgcacgagaccattacctagaacatcctaatcgaaaagacttccctagggtttagtcgcgccgccgccgccgccgaaacagcacatcgctctctcgatctcagccatggncggagtggagcagccccaggacgcgntgaagctcttcaacgctggaccttcgacgatgtccaggtgacggaatactcgctgaacgactacctggctgggaactgggggaaaaaagcgaaatttctggccacttcccgggggggctacttcacaaaaaggggtccccaaaggggcaaggggcatttttcaaaggcctcacaaattgggtatggtggacggggggcaccacacgccaaaaagggttggggcccccccccattaagaaaacccgggggaaaattcccccgggtctggggggcaatccctcccgggggggggggaggccttttttaaaaggggccccccggggggggccccccccttgttcctccccggggggggaaaaaaaaaagcctgggtaataattcccccccgcgaaaggggggccacc

SEQ ID NO: 11998 - DNA, 659 bp, Zea mays
  misc_feature: Ceres CLONE 1367895-F
  misc_feature: Translation starting site: 322
  misc_feature: Pfam Name: NTP_transferase Pfam Description: Nucleotidyl transferase
  misc_feature (394)..(394): n is a, c, t, g, unknown, or other
  misc_feature (656)..(656): n is a, c, t, g, unknown, or other
  misc_feature (657)..(657): n is a, c, t, g, unknown, or other
  misc_feature (659)..(659): n is a, c, t, g, unknown, or other
aaagctggagctccccgcggtggcggccgctctagaactagtggatcccccgggctgcaggaattcgcacgagaccattacctagaacatcctaatcgaaaaaaaatcccatcgccataaatctcgccacgcccgcgcccgcgcccgcgcgtgtctcttccccccaccactccgccaccggcgccgaagcagagcagccatggccggctccgagcagcgcgtcgtcgccgtcatcatgtcggcggccccaccaaagggacgcggttccggccgctgtcgctgaacgtgcccaagccgctcttccctatcgccggccagcccatggtgcaccaccccatctccgcctgcagccggatcccccacctggcacagatatacctcatcgggttctatngaggagcgggagttcgcgctctatgtctcgtctatctcccacgagctcaggatccctgtcaggtacctacgagaggataagcctcacgggtcagctggagggctctacagctttagagattacatcatggaagacagtccgtcacacatagttctgtggaattggcgacgtctgttctagcttccctcttcagacatgctagagcccataaaaagtattggaaggaaatgggtactttactaagtcacaggtatcagcaagnncn

SEQ ID NO: 11999 - DNA, 630 bp, Zea mays
  misc_feature: Ceres CLONE 1367900-F
  misc_feature: Encodes the peptide sequence at SEQ ID NO. 12000
  misc_feature (371)..(371): n is a, c, t, g, unknown, or other
  misc_feature (446)..(446): n is a, c, t, g, unknown, or other
  misc_feature (447)..(447): n is a, c, t, g, unknown, or other
  misc_feature (499)..(499): n is a, c, t, g, unknown, or other
  misc_feature (555)..(555): n is a, c, t, g, unknown, or other
  misc_feature (598)..(598): n is a, c, t, g, unknown, or other
  misc_feature (599)..(599): n is a, c, t, g, unknown, or other
tggagctccccgcggtggcggccgctctagaactagtggatcccccgggctgcaggaattcgcacgagaccattacctagaacatcctaatcgaaaagaggactcagcgggctccaaagccgacgaggataaagaggagcccggctccgcacgcgggagcgagaggatcgccggcgcaggatgtggtgcgcatcgtgcttggcgtccgcctgcgcgggctgcacctgcaacctctgcacgtcggcggcatcggccgtgtcccgccgctccgcgcgcctcgcttactgcggcctcttcgccgcctcccttatcctctccttcttgctccgccagttcgccgcgccgctccctcagcatatcccatggataantgcgtttgatcaaacaccaccagaagaatggtttcaaatgaatgctgttcttcgtgtaagcctggggaacttctnnggtcttgcatattttctctcgtgatgattggtgtgaaagacagaatgaccgncgagatgcctggcaccatggtggctggatgcaaagattgctggatggctggtccantggtcttaatgtctgtgtgccgacatgtcattactattacagnncctttccaaaggtggatctggctcttctcct

SEQ ID NO: 12000 - protein, 96 aa, Zea mays
  misc_feature: Ceres CLONE 1367900-F
  misc_feature (64)..(64): Xaa is any aa, unknown, or other
  misc_feature (89)..(89): Xaa is any aa, unknown, or other
MWCASCLASACAGCTCNLCTSAASAVSRRSARLAYCGLFAASLILSFLLRQFAAPLPQHIPWIXAFDQTPPEEWFQMNAVLRVSLGNFXGLAYFLS

SEQ ID NO: 12001 - DNA, 681 bp, Zea mays
  misc_feature: Ceres CLONE 1367905-F
  misc_feature: Encodes the peptide sequence at SEQ ID NO. 12002
  misc_feature (469)..(469): n is a, c, t, g, unknown, or other
  misc_feature (572)..(572): n is a, c, t, g, unknown, or other
  misc_feature (573)..(573): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (588)..(588): n is a, c, t, g, unknown, or other
  misc_feature (610)..(610): n is a, c, t, g, unknown, or other
  misc_feature (626)..(626): n is a, c, t, g, unknown, or other
  misc_feature (649)..(649): n is a, c, t, g, unknown, or other
  misc_feature (650)..(650): n is a, c, t, g, unknown, or other
aagctggagctccccgcggtggcggccgctctagaactagtggatcccccgggctgcaggaattcgcacgagaccattacctagaacatcctaatcgaaaagttccatcgccccccattgctcgccaagagttcttcttgtttaggcaaaggcaaaagcaggagcaaaaaggtttcgttggcgatggcgagctcgtggacgcttcctgaccacccgaagctccccaaggggaagccggtggctgttgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctnaagcttgttgatcaagctcttgcctcaggaaagatttatgatgggagatgggttcaactacatcaaagaatcgttttgaaaatggtactcttcactttattgnngtgtgagnnnnnntnagggggggtgtccacttcccgnccttgaccaactacangtactttctgaaaaaggtgtcanngtgagagaggagcaaaaaaaaagtcgtgtgc

SEQ ID NO: 12002 - protein, 98 aa, Zea mays
  misc_feature: Ceres CLONE 1367905-F
  misc_feature: SWISSPROT Homolog: EC 5.4.2.1 Phosphoglycerate mutase
  misc_feature (96)..(96): Xaa is any aa, unknown, or other
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAXAC

SEQ ID NO: 12003 - DNA, 647 bp, Zea mays
  misc_feature: Ceres CLONE 1367911-F
  misc_feature: Encodes the peptide sequence at SEQ ID NO. 12004
tggagctccccgcggtggcggccgctctagaactagtggatcccccgggctgcaggaattcgcacgagaccattacctagaacatcctaatcgaaaacaacaatggagttatcattccctattgatgatcgtggtactgttaagactgtggtgcaatacttcctggagacttatggtttcagtattcagcacaccactttaccttgtttgcaagtgtgcaatcagcaaagaccaaattatctgcctatggaggtctgtaagatagttgaggggcagcgctactcgaaacgacttagtgataaacagatcactgctctactgaaggtgacttgccaacgtccccaagcacgtgagaaggacatcttgcagactgtgtatcacaatgcctactccaaggatccttatgcccaggaatttggtataacgattgatgagcgtcttgcatcgcttgaagctcgtgttctgcctcccccaagtctgaaataccatgatagtgtcagagaaagggatgtattgccataaatcgtccagtggaacatgatgaataataaatggtgcatgctggtagagttagcagctgcgcatgcattgacttctcacgcaatgtgcaagatggtgctagcgggacgttctgtcatgacttggct

SEQ ID NO: 12004 - protein, 139 aa, Zea mays
  misc_feature: Ceres CLONE 1367911-F
  misc_feature (1)..(79): Pfam Name: PAZ Pfam Description: PAZ domain
  misc_feature: The sequence is a functional homolog of SEQ ID NO 2086 in the 10/374,780 US patent application
  misc_feature: The sequence is a functional homolog of SEQ ID NO 152 in the 10/225,066 US patent application
  misc_feature: The sequence is a functional homolog of SEQ ID NO 238 in the 10/374,780 US patent application
  misc_feature: The sequence is a functional homolog of SEQ ID NO 102 in the 10/286,264 US patent application
  misc_feature: The sequence is a functional homolog of SEQ ID NO 1579 in the 11/479,226 US patent application
  misc_feature: The sequence is a functional homolog of SEQ ID NO 2084 in the 10/374,780 US patent application
  misc_feature: The sequence is a functional homolog of SEQ ID NO 752 in the 10/412,699 US patent application
MELSFPIDDRGTVKTVVQYFLETYGFSIQHTTLPCLQVCNQQRPNYLPMEVCKIVEGQRYSKRLSDKQITALLKVTCQRPQAREKDILQTVYHNAYSKDPYAQEFGITIDERLASLEARVLPPPSLKYHDSVRERDVLP

SEQ ID NO: 12005 - DNA, 672 bp, Zea mays
  misc_feature: Ceres CLONE 1367913-F
  misc_feature: Encodes the peptide sequence at SEQ ID NO. 12006
  misc_feature (426)..(426): n is a, c, t, g, unknown, or other
  misc_feature (427)..(427): n is a, c, t, g, unknown, or other
  misc_feature (557)..(557): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (572)..(572): n is a, c, t, g, unknown, or other
  misc_feature (580)..(580): n is a, c, t, g, unknown, or other
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcgaaaactcgccgcagccgcaccaccagaccgacaaccggccggcttccctcgcccccggcgaggagtgaagacaagccgacaaggcaaaaccatcgcctgtacggtatccaaccgccgtcccgccgcacaacaaggatagggcgggagagggggatctcgctttcgctccgctgccgcatgcgcaccgcccctcctcatgacaccaactagggcaccaccagcccccttctcgtcgacctccgcgcggtgactctgctgagcatcatacccttatagggcccgacccatggatgtaacttcgaccgctgccgcctccgcctcaggcggnnggtaggtggtacacgggcatgtccgcggataacatcaagggcctggtgctcgcgctctcctccagcctcttcatcggcgccagcttcattatcaagaagaagggactcaagaaggccgcatctcgcgtcnaaaaaannngggggntggggggnctattcttatttatatgagctctttttttgggggggtggcatgataacaatgtttgttggttgggagaaattgcaaattttcgcnagcttat

SEQ ID NO: 12006 - protein, 50 aa, Zea mays
  misc_feature: Ceres CLONE 1367913-F
  misc_feature (38)..(38): Xaa is any aa, unknown, or other
  misc_feature (40)..(40): Xaa is any aa, unknown, or other
  misc_feature (41)..(41): Xaa is any aa, unknown, or other
  misc_feature (43)..(43): Xaa is any aa, unknown, or other
MSADNIKGLVLALSSSLFIGASFIIKKKGLKKAASRVXKXXGXGGLFLFI

SEQ ID NO: 12007 - DNA, 661 bp, Zea mays
  misc_feature: Ceres CLONE 1367919-F
  misc_feature: Translation starting site: 170
  misc_feature: Pfam Name: fn3 Pfam Description: Fibronectin type III domain
  misc_feature: SWISSPROT Homolog: EC 3.1.3.2 Acid phosphatase
  misc_feature (403)..(403): n is a, c, t, g, unknown, or other
  misc_feature (404)..(404): n is a, c, t, g, unknown, or other
  misc_feature (472)..(472): n is a, c, t, g, unknown, or other
  misc_feature (528)..(528): n is a, c, t, g, unknown, or other
  misc_feature (593)..(593): n is a, c, t, g, unknown, or other
  misc_feature (601)..(601): n is a, c, t, g, unknown, or other
aaagctggagctccccgcggtggcggccgctctagaactagtggatcccccgggctgcaggaattcgcacgagaccattacctagaacatcctaatcgaaaaccatccatccatccagttagttagttagtaagttagttgagggagaagaagcaggggaggggaagcgatgagcaacatgctgcgggctcgccgccgcctggacctcctgcaggtggtgctcttcgccgctgtgctcctcgtcgtcgtcgccgacgccggcgtgacgagccagtaccggcggaagctggaggcgacggtggagatgccctgggacgccgacgtcttccgcgtcccgccggggtacaatgccccgcagcaggtgcacatcacgctgggtgaccaggagggcacggcgatgatnncgtgtcgtgggtgacggccaatgagctgggcagcagcaccgtcatgtacagcgagggcgtcgccggancccggagaagatggagctcccgggcggagggcacccacacgcgctacgactacttncactacacctccggcttcatccaccactgcaccctcacaaacctcaagcatagcaccagtctatncccccccngtggggtcggccacacggtggagagcttctgctcacaccccaccatgcggggggcctgag

SEQ ID NO: 12008 - DNA, 631 bp, Zea mays
  misc_feature: Ceres CLONE 1367920-F
  misc_feature: Encodes the peptide sequence at SEQ ID NO. 12009
  misc_feature (345)..(345): n is a, c, t, g, unknown, or other
tccccgcggtggcggccgctctagaactagtggatcccccgggctgcaggaattcgcacgagaccattacctagaacatcctaatcgaaaacttgttcgccagccgtacgtcttcgtcagtgtcgtgtactcgttttcccttccaaggcacccgttgcgagggcggaggcgccgatggccggggcggcggcgggggcgggagcgggggcgctggccgggctcgcagcgtgcgcgacgctggcgtgcaacgtcgcaggcgccgtgctcttcctcctcagccaagacgacaagcggctgcggcgcgggtgtgcggcgaggttgggcgctggcggcgtcgcgtcgcanccggtggaggagtgcggtgatgaagaggcgctcgcgccggacgccgtcctcaacctcgagctcggcgacccgacgatgtaccgggcgttctggcgggaggttagggactgcggcgccaccgtgatccgcgggtggcaggggatgatctacttctccgacgacgacgccgtgctctgctggttccctcgagcggagctggagcgcgaggtgcgccgactccaccgcatcgatggaaacgcagtcgtcgacgctacccacctcgtggtacgcgacggtgccatccagt

SEQ ID NO: 12009 - protein, 152 aa, Zea mays
  misc_feature: Ceres CLONE 1367920-F
  misc_feature: SWISSPROT Homolog: EC 4.4.1.4 Alliin lyase
  misc_feature (57)..(57): Xaa is any aa, unknown, or other
MAGAAAGAGAGALAGLAACATLACNVAGAVLFLLSQDDKRLRRGCAARLGAGGVASXPVEECGDEEALAPDAVLNLELGDPTMYRAFWREVRDCGATVIRGWQGMIYFSDDDAVLCWFPRAELEREVRRLHRIDGNAVVDATHLVVRDGAIQ

SEQ ID NO: 12010 - DNA, 776 bp, Zea mays
  misc_feature: Ceres CLONE 1367926-F
  misc_feature: Encodes the peptide sequence at SEQ ID NO. 12011
  misc_feature (575)..(575): n is a, c, t, g, unknown, or other
  misc_feature (619)..(619): n is a, c, t, g, unknown, or other
aagctggagctcaccgcggtggcggccgctctataatagtggatcccccgggctgcaggaattcgcacgagaccattacctagaacatcctaatcgaaaaatatttgttaagtttcaggcagagagaaagatagaggagcaaacagcaactccagaagatgagtctccctcgccgccgccaccttgtcctgctcgcctgcctcctggtcttcctcgtcttcgccgcgtccgcgtcgacgagttccgccgaggtggccccgagcgtggcggtggacttcgtgcggcgttcgtgccggtcgacgaagtacccgcgcgtgtgcaagagcacgctggtccccctggccggctggcgtggggcgcatccccgcccctgctggcgcgaacggccctggtggttggccccaaccgcccccggaaattgctccctcctaaatccccgggggggagggggcggcccaaaaaaaagaactgccccgaacctggccccccaacccagaagaaaacggtttgcgcaaatcccccgcaaaaaaaaggaagcggaagtgggccgttgccggaaaaaacaaccttttccntttgggccccctccaaaaaccctccaaaaaccttggggccaganggccgggttttcaccgcaaaaccccccacccgtgcttccaaaatcccctcccgcccaaaaaaatccccccgcgggtgggaaagggaaaagtggaacaaacccccctttaaagtgataaaaaaaaaaggcggtggcggcccccctccccctcaccccc

SEQ ID NO: 12011 - protein, 191 aa, Zea mays
  misc_feature: Ceres CLONE 1367926-F
  misc_feature (154)..(154): Xaa is any aa, unknown, or other
MSLPRRRHLVLLACLLVFLVFAASASTSSAEVAPSVAVDFVRRSCRSTKYPRVCKSTLVPLAGWRGAHPRPCWRERPWWLAPTAPGNCSLLNPRGGGGGPKKRTAPNLAPQPRRKRFAQIPRKKKEAEVGRCRKKQPFPFGPPPKTLQKPWGQXAGFSPQNPPPVLPKSPPAQKNPPAGGKGKSGTNPPLK

SEQ ID NO: 12012 - DNA, 653 bp, Zea mays
  misc_feature: Ceres CLONE 1367927-F
  misc_feature: Translation starting site: 465
  misc_feature: Pfam Name: RhoGAP Pfam Description: RhoGAP domain
  misc_feature: Pfam Name: PH Pfam Description: PH domain
  misc_feature (364)..(364): n is a, c, t, g, unknown, or other
tccccgcggtggcggccgctctagaactagtggatcccccgggctgcaggaattcgcacgagaccattacctagaacatcctaatcgaaaaggaattgaccttatcactcccgctagcgcacgagccaggcaagacacaacgctactgactggcctttttcaggatgcccgcgatggccgcgccttcaccttgaaggcagaaaggtctcgaagatttgtttgagtggaaaacaccgctggaagaacctcttgcacaagctccaaatgcagctcttgtgatggcccataatgcaatatttcgcagtgacacaacagatgtatgtgacggggctattcctagttggagaaagaagacacctatcgnatcactagatgttgacaggccactactgcttgcactggaagatatagatggcaatccttcttttctgtaaaaagctgtgtgtctccatgagaaacatgcaatgaaggtgcaaggaattctgcgtcaagctgcagatgcggatgaggctgacaggagattgcacgactatgagcaacgaacgacagaatttgcaccagaagagcatgctcatggtgctggtgactgtgcaaagcatagtctacgtgagctcccatcatctcctgattcagcttcgtgctgcacagaatga

SEQ ID NO: 12013 - DNA, 720 bp, Zea mays
  misc_feature: Ceres CLONE 1367928-F
  misc_feature: Encodes the peptide sequence at SEQ ID NO. 12014
aaagctggagctccccgcggtggcggccgctctagaactagtggatcccccgggctgcaggaattcgcacgagaccattacctagaacatcctaatcaaaaaaccaaaggtatcttgcaatcacaacgaacaaaagctctcgatctcaccgacaccgaggaagaagagatcaatggcgtccgagcagggagtcgtgatcgcgtgccacagcaaggctgagtttgacgcccacatgaccaaggcccaggaagccggcaagctggtggtcatcgacttcactgccgcctggtgcggtccatgccgcgccatcgccccactgttcgtcgaacacgccaagaagttcactcaggtcgtctttctgaaggtgaacgtggacgaagtgaaaggattccaccccgccctatgaggtccaggggatgcccacctttcccttcgtaaaaaacggaagaaggccccgaaccatcggggggccagaaaggacaaatccctggccctgaaaaaaaaaatggccgccctgggcctggaaatgggtttgccaaaagggaacaaaaaaggcgccgcccccccataagggcccccacgaagggggttaaaagggggccctaaaaccaccggggtttttccctgggggggcggtttttgaaacaaaaaaaaagttttttttttttcccctggggcgggggggagtatattacccccggagattttcgggggggggtc

SEQ ID NO: 12014 - protein, 77 aa, Zea mays
  misc_feature: Ceres CLONE 1367928-F
  misc_feature (8)..(77): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASEQGVVIACHSKAEFDAHMTKAQEAGKLVVIDFTAAWCGPCRAIAPLFVEHAKKFTQVVFLKVNVDEVKGFHPAL

SEQ ID NO: 12015 - DNA, 689 bp, Zea mays
  misc_feature: Ceres CLONE 1367933-F
  misc_feature: Encodes the peptide sequence at SEQ ID NO. 12016
  misc_feature (345)..(345): n is a, c, t, g, unknown, or other
aaagctggagctccccgcggtggcggccgctctagaactagtggatcccccgggctgcaggaattcgcacgagaccattacctagaacatcctaatcaaaaagcaaggcaagaagaacacgagagagatagcaggcaccaggcagggatcaatcatccgtccatggagaacctaaaggagcggggacacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggngacgacgacctcctcgcccacgcccaggcccaggccctgaagccgcaggccagtaacgccccgcccaagctcggccgcccccgccccggccccgccgacgaccactccccaacgggagggaagaagttcctgagctacttccggtgttgtatcaaggcctgaagaggtgctgctctagtgcctgcagtccctgtgtttttttttcgcagcagaacacttgtgagcaatcaggcatcggttttggtacgactccctcccgtttccttttttatttggcccctagataggggtaaaaattgcactattccagcgacaaataaaaaagaaacacggagggaggtacc

SEQ ID NO: 12016 - protein, 114 aa, Zea mays
  misc_feature: Ceres CLONE 1367933-F
MENLKERGHDAAGANAWMTVPAFGDWDTKNGALPDYSMDFSKIREMRKQNKKELSRASLGGDDDLLAHAQAQALKPQASNAPPKLGRPRPGPADDHSPTGGKKFLSYFRCCIKA

SEQ ID NO: 12017 - DNA, 678 bp, Zea mays
  misc_feature: Ceres CLONE 1367939-F
  misc_feature: Encodes the peptide sequence at SEQ ID NO. 12018
  misc_feature (600)..(600): n is a, c, t, g, unknown, or other
  misc_feature (606)..(606): n is a, c, t, g, unknown, or other
tggagctccccgcggtggcggccgctctagaactagtggatcccccgggctgcaggaattcgcacgagaccattacctagaacatcctaatcgaaaaaccgagaatcacaatacgaaacgaattaatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggtgctggtgatcagcggcgagcggcgccgggaggagcgcgaggacgccaagtacctgcgcatggagcggcggatgggcaagttcatgcgcaaagtcgtgctgccggacaacgccgacgtggacaaggtcgccgccgtgtgcagggacggcgtgctcacggtgaccgtcgagaagctgcccccgccgnagcccnagagcccagaccatcgagattaaggtcgcctggagggagaccgtttgtcgagcagtccagtgagctgggtgg

SEQ ID NO: 12018 - protein, 150 aa, Zea mays
  misc_feature: Ceres CLONE 1367939-F
  misc_feature (49)..(149): Pfam Name: HSP20 Pfam Description: Hsp20/alpha crystallin family
  misc_feature (142)..(142): Xaa is any aa, unknown, or other
  misc_feature (144)..(144): Xaa is any aa, unknown, or other
MDARMFGLETPRVAALHHLLDVPDGDKAGGGATRTYVRDARAMAATPADVKELAGAYAFVVDMPGLSTGDIRVQVEDERVLVISGERRREEREDAKYLRMERRMGKFMRKVVLPDNADVDKVAAVCRDGVLTVTVEKLPPPXPXSPDHRD

SEQ ID NO: 12019 - DNA, 707 bp, Zea mays
  misc_feature: Ceres CLONE 1367943-F
  misc_feature: Encodes the peptide sequence at SEQ ID NO. 12020
  misc_feature (301)..(301): n is a, c, t, g, unknown, or other
aagctggagctccccgcggtggcggccgctctagaactagtggatcccccgggctgcaggaattcgcacgagaccattacctagaacatcctaatcgaaaaattcaccaatcgccttcctgtcgccctcccgctcggctcggagaacgcgatctgttccccaacctccggagccgctccaccgtcctccactccggatgccgaatcgacccgccccgatccagatcaggagctgagggatggacgcgaacaggcgccagagtgggatccagcagttgctggctgcggagcaggaagctcancaaatagtgaatgcagctagagctggcaagtcagcgaggctcacgcaatcaaaagaggaggctgagcgataaatagcctaataccgtgcccagatggagctgagtttcaaaaggaaggttgaaaagaagcagcgcaaactccggtgcaaacgtcaaacttctccgaggaagaaccggcgggtaaaaatcaagtaacctcaccggaaggcccaaagcatccccccggatggcattcaaaaggtcctgggggttggcccccaccgcaagaaatggaggggggggggtccccgaacttgtgcccccaaaatggccccccccaataattttttttttggcaaaaggagaaaggggggggagaaaaaaaaaccccccgttgaaacacaaaatttcggggggaaaaacagga

SEQ ID NO: 12020 - protein, 44 aa, Zea mays
  misc_feature: Ceres CLONE 1367943-F
  misc_feature: SWISSPROT Homolog: EC 3.6.3.14 H(+)-transporting two-sector ATPase
  misc_feature (21)..(21): Xaa is any aa, unknown, or other
MDANRRQSGIQQLLAAEQEAXQIVNAARAGKSARLTQSKEEAER

SEQ ID NO: 12021 - DNA, 776 bp, Zea mays
  misc_feature: Ceres CLONE 1367946-R
  misc_feature (713)..(713): n is a, c, t, g, unknown, or other
  misc_feature (740)..(740): n is a, c, t, g, unknown, or other
acaattgggtaccgggccccccctcgaggtcgacggtatcgataagcttttttttttttttttttgggccctatttcttttgtttgttaataatgaggtgcccataaaaaaagtgcccctctaagattgttcataatgtacactacccaaactaatttcctcataattggcaactaaaatcctttatgtggcaaatcgctggattgggaaaaaatgtcaagtatgtgcctggcatgggggcttatccttcgcgtaccactttgatggatcttgcaccgtctttcccgatgccccctgagcttgtgccaaaatatccaccaatactgctaaaatgttcgacaacttaagcctgacccatggatctgcttccctacatcactacttcataccctacagcttttaaccgcatcttcttcaaaagacatgggctctacccctgtctcacacctactgccgcttggagagcgtgccataggctcacccgtgatcatgaacctcatcagctcccagataacctcggccaacctgaacacatctgctcttacctcaaatggcctcgtggtatatcatcatcatgctccatccatctgtatcctgccacctatcagctgtcacccacacctcgcttgatccaattaactgagccttcgccaaaattcatgcacttttctcgggcaagcttccgttaccccttcacccttttaaaggtgttnggaccgatgtcccttcccatttctgtnaaaccatctcctgtgcccctccttcccccaattttt

SEQ ID NO: 12022 - DNA, 639 bp, Zea mays
  misc_feature: Ceres CLONE 1367946-F
  misc_feature: Encodes the peptide sequence at SEQ ID NO. 12023
  misc_feature (573)..(573): n is a, c, t, g, unknown, or other
  misc_feature (587)..(587): n is a, c, t, g, unknown, or other
tccccgcggtggcggccgctctagaactagtggatcccccgggctgcaggaattcgcacgagaccattacctagaacatcctaatcgaaaaacagtaggttcattccccccaccacatcgaactgtgcgcgcgctgcacgtccgatcactcccctcctctgtccgcgatctcgaatggccgcctgggcttggccctcgccaccgctcccgtctccggttccgacgaccgagccaggtttgctcggctcttcgtgccagcgacgatgaaggacaagcgtgggctcgaggacaccggcgacgcgcgccctgatgccaagaggacgagtcctccggctctggccagtgttattgttcaagcgctaaaggtgcatagtctgcagaggctctgctcatcattggaaccatttcttcgtagagtattcagtgaataagtgcagagcgcactgcgcaaacttgcgactgcaacaatcggtggaaggtcttcccaaagcgaattgacggcccaaatggaagaactctgcaactcgtattcagaacaggctgtcacttcgcctttttactaggagaaaagtngaacgggagcaggnagctgcaactcatggtgctattgttgatgctggcactggctagattgtatcc

SEQ ID NO: 12023 - protein, 55 aa, Zea mays
  misc_feature: Ceres CLONE 1367946-F
MKDKRGLEDTGDARPDAKRTSPPALASVIVQALKVHSLQRLCSSLEPFLRRVFSE

SEQ ID NO: 12024 - DNA, 711 bp, Zea mays
  misc_feature: Ceres CLONE 1367948-F
  misc_feature: Encodes the peptide sequence at SEQ ID NO. 12025
  misc_feature (384)..(384): n is a, c, t, g, unknown, or other
  misc_feature (455)..(455): n is a, c, t, g, unknown, or other
aaagctggagctccccgcggtggcggccgctctagaactagtggatcccccgggctgcaggaattcgcacgagaccattacctagaacatcctaatcgaaaaaggaaaggacaaaggagcggcggcgaggtctatggcgtcgacggcggggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcatcgacgatgcggaggctcagtacaggaacttccagcaccccgatccctacatggntccatgggcaccaggcggcactaaattcacaaggaaacccccctccactcaggggatcgagatcatctacnattatggcaaggaggaccagtaaacaagagtccttgcaggcgggggcaaaacttccacagttccaatcccttccggtttatccagttggtggacagaaaataaaatggaaatttcgggaccccaaccagggctccccattgcctgggccgaaaaaccaagccccctccccaggggaaattggagggggggttccctggccaaaaggggattggcctttccttggggggggggtttaaaaaaaaaaaaaaaaagttt

SEQ ID NO: 12025 - protein, 114 aa, Zea mays
  misc_feature: Ceres CLONE 1367948-F
  misc_feature (13)..(78): Pfam Name: Complex1_LYR Pfam Description: Complex 1 protein (LYR family)
  misc_feature (84)..(84): Xaa is any aa, unknown, or other
  misc_feature (108)..(108): Xaa is any aa, unknown, or other
MASTAGYLARRAAQKERVRLLYRRALKDTLNWAVHRHLFYQDASDLRDKFEANRHVDNLDVVDRLIDDAEAQYRNFQHPDPYMXPWAPGGTKFTRKPPSTQGIEIIYXYGKEDQ

SEQ ID NO: 12026 - DNA, 678 bp, Zea mays
  misc_feature: Ceres CLONE 1367959-F
  misc_feature: Translation starting site: 216
  misc_feature: SWISSPROT Homolog: EC 2.7.11.1 Non-specific serine/threonine protein kinase
  misc_feature (306)..(306): n is a, c, t, g, unknown, or other
  misc_feature (353)..(353): n is a, c, t, g, unknown, or other
  misc_feature (367)..(367): n is a, c, t, g, unknown, or other
  misc_feature (558)..(558): n is a, c, t, g, unknown, or other
  misc_feature (602)..(602): n is a, c, t, g, unknown, or other
  misc_feature (603)..(603): n is a, c, t, g, unknown, or other
aaagctggagctccccgcggtggcggccgctctagaactagtggatcccccgggctgcaggaattcgcacgagaccattacctagaacatcctaatcgaaaaatttcgacatcaggtattcagttcggttcttgggagagccaatctgctgctgcttgcggtgactggcaccagcgcgcaaggcttcctagagaccatctgcctgcgctgttccgatggattgcttcgggtgcttcgcgccggaggcggacgaggacctcaggcccctccagcacgacgattcgtcaggggctgatgcgagggagnaggtcgtgccggatgtggccagcggctacgcgcacagcttcaccttncaggatctgcttgntggcagtggctacttttcacgagcccatttcataggagaaggtggattcgggaaggtgtacaaggacaaagatcacgggcagatggtggcagtgaagcagctcgctcgagacggagttcttggtcgaggtgctcatgctgacggtgctcaaccatcgcaatcttgtcagctttggtcggttctgcacgtanggggacgagaggctgctggctgctggtctatgagtacatgccgnntcggaagctggagagccatctgtttgaccatcctaggtctaaggatacagcccggtggcgttatggattcccggc

SEQ ID NO: 12027 - DNA, 691 bp, Zea mays
  misc_feature: Ceres CLONE 1367962-F
  misc_feature: Encodes the peptide sequence at SEQ ID NO. 12028
  misc_feature (515)..(515): n is a, c, t, g, unknown, or other
aagctggagctccccgcggtggcggccgctctagaatagtggatcccccgggctgcaggaattcgcacgagaccattacctagaacatcctaatcgaaaaccacacaccagaatccgtgaatcacagacgcgtctatttaagattgctgcattgcactaccctgccctgccatcatatcgtacgtgagcccgaccaaacgaaagcaagggaaaggctgatctgctccgaagctcgcgacgctggcgctggccgctctcctggcgaggatggtggtgcctcctccacgcgtggtgcgagcttacatgccttgctccaccgtgtacagcacgctgatgccgaggctgccgttcgctcacatggccgaagccatggcgccgcagtcgtgctgcggcgctatccgcagcctgctgcagcaagtcaacaacaccgccgaccgacgaatcatctgcttctgcctcaggaacgtcggcaatgctcgcaattgcagcggcatctacatcagccgcgccgccgngcttgccaggcagagcagtgtcgccatgacgaacaagacagcatcagcgttaactgcacctcgattcattaactgaggaggatacctgcgcccgtctggagaaggaatgcttccatggcgctggaccagacctaaaaactatggcaactgcaattttaagcttttcgtggtgtgcc

SEQ ID NO: 12028 - protein, 107 aa, Zea mays
  misc_feature: Ceres CLONE 1367962-F
  misc_feature (83)..(83): Xaa is any aa, unknown, or other
MVVPPPRVVRAYMPCSTVYSTLMPRLPFAHMAEAMAPQSCCGAIRSLLQQVNNTADRRIICFCLRNVGNARNCSGIYISRAAXLARQSSVAMTNKTASALTAPRFIN

SEQ ID NO: 12029 - DNA, 666 bp, Zea mays
  misc_feature: Ceres CLONE 1367966-F
  misc_feature: Encodes the peptide sequence at SEQ ID NO. 12030
  misc_feature (666)..(666): n is a, c, t, g, unknown, or other
aaagctggagctccccgcggtggcggccgctctagaactagtggatcccccgggctgcaggaattcgcacgagaccattacctagaacatcctaatcgaaaaatctcaagccaccatcgaccttcaagtctcgctacgtagcagtgcaataaaaaaagcagccgcaatggcgagcagcaccatggccctctcctccacggccttcgccggcaagggcgtgaacgtgccgtcgtcgtccgccttcggcgaggcccgcgtgactatgcgcaagacggcggccaaggccaagccagcgacggtgtccggcagtccgtggtacggccccgaccgcgtgctgtacctggacccactgtccggcgagccaccgagctacctgacgggcgagttcccgggcgactactgctgctacaccgcggtgctgtcggcgtacccggagacgttcgccaagaaccgggagctggaggtgatccactcccgctgggacatgctgggcgcgctcggatgcgtcttccccgagctgctcgcccgcagcggcgtcaagttcggcgaggacgtgtggttcaggggcgcctcccatatcttcagcgagggctggctggactacctcgggaaaccgagcctcatccacgcgcagaggatccttgctatctgggcctgacaggtcgn

SEQ ID NO: 12030 - protein, 163 aa, Zea mays
  misc_feature: Ceres CLONE 1367966-F
  misc_feature (65)..(156): Pfam Name: Chloroa_b-bind Pfam Description: Chlorophyll A-B binding protein
MASSTMALSSTAFAGKGVNVPSSSAFGEARVTMRKTAAKAKPATVSGSPWYGPDRVLYLDPLSGEPPSYLTGEFPGDYCCYTAVLSAYPETFAKNRELEVIHSRWDMLGALGCVFPELLARSGVKFGEDVWFRGASHIFSEGWLDYLGKPSLIHAQRILAIWA

SEQ ID NO: 12031 - DNA, 675 bp, Zea mays
  misc_feature: Ceres CLONE 1367968-F
  misc_feature: Encodes the peptide sequence at SEQ ID NO. 12032
  misc_feature (348)..(348): n is a, c, t, g, unknown, or other
  misc_feature (367)..(367): n is a, c, t, g, unknown, or other
aaagctggagctccccgcggtggcggccgctctagaactagtggatcccccgggctgcaggaattcgcacgagaccattacctagaacatcctaatcgaaaaaacagtgaaacgccccgctcccaagccggcaaacaccagcccccgcgacggcgccgcgccgtcctctcccgaccgacggcaacggaaaccctggtgacttctgatacaggaagattacttttatctatactccaccttcttttgtggctatggcactagcagctatctataaccttttcatcattaacaaatccggcggccttatatactacaaggactatggttcagcagggaggatggataccnatgacagtttaagattaancagcctctggcattcgatgcatgctatctcgcagcaactgtcccctaccactggctgtactggcattgatcttcttacagctcataactttgatctccatgctttccatccctcaaaggaacgaaatttttcgtcgaatgccaacctggagctccaatatggaaatgctgctaaaaaggatttacagttggaaccgaacttctttttaaaaataccttcataaaaaaggaaaagccaattgggggggagttttaacccaacccggtctagggataccaaaaagaccggttgcccccgggggggggaaa

SEQ ID NO: 12032 - protein, 112 aa, Zea mays
  misc_feature: Ceres CLONE 1367968-F
  misc_feature (6)..(110): Pfam Name: Sybindin Pfam Description: Sybindin-like family
  misc_feature (33)..(33): Xaa is any aa, unknown, or other
  misc_feature (39)..(39): Xaa is any aa, unknown, or other
MALAAIYNLFIINKSGGLIYYKDYGSAGRMDTXDSLRLXSLWHSMHAISQQLSPTTGCTGIDLLTAHNFDLHAFHPSKERNFSSNANLELQYGNAAKKDLQLEPNFFLKIPS

SEQ ID NO: 12033 - DNA, 680 bp, Zea mays
  misc_feature: Ceres CLONE 1367969-F
  misc_feature: Encodes the peptide sequence at SEQ ID NO. 12034
  misc_feature (604)..(604): n is a, c, t, g, unknown, or other
aaagctggagctccccgcggtggcggccgctctagaactagtggatcccccgggctgcaggaattcgcacgagaccattacctagaacatcctaatcgaaaaaacaacaacaacaacccgcacaacggcacgattctcctcctccgtccgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctacgaggagacccgcggcgtgctcaagatcttcctcgagaacgtcatccgcgacgccgtcacctacaccgagcacgcccccgcaagaccgtcaccgccatggatgtcgtctacgcgctcaagcgccagggccgcacgctctacggcttcggcggctaggccgcctccccttctgatgctttgatgtgacggccgtggtcggttgtgtgtctagttggccggtctactgtagtttgttctgtatccttcgttcgaggtggttccagttctagccccattggntgtatattttcactgctattatcaatggaaagccctcgggtctatccccattggtctggatcaaaaaaaaaaaaaa

SEQ ID NO: 12034 - protein, 111 aa, Zea mays
  misc_feature: Ceres CLONE 1367969-F
MSGRGKGGKGLGKGGAKRHRKVLRDNIQGITKPAIRRLARRGGVKRISGLIYEETRGVLKIFLENVIRDAVTYTEHAPARPSPPWMSSTRSSARAARSTASAARPPPLLML

SEQ ID NO: 12035 - DNA, 693 bp, Zea mays
  misc_feature: Ceres CLONE 1367974-F
  misc_feature: Encodes the peptide sequence at SEQ ID NO. 12036
  misc_feature (366)..(366): n is a, c, t, g, unknown, or other
  misc_feature (693)..(693): n is a, c, t, g, unknown, or other
aagctggagctccccgcggtggcggccgctctagtctagtggatcccccgggctgcaggaattcgcacgagaccattacctagaacatcctaatcgaaaagtttaatcaatccttcaagcgcaagctgcctcctcctcgtcgtccggtcgtgagaagggatggcgggccgtggcaaggctatcggcgctggcgccgcgaagaaggcaacgtcgaggagctccaaggccggactccagttccccgtcggaaggattgctaggttcctcaaggcgggcaagtacgctgagcgcttcggcgccgacgcccccgtgtacctcgccgccgtcctcgagaacctcgcggctgaggttctcagacttgccggnaacgccgcgagggacaacaagaagaccccgcattgtgccgcgccacatccagcttgctgtgcgccaccgactagggagctgaccaaactgttggggggtgccccccatcgcgagggggagggtgttatgcctagcctccatcagaatctgctccccaagaagggtggctccctcccaggccggtgtcgaccccgacgacaacggagaatggtttcctgaaaaaatgatccgaaccaccgccctggttttgaacgaatcaggttgatgtttgccttccatccgcgcagggacccgggtatgcctgggaaaggcaaattagatcacgcn

SEQ ID NO: 12036 - protein, 141 aa, Zea mays
  misc_feature: Ceres CLONE 1367974-F
  misc_feature (19)..(87): Pfam Name: Histone Pfam Description: Core histone H2A/H2B/H3/H4
MAGRGKAIGAGAAKKATSRSSKAGLQFPVGRIARFLKAGKYAERFGADAPVYLAAVLENLAAEVLRLAGNAARDNKKTPHCAAPHPACCAPPTRELTKLLGGAPHREGEGVMPSLHQNLLPKKGGSLPGRCRPRRQRRMVS

SEQ ID NO: 12037 - DNA, 729 bp, Zea mays
  misc_feature: Ceres CLONE 1367983-F
  misc_feature: Encodes the peptide sequence at SEQ ID NO. 12038
  misc_feature (363)..(363): n is a, c, t, g, unknown, or other
  misc_feature (370)..(370): n is a, c, t, g, unknown, or other
  misc_feature (595)..(595): n is a, c, t, g, unknown, or other
  misc_feature (727)..(727): n is a, c, t, g, unknown, or other
  misc_feature (728)..(728): n is a, c, t, g, unknown, or other
aaagctggagctccccgcggtggcggccgctctagaactagtggatcccccgggctgcaggaattcgcacgagaccattacctagaacatcctaatcgaaaaactgcacgctagtggctagcactgccgcagtaggtcagtcgggtgtacgtacggtgccatggcctcggcctcgctgccgctcctcgtcatcgtcctcctcgtctcggtcgtcggagcttgcactcgtgctgccgaggcggcggctacccgtaggaaggacgatgtcatcacaacaaccaccagcagcagccgtggatcatcctcaccgtcgtcgtcaccctccccaggagcagcagcagagaagaaagagaagcccaaggncggtggncgcgcgacgtccgcgaagaaaccgtcgcccgcggccaagtgcgtgacgagcaaggactgccaccctcagcggctggtgtgcggcaagaggtgcaccatggccgcacacaacaggtgcgccggccagtggttccacttcttgcaacgccctccccatctgcacctaggtgacatgcatgctatgtaaccccagtaaaattattatttattttataaatgaaccccntggctggagtccattcggatggcagcctgggcaatcaaagaggaaggggaatggattccaaccaccttttaaaaaaaaaaaaaaagttttttttagaaaaaaaggggggggggggggggggggggagggggnnt

SEQ ID NO: 12038 - protein, 131 aa, Zea mays
  misc_feature: Ceres CLONE 1367983-F
  misc_feature (68)..(68): Xaa is any aa, unknown, or other
MASASLPLLVIVLLVSVVGACTRAAEAAATRRKDDVITTTTSSSRGSSSPSSSPSPGAAAEKKEKPKXGGRATSAKKPSPAAKCVTSKDCHPQRLVCGKRCTMAAHNRCAGQWFHFLQRPPHLHLGDMHAM

SEQ ID NO: 12039 - DNA, 702 bp, Zea mays
  misc_feature: Ceres CLONE 1367987-F
  misc_feature: Encodes the peptide sequence at SEQ ID NO. 12040
  misc_feature (230)..(230): n is a, c, t, g, unknown, or other
  misc_feature (349)..(349): n is a, c, t, g, unknown, or other
  misc_feature (428)..(428): n is a, c, t, g, unknown, or other
aaagctggagctccccgcggtggcggccgctctagaactagtggatcccccgggctgcaggaattcgcacgagaccattacctagaacatcctaatcgaaaaaccgaccaagaaccagcatgaagccactggtggcgcgcctgctcctctgctactccctgctctggctggcgcccgcggcagccccgctacgcctgcagcacgatcatggtccgggccacggccacggncatgcccacccgcctccgtacgcgcgtaacgcgacggcgtacggcgtctcggcggcgctgtgcccggcctgcggcgcgtgggcggacgcgctcgagttcctctactaccacaacctggntgcgctggcgtccctggagccggcgctggcgtggtcccccgcgcctggcgtcctacgcggcttggtggggccgcgcaancgccgcggggactggggcgcttgcccactccctcccccgacgggcagttcggcgctcgggggaaaccgtctttctggggcgggccccgggcgggcgcggtggcggcccccgggacccccttcccggacttggccccgccgaaggccccctactactcctaagcccaaaaaagggggggcgccaagggccggaaggtgccccactaaaacccaaaatggtggtggcgcacacccccccgcccgtcggtttgctccccgggtggcctgggaaaaag

SEQ ID NO: 12040 - protein, 194 aa, Zea mays
  misc_feature: Ceres CLONE 1367987-F
  misc_feature (77)..(77): Xaa is any aa, unknown, or other
  misc_feature (103)..(103): Xaa is any aa, unknown, or other
MKPLVARLLLCYSLLWLAPAAAPLRLQHDHGPGHGHGHAHPPPYARNATAYGVSAALCPACGAWADALEFLYYHNLXALASLEPALAWSPAPGVLRGLVGPRXRRGDWGACPLPPPTGSSALGGNRLSGAGPGRARWRPPGPPSRTWPRRRPPTTPKPKKGGAPRAGRCPTKTQNGGGAHPPARRFAPRVAWEK

SEQ ID NO: 12041 - DNA, 681 bp, Zea mays
  misc_feature: Ceres CLONE 1367996-F
  misc_feature: Encodes the peptide sequence at SEQ ID NO. 12042
  misc_feature (366)..(366): n is a, c, t, g, unknown, or other
  misc_feature (393)..(393): n is a, c, t, g, unknown, or other
  misc_feature (482)..(482): n is a, c, t, g, unknown, or other
  misc_feature (483)..(483): n is a, c, t, g, unknown, or other
  misc_feature (504)..(504): n is a, c, t, g, unknown, or other
  misc_feature (505)..(505): n is a, c, t, g, unknown, or other
aaagctggagctccccgcggtggcggccgctctagaactagtggatcccccgggctgcaggaattcgcacgagaccattacctagaacatcctaatcgaaaaactacacacaaacacacaatggcaccagaaaggatgctcctcggcgtctgtgccgtgctgatggtggtcggcgtcacgaacgcggcggagggccaggtggcgtcggtcgtcgtgggcctggcgaggtgcgccgacagcacgaggaagaacatgaaggctgaggccggtttcaagggtcttcaggtggcgatcaagtgcaagaacagcaacggcgagtacgagacaaaggccgtgagtgagatccaaagctccggagccttcagngtcccactcgcccgcgacctccacggngccgactggcacgcgcagcttcacagcgccgccaataacgcgccttgccctggggcagagcccgtcaggatcgcgcccatgtcaggcgnnacctttcgtcgcgtgcctggnnagagcactacccgtccggcgaatgcgcgtccgggttccctgctcccgatcaaaaagacttgtaaatcacttccaaaggacccctgcgggggccgaataccacccgggctgaccaagaagccccgggcgggatacccccggggctgaaacaaaagcgggcccggaaaccccttcccc

SEQ ID NO: 12042 - protein, 176 aa, Zea mays
  misc_feature: Ceres CLONE 1367996-F
  misc_feature (31)..(174): Pfam Name: DUF1210 Pfam Description: Protein of unknown function (DUF1210)
  misc_feature (82)..(82): Xaa is any aa, unknown, or other
  misc_feature (121)..(121): Xaa is any aa, unknown, or other
  misc_feature (129)..(129): Xaa is any aa, unknown, or other
MAPERMLLGVCAVLMVVGVTNAAEGQVASVVVGLARCADSTRKNMKAEAGFKGLQVAIKCKNSNGEYETKAVSEIQSSGAFXVPLARDLHGADWHAQLHSAANNAPCPGAEPVRIAPMSGXTFRRVPGXSTTRPANARPGSLLPIKKTCKSLPKDPCGGRIPPGLTKKPRAGYPRG

SEQ ID NO: 12043 - DNA, 712 bp, Zea mays
  misc_feature: Ceres CLONE 1368000-F
  misc_feature: Encodes the peptide sequence at SEQ ID NO. 12044
  misc_feature (712)..(712): n is a, c, t, g, unknown, or other
agagctggagctccccgcggtggcggccgctctagaactagtggatcccccgggctgcaggaattcgcacgagaccattacctagaacatcctaataaaaatagccattcaatcattcaagcgaagcagccaccactctctccactgtgactccgtgacctgcctgccctgctgcacaagcacagcacacacaccccgcacaccgcaccagctcagctcagctcaccaagacaatcaatcatggctcgtccgcgcagtgtcgctgccgctgcccccctcctcctgctgctcgccgccgccgcagcggggctcgtgtccgccgcgtcgccggcagccagcgacttcgtccgcaagtcgtgccgcacgacgcagtacccttcggtgtgcgagcagagcctggcgtcgtacggcgggtcgccgccgccacggagcccgcgtgagctggcgcgcgccgcgctgtcggtgagcgcggaccgcgcgcgcgcccgcgcggcggacgtggggcgcctgtgcggccgccgcaaacggcaaaggcccaaaaaaaggggttcggaatccggcgtccggcgtttggaaagtccccgggcgccaactgcccgggaaaattctggaggaacaggggtgggcccaccccccgccaacccccgcccaaaaaaaaatgggtcggccgcccggaaatggccccccgccgggagaacccccggtttttttn

SEQ ID NO: 12044 - protein, 157 aa, Zea mays
  misc_feature: Ceres CLONE 1368000-F
MARPRSVAAAAPLLLLLAAAAAGLVSAASPAASDFVRKSCRTTQYPSVCEQSLASYGGSPPPRSPRELARAALSVSADRARARAADVGRLCGRRKRQRPKKRGSESGVRRLESPRAPTARENSGGTGVGPPPANPRPKKNGSAARKWPPAGRTPGFF

SEQ ID NO: 12045 - DNA, 668 bp, Zea mays
  misc_feature: Ceres CLONE 1368003-F
  misc_feature: Encodes the peptide sequence at SEQ ID NO. 12046
  misc_feature (525)..(525): n is a, c, t, g, unknown, or other
  misc_feature (537)..(537): n is a, c, t, g, unknown, or other
  misc_feature (602)..(602): n is a, c, t, g, unknown, or other
aagctggagctccccgcggtggcggccgctctagaactagtggatcccccgggctgcaggaattcgcacgagaccattacctagaacatcctaatcaaaaaaccaaaggtatcttgcaatcacaacgaacaaaagctctcgatctcaccgacaccgaggaagaagagatcaatggcgtccgagcagggagtcgtgatcgcgtgccacagcaaggctgagtttgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtgcacgtgtacgaagtgaaggaagtcaccgcggactacgaggtcgaggcgatgccgaccttccacttcgtcaagaaacggaagacggtcgcgaccatcgtgggtgccatgaaggacgagctcctggccctgatcgagaagcatgcctgcgctgcccctgcnactgcgtctgcntaaatgacatcagatcagcccgtcgccgtcataagggacaggacgtatgggtgaaaatggtgtcnttatcagttcttgcctttgccgttggggggcaatttggaactaagaggtgtgttgttttattcgag

SEQ ID NO: 12046 - protein, 122 aa, Zea mays
  misc_feature: Ceres CLONE 1368003-F
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASEQGVVIACHSKAEFDAHMTKAQEAGKLVVIDFTAAWCGPCRAIAPLFVEHAKKFTQVVFLKVHVYEVKEVTADYEVEAMPTFHFVKKRKTVATIVGAMKDELLALIEKHACAAPATASA

SEQ ID NO: 12047 - DNA, 691 bp, Zea mays
  misc_feature: Ceres CLONE 1368006-F
  misc_feature: Encodes the peptide sequence at SEQ ID NO. 12048
  misc_feature (469)..(469): n is a, c, t, g, unknown, or other
tggagctccccgcggtggcggccgctctagaactagtggatcccccgggctgcaggaattcgcacgagaccattacctagaacatcctaatcgaaaagccgaagccgcgcgacggaaaccccaaacccaacctcatctcttttctcggcctctaccgccccctcgatcggtcggccggtcagctatgacgccgggaagctcggccgccggatccggcgtcgtcgttcctcggaacttcaggctcctagaagagcttgaacgtggagagaagggcattggagatgggacagtgagctatggaatggatgacgcagatgacatctacatgcgatcatggactggcactattattggccctcataataccgtccatgagggtcgcatctaccagctgaagttgttctgcgacaaggactaccctgagaagccaccatcagttcgatttcattcaagataaacttaacatgcngtaatcatgaaactggagtggttgacccgaagaagtcagccgtctgggtaactggcagcgtgattacctcatggaatacatcctaccccatctcaagaaagagatgacatcgccacagaaccgcaagctagttcagcctccgaaagggacattcttctaaagatggcagcaactcatgtccatccatggggactcgggaaacagcttcggcacctggttcta

SEQ ID NO: 12048 - protein, 90 aa, Zea mays
  misc_feature: Ceres CLONE 1368006-F
  misc_feature: SWISSPROT Homolog: EC 6.3.2.19 Ubiquitin--protein ligase
MTPGSSAAGSGVVVPRNFRLLEELERGEKGIGDGTVSYGMDDADDIYMRSWTGTIIGPHNTVHEGRIYQLKLFCDKDYPEKPPSVRFHSR

SEQ ID NO: 12049 - DNA, 668 bp, Zea mays
  misc_feature: Ceres CLONE 1368012-F
  misc_feature: Encodes the peptide sequence at SEQ ID NO. 12050
  misc_feature (476)..(476): n is a, c, t, g, unknown, or other
  misc_feature (534)..(534): n is a, c, t, g, unknown, or other
  misc_feature (632)..(632): n is a, c, t, g, unknown, or other
aaagctggagctccccgcggtggcggccgctctagaactagtggatcccccgggctgcaggaattcgcacgagaccattacctagaacatcctaatcaaaaatcacaattcacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctgggcgggaacgcggcgaaggacaacaagaagacgcgcatcgtcccgcgacacttgctcctggncgatcgtaacgacgttgagctcggcaagctgctgtctggcgtcaccatcgcgcacggnggtgtcctccccacatcaacccggttctcctgcccaagaaaggtgcgaagaagcgtccagcggcggcagcaggagagcaagcccctaagaagccgccnagtccccaaaaaggcagccaatcccgaaagagggtt

SEQ ID NO: 12050 - protein, 161 aa, Zea mays
  misc_feature: Ceres CLONE 1368012-F
  misc_feature (29)..(102): Pfam Name: Histone Pfam Description: Core histone H2A/H2B/H3/H4
  misc_feature (98)..(98): Xaa is any aa, unknown, or other
  misc_feature (150)..(150): Xaa is any aa, unknown, or other
MDASGAGSKAKKGAAGRKAGGPRKKSVSRSVKAGLQFPVGRIGRYLKKGRYAQRVGTGAPVYLAAVLEYLAAEVLELGGNAAKDNKKTRIVPRHLLLXDRNDVELGKLLSGVTIAHGGVLPTSTRFSCPRKVRRSVQRRQQESKPLRSRXVPKKAANPERG

SEQ ID NO: 12051 - DNA, 677 bp, Zea mays
  misc_feature: Ceres CLONE 1368013-F
  misc_feature: Encodes the peptide sequence at SEQ ID NO. 12052
aaagctggagctccccgcggtggcggccgctctagaactagtggatcccccgggctgcaggaattcgcacgagaccattacctagaacatcctaatcgaaaaaaaaaggaaattttcttgggcgttcttcggcttcattgtcacaaggttcgagttcgtcaccgtctagtacgactgtgcgaggcaggaataggcgaggagaacatgcacatcttcgtgaagaccctgacggggaagaccatcaccctcgaggtggagagcagcgacaccgtcgacaacgtcaaggtcaaaatccaggacaaggaagggattcccccagatcaacagcgactgatattcgctggcaaacagctggaggatggacgcacgctggctgactactacatccaaaaggagtcaactcttcatttgggcctcgggcttaggggtggaaccatgatcaaggtcaaaactctcactgggaaggagatcgagatcgacattgaacccactgactcgattgacaggatcaaggagcgtgttgaagagaaagaaggcattcctcccgtgcagcagaggctcatctatgctggtaagcagcttgctgatgacaagatcgcaaaggactacaacatcgagggcgggtccgtcctccatcttgtccttgctctgaggcgcggttactagtctaaacctga

SEQ ID NO: 12052 - protein, 153 aa, Zea mays
  misc_feature: Ceres CLONE 1368013-F
  misc_feature (6)..(74): Pfam Name: ubiquitin Pfam Description: Ubiquitin family
  misc_feature (82)..(150): Pfam Name: ubiquitin Pfam Description: Ubiquitin family
MHIFVKTLTGKTITLEVESSDTVDNVKVKIQDKEGIPPDQQRLIFAGKQLEDGRTLADYYIQKESTLHLGLGLRGGTMIKVKTLTGKEIEIDIEPTDSIDRIKERVEEKEGIPPVQQRLIYAGKQLADDKIAKDYNIEGGSVLHLVLALRRGY

SEQ ID NO: 12053 - DNA, 680 bp, Zea mays
  misc_feature: Ceres CLONE 1368014-F
  misc_feature: Encodes the peptide sequence at SEQ ID NO. 12054
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaaatccatctcttgtgagttctgaaccaaaactacaaaatgaattgacgatattaccctcgaccctcgaggtctcgagtcttgaccaacccatacgcacccaccctccgccgccgtttttctctccccatctcgcccgccgttttcgtccttatcgatctcctcgcacctcgtggcggcacctctccccttcgatccaccaagggtttaggatcggcggcgatggcggcgaggctggcacagctgcgcgctcaggcggtgcaggcggcggagttcgcctcgaagcacggcggctcctactacaaggagctcatggagaagaacaagcagtacgtcgtgcagccccccaccatcgagaaatgccaggagctctccaagcagctcttctacacccgcctcgcaagcctaccaggtcggtatgagtcattctggaaggagcttgatggtgtcaagcaggtatggaagaacaggaaggacctcaaggttgaggaccttgggattgcgactttatttggatttgagctttatgcatggttctgcgtangcgagattgttggcagaggtttcaccttaaccggcta

SEQ ID NO: 12054 - protein, 119 aa, Zea mays
  misc_feature: Ceres CLONE 1368014-F
  misc_feature (8)..(119): Pfam Name: ATP-synt_G Pfam Description: Mitochondrial ATP synthase g subunit
  misc_feature (108)..(108): Xaa is any aa, unknown, or other
MAARLAQLRAQAVQAAEFASKHGGSYYKELMEKNKQYVVQPPTIEKCQELSKQLFYTRLASLPGRYESFWKELDGVKQVWKNRKDLKVEDLGIATLFGFELYAWFCVXEIVGRGFTLTG

SEQ ID NO: 12055 - DNA, 712 bp, Zea mays
  misc_feature: Ceres CLONE 1368020-F
  misc_feature: Encodes the peptide sequence at SEQ ID NO. 12056
  misc_feature (363)..(363): n is a, c, t, g, unknown, or other
  misc_feature (467)..(467): n is a, c, t, g, unknown, or other
aagctggagctccccgcggtggcggccgctctagaactagtggatcccccgggctgcaggaattcgcacgagaccattacctagaacatcctaatcgaaaaagtggcgtcttcctcctcccttcgtaaccttccagacccgaccgcagcagcccggggcaacaagcgaaccggcggcagcgatggggatcggtgagcacttcgagggcgtcaagcagcactgggcgagcaacttcgccttcctcgactacttcaagaaggtctacggccgcgccgagcccctccccaagtggtccgacgccgacgtcgacgagttcatcgccttccgacccggtctacgggccccagctcaaggccctgcggnagtcgaggaaagtcgcgctcgccggggccctcgtcggcgccgcccacctcgcggcgtcgcgctcagtactccaaggcgccggacggggtcctgctggcgacggncttcggggcgatcaccgggggccgggctgggatctgagggggcggaaccactggtaacaagctccacgaaatggacaaagaaggggggccaaccctccggttcatcctacggggggggaaggaaaagggcctccgggccaaaaaagctgaaaccccttcggggggggggcctttttttagtggggcaccccccgggggaaaacaaaaaaattgtggcgctccctcgggcgcgaggtttatttttt

SEQ ID NO: 12056 - protein, 177 aa, Zea mays
  misc_feature: Ceres CLONE 1368020-F
  misc_feature (61)..(61): Xaa is any aa, unknown, or other
  misc_feature (96)..(96): Xaa is any aa, unknown, or other
MGIGEHFEGVKQHWASNFAFLDYFKKVYGRAEPLPKWSDADVDEFIAFRPGLRAPAQGPAXVEESRARRGPRRRRPPRGVALSTPRRRTGSCWRRXSGRSPGAGLGSEGAEPLVTSSTKWTKKGGQPSGSSYGGGRKRASGPKKLKPLRGGGLFLVGHPPGENKKIVALPRARGLFF

SEQ ID NO: 12057 - DNA, 707 bp, Zea mays
  misc_feature: Ceres CLONE 1368066-F
  misc_feature: Encodes the peptide sequence at SEQ ID NO. 12058
aaagctggagctccccgcggtggcggccgctctagaactagtggatcccccgggctgcaggaattcgcacgagaccattacctagaacatcctaatcgaaaaataattctattctccataccgctctcttctccctcgtctcgttcagcaaccactcccgtggacacggcaaggcagggccgggcctctgcgcacggcgtccggccggctacaacccctagccgtggccatggcggcggccagccccgccccccagtcgacctcggctctccggtgagctgccctccatgtcctggccgctcagtcgctcgccgtgccgaatcgcccaggaagatctgcgatgctctcgtcgttgccgagactgtgatccatttccgagcttcgaggaatcgacgatcaagcttcgacgatcaaatgacccagctctttgagttctacaaggctgaagatcctgagcatctgttctgccgaagttgcctttggggcacccacgctccggtaaaccaaaaggcgtcgaggggggatccccaggaattcccgggacttcgaccgagttcgaaggataaggctagccgaccctcccccaataagctggcctgtgggggggtcaaattcaccccgggcctacctctttctatcctggggtacctctgctttatttttattgttaaatgggactctaagcccccctaaacacctattgacct

SEQ ID NO: 12058 - protein, 230 aa, Zea mays
  misc_feature: Ceres CLONE 1368066-F
KAGAPRGGGRSRTSGSPGLQEFARDHYLEHPNRKIILFSIPLSSPSSRSATTPVDTARQGRASAHGVRPATTPSRGHGGGQPRPPVDLGSPVSCPPCPGRSVARRAESPRKICDALVVAETVIHFRASRNRRSSFDDQMTQLFEFYKAEDPEHLFCRSCLWGTHAPVNQKASRGDPQEFPGLRPSSKDKASRPSPNKLACGGVKFTPGLPLSILGYLCFIFIVKWDSKPP

SEQ ID NO: 12059 - DNA, 694 bp, Zea mays
  misc_feature: Ceres CLONE 1368067-F
  misc_feature: Encodes the peptide sequence at SEQ ID NO. 12060
  misc_feature (563)..(563): n is a, c, t, g, unknown, or other
agagctggagctccccgcggtggcggccgctctagaactagtggatcccccgggctgcaggaattcgcacgagaccattacctagaacatcctaatcaaaaacagaagcttccggaagccagcccaagccatgaacgccgccagcaccgccgccgcggcccccgcgcctgccgcgaccgtgcaggtgccgcgcgggcaggtggatctgatcgacttcatcgactggaccggcgtcgagtgcctcaaccaggactcgtcccacagcatcgtcaacgcgctcaagcagagtttgagagacgacgaggggctgtacctcgccagcgattcggacgagcagctgctgatctacatccccttcatgcaggtagtcaaactgcattccgcgctattcaaaggtcccgaggaagagggccccaaaacagtaaaactcttctccaacaaagagcatatgggtttcaccaatgtcaatgactatccaccaagtgacaccctcgagctatcatccatcatttgatagagaataaacttttgccactaaagtatgtcaagtttcaaaatgttcncagtcctgactatatttatttgggaccaccaaagtggaagtgatgtctccagaattcacaagattgctcctttatggaccactgtggacaccacaaatattaacgatctgaacaaaataaaaaacccctga

SEQ ID NO: 12060 - protein, 127 aa, Zea mays
  misc_feature: Ceres CLONE 1368067-F
  misc_feature (57)..(128): Pfam Name: DUF1000 Pfam Description: Domain of Unknown Function (DUF1000)
MNAASTAAAAPAPAATVQVPRGQVDLIDFIDWTGVECLNQDSSHSIVNALKQSLRDDEGLYLASDSDEQLLIYIPFMQVVKLHSALFKGPEEEGPKTVKLFSNKEHMGFTNVNDYPPSDTLELSSII

SEQ ID NO: 12061 - DNA, 619 bp, Zea mays
  misc_feature: Ceres CLONE 1368068-F
  misc_feature: Encodes the peptide sequence at SEQ ID NO. 12062
  misc_feature (390)..(390): n is a, c, t, g, unknown, or other
  misc_feature (461)..(461): n is a, c, t, g, unknown, or other
  misc_feature (476)..(476): n is a, c, t, g, unknown, or other
  misc_feature (563)..(563): n is a, c, t, g, unknown, or other
aaagctggagctccccgcggtggcggccgctctagaactagtggatcccccgggctgcaggaattcgcacgagaccattacctagaacatcctaatcgaaaaccgcacgccgttttccccatctcgcgcagcgctactgccggctgtcccgagtcccgaccaccgtcctccgcggctccgctccccgccgtgaatccttcctcctcccgcgatggagaccttcccgttggtgaagaacatcctcctactggactccgaggggaagcgcgtcgccgtgaagtactacagcgatggctgggccctactctctccgccgaaagctgggccttccaagaaagccgggtcttccccccaaaaacccccaaaaagcgaaaagggtgggaaacccgntttccgaaaaaaaatttgttaggggtttttttggggcccaaaaaaaaagggggggggaaaaaaaaaaaaantttttttttttttgnaaaaaaaaaccccccctcttttttttttttttttttcagaaaaaaaaaaaaaaaaaaagaggtttttttttttccccccctctcccnccgaaaattctttcgtgggggggggcgggggccccctccctcccccaaaagaaggg

SEQ ID NO: 12062 - protein, 66 aa, Zea mays
  misc_feature: Ceres CLONE 1368068-F
  misc_feature (60)..(60): Xaa is any aa, unknown, or other
METFPLVKNILLLDSEGKRVAVKYYSDGWALLSPPKAGPSKKAGSSPQKPPKSEKGGKPXFRKKIC

SEQ ID NO: 12063 - DNA, 717 bp, Zea mays
  misc_feature: Ceres CLONE 1368069-F
  misc_feature: Translation starting site: 209
  misc_feature: Pfam Name: IF4E Pfam Description: Eukaryotic initiation factor 4E
  misc_feature (717)..(717): n is a, c, t, g, unknown, or other
aaagctggagctccccgcggtggcggccgctctagaactagtggatcccccgggctgcaggaattcgcacgagaccattacctagaacatcctaatcgaaaagacgcgtctcttccacagccgcaacctctatccctcgtctggtatcgtctcccacacccctctgccccaactcagaaaaaccctcgaaaagcggcggcggcgcgacatggcggaggtcgaggctccagctgctgcggttgcggcggcgacccctgaggtggcgacggtgaccgagggcggagccgctacggaggcgaagggtccgcacaagctgcaccgccagtggaccttctggtacgacatccagtccaagcccaaacccggcgctgcgtggggcacctccctcaaaaggcgtacaccttccacaccgtcgaggaggtttggggcttggatgatcatgttttccgcccaagcaaggtgcctgggaatgttgaatttcccctaatttcaggctgggggcaaagcccaaatggggaaaaccccaaggggggcaaaggggggggaaaagggatggtcccctggaaacaaaaagccaccctttgaaaaccggggggcttgaaacctctaagggcctcttttggggggaaaccctttataaaaaaaaaaaacctttttgggaaaatgtgttccacagggcccacccaaaagagaaaaaataatcctttttgggcgaan

SEQ ID NO: 12064 - DNA, 685 bp, Zea mays
  misc_feature: Ceres CLONE 1368070-F
  misc_feature: Translation starting site: 348
  misc_feature (387)..(387): n is a, c, t, g, unknown, or other
aaagctggagctccccgcggtggcggccgctctagaactagtggatcccccgggctgcaggaattcgcacgagaccattacctagaacatcctaatcgaaaaaccgccgactcgaacagtcgaacctcggctcccctcctccccaatccgtcatcttccttctacacttgtttctgcgggagcgggagagaaggcaccagggaggccgcccccgtcacccatagccaaagtcacgcgccaccaaactttgttctctcacccagtcgctttcgcgttcagcgcgagccgagcccagccggtgggtcggtcgctgaaggcggagccataaaggcgtcggcgacggcaggatgatgagcggcaaatcgggcggcagggacggcgaggcgnccggccccgtcatcaggatcagggtttcccacgaagccaactcccgcgaagtcgtcgtgccggcgcaggctacctttcggggagtgaaaaaggatccttggtcaaactactgccttgaaacctgaaaggaaaagctcttttttccggggaaggggaaaaaaggacgaaaattccccccccccggaaggggttaaggatgggcccaaaattgccttttgccttggaaacccttcccccggccaaaaaaaaaaaaaagggtgggccctggtatttttggatataaaaccggtttaaaagc

SEQ ID NO: 12065 - DNA, 689 bp, Zea mays
  misc_feature: Ceres CLONE 1368071-F
aaagctggagctccccgcggtggcggccgctctagaactagtggatcccccgggctgcaggaattcgcacgagaccattacctagaacatcctaatcgaaaaatccatcaagatgtgcgggtgcggcagatattctcctccctcggctaggtgactttggaggggcgaccagggacggtgcgagcgatgtccgcatacgaatccgatgccgtcacggagatcggcgccggccagattgttatggcgctcctcatcgcggaggagatgctccggcgacaacgatgacatgtaccactggaatagcattgactctcgcacggggaagtgccgagacgagagacgctatagaaactttcaccgaatccaaaaatgcgaaagcctcttgcggcgacgctgatgtacagtgcaacaactatggcctcggcgagtgattcgaggaactgtcggccatctgctaccaccagtagagatttgatgaagaagcatctgcgtccctcccgtgaacaaagacaaaactacgccgctgaagagctgtagcgactagtgttacaactacgagccgacagcgcctgcgaactggcacgaagcataggacccaatgcctgatgcacccagacgccggaacctattattaacctcatgcgccgagacaaagacaccatgccaaggcgccgcatcgccacagagtc

SEQ ID NO: 12066 - DNA, 777 bp, Zea mays
  misc_feature: Ceres CLONE 1368072-F
  misc_feature: Encodes the peptide sequence at SEQ ID NO. 12067
  misc_feature (164)..(164): n is a, c, t, g, unknown, or other
agagctggagctccccgcggtggcggccgctctagaactagtggatcccccgggctgcaggaattcgcacgagaccattacctagaacatcctaatcgaaaaatcaactcgcaattccgcattcgttccaactcctgagcactttctcctcgtccccgataagncaatcgaagccgagatacggccatggactccaccggtaccggagcacggggtaaggggaagaagggagcggccgggcgcaaggtcggcggctcaaggaagaagtcgcggtctaggtacgtgaaccgcgtcctcctttcccccgtccccccgatccgggggctacttggaaaaagggtcgctaacgcgcaccggggccgcaccccgggccccccgcttaaccccgcggttgtcccccaaaacccttcccgtttggccctttttgacactttttgggcaagtggtcccccgcccacccccacacaaatcccccccctttttctcccttccccccccccttttgttccccccctcacaccaccccaccaattttgtaaccaccctctttcccccctttaaccccccttcttccccggcggggggggctcgcgccaaataccaccccgctgtccccgcttcccaaaaaaaccgttgggcaaaccagcccacccgcgcgccgcgttacagtcgtgccctaccgccccccattataactgtcttcccgacctgctccagcgaagagtaacagacagtgcccgcgcgacgagattcccctttatctgcagactaagtccc

SEQ ID NO: 12067 - protein, 124 aa, Zea mays
  misc_feature: Ceres CLONE 1368072-F
MDSTGTGARGKGKKGAAGRKVGGSRKKSRSRYVNRVLLSPVPPIRGLLGKRVANAHRGRTPGPPLNPAVVPQNPSRLALFDTFWASGPPPTPTQIPPLFLPSPPPFVPPLTPPHQFCNHPLSPL

SEQ ID NO: 12068 - DNA, 722 bp, Zea mays
  misc_feature: Ceres CLONE 1368073-F
agagctggagctccccgcggtggcggccgctctagaactagtggatcccccgggctgcaggaattcgcacgagaccattacctagaacatcctaatcgaaaaatcgctattctctccactcatcttttcgggattagaacctctaaactatcccacactcgctagtcggggaagcacctgtagtcatggacgccagcgtatccggcagcaaggtaaagaagggtgccatcgggtgcaaggcattcgcccccaggaacaagcggtagaccgaaccatatagggcgccctgcattctgcgacaggcgaatcgggcgctacctaaaaaccgccggctacgacaacgcgttgctactggaccccccgtctacctgggcgacgtcctggaaacttcaccaaaaaggaaccgcatccgtaaggaaacggggtgatatgaccccaaaaacacgaggatccttccgccgcctcggggcccttgttggatccccaaacaaagaaggaatccgtaaaaattggtggaaggggggattcaaccgggaacgcgttgggacctcccccaaagaccccccccatgttcccgccccagaaaaaagaaaaaaaaaaggggccctgggccccccaaaaaaaaaaccaaaaacccccccaaaaaagcgcgcccacccccccctaataagcttttaaaaaaaagggaccctcctttggaacgggggcccccaaaaaaaaag

SEQ ID NO: 12069 - DNA, 623 bp, Zea mays
  misc_feature: Ceres CLONE 1368074-F
  misc_feature: Translation starting site: 217
  misc_feature (274)..(274): n is a, c, t, g, unknown, or other
  misc_feature (278)..(278): n is a, c, t, g, unknown, or other
  misc_feature (282)..(282): n is a, c, t, g, unknown, or other
  misc_feature (310)..(310): n is a, c, t, g, unknown, or other
  misc_feature (317)..(317): n is a, c, t, g, unknown, or other
agagtggagtccccgcggtggcggccgctctagaactagtggatcccccgggctgcaggaattcgcacgagaccattacctagaacatcctaatcgaaaacccggcagtcacacctcgaaagcaacagaagtcagaacctacctagctagagctatcactatatcagtatcaggtacctagacctagcagcagccacacccacaccgtacgtcggcatggctaggtggtcgtcgtcagctctggtcgccgtcctcgtgggcctggccgcggcgntggngtgntccggggggcgcccccgtccccgggganaaaaaanaagggggaaaaggacgtgaagcggccggaaaccttgaccaaggggacggggttaatcccggggaaggggggctaacaaaatcgggaacccataaattccgggaattcggggggttgggacccaaaatttcccccgccccccccagggaaaatttccccccccggggccaaaaaaaacttgggggggcccaacccggggttttggggggcccaccccccttttttggggggggggggggcccctcccctgaaaaaaaaacccccccgggggggaagaaggggggctccccccgcaaaaaataaaaat

SEQ ID NO: 12070 - DNA, 724 bp, Zea mays
  misc_feature: Ceres CLONE 1368077-F
  misc_feature: Translation starting site: 124
  misc_feature (234)..(234): n is a, c, t, g, unknown, or other
  misc_feature (242)..(242): n is a, c, t, g, unknown, or other
  misc_feature (243)..(243): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (271)..(271): n is a, c, t, g, unknown, or other
  misc_feature (422)..(422): n is a, c, t, g, unknown, or other
  misc_feature (465)..(465): n is a, c, t, g, unknown, or other
  misc_feature (467)..(467): n is a, c, t, g, unknown, or other
  misc_feature (468)..(468): n is a, c, t, g, unknown, or other
  misc_feature (524)..(524): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (661)..(661): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
agagctggagctccccgcggtggcggccgctctagaactagtggatcccccgggctgcaggaattcgcacgagaccattacctagaacatcctaatcgaaaatccactacacacaaacacacaatggcaccagaaaggatgctcctcggcgtctgtgccgtgctgatggtggtcggcgtcacgaacgcggcggagggccaggtggcgtcggtcgtcgtgggccctggcgaaggntgcgccgnnacccagnnnnnnccaccgaagggggggnaaaaaaaaatgaaggggctgagggcccggtttcagggggctttccggggggggggaaccaaggggcaaaaaaaaccggaaaacgggggggggtgttcccccagacaaaaacagggggccccccggggagagggggaaaaaacccccccccnaaaaaaaggtttctccccgggaggagccttttttcttaaaaananncccccccctcctctgaggcggcgcgcgcgacaccccccctccagagggggcgcccnaaaagggggtggtcgcccccgccgcggatttttttttcttccctacaaagggggcgcgcgccccnnnnnnnaaaaaaaaaannnnnngggnnntgtcacgatagcnnnnncggtgggagagagagagaggggagagnagcgcgggcagaggaggagaagagnnnncccggcgcccccgccggcgtgtgtgggggggtaga

SEQ ID NO: 12071 - DNA, 665 bp, Zea mays
  misc_feature: Ceres CLONE 1368079-F
  misc_feature: Encodes the peptide sequence at SEQ ID NO. 12072
  misc_feature (483)..(483): n is a, c, t, g, unknown, or other
  misc_feature (504)..(504): n is a, c, t, g, unknown, or other
  misc_feature (517)..(517): n is a, c, t, g, unknown, or other
  misc_feature (537)..(537): n is a, c, t, g, unknown, or other
aaagctggagctccccgcggtggcggccgctctagaactagtggatcccccgggctgcaggaattcgcacgagaccattacctagaacatcctaatcgaaaacaaaaccaaaagcagaggggaaagtgccgtcggctctgactcttgggcacttggctgacgacccgttctctctctgcaactgcaactgcaacgcaccaagaaactgccggcgatcgatcggggaaggagataaacatggtgcacgggaagctggaggtcctcctcgtctccgccaagggactcgaggacaccgatttcctcaataacatggaccccttcgtgatccttacctgccgcacccaagagcagaaaagcagcgtcgcaaatggagcaggaagcgagcccgaatggaacgagaccttcgtcttcaccgtctccgacgacaccccgcagctgcacctcaagatcatggacagcgacctcaccaacgacgatttcgtncgcgaagcaccatccccctgnagcccgtgttcanggaagcagcccttcccccgncggtcacctgttcgtcaggaggaaaagtactgccggaaagtcaaggtcgccctcaccttcactcaggagggaaaaccggccgccttgatgcaacgaggaggggcccgcttaaagcagcttgaattgaa

SEQ ID NO: 12072 - protein, 142 aa, Zea mays
  misc_feature: Ceres CLONE 1368079-F
  misc_feature (6)..(86): Pfam Name: C2 Pfam Description: C2 domain
  misc_feature: SWISSPROT Homolog: EC 3.1.1.4 Phospholipase A(2)
  misc_feature (89)..(89): Xaa is any aa, unknown, or other
  misc_feature (94)..(94): Xaa is any aa, unknown, or other
MVHGKLEVLLVSAKGLEDTDFLNNMDPFVILTCRTQEQKSSVANGAGSEPEWNETFVFTVSDDTPQLHLKIMDSDLTNDDFVREAPSPXSPCSXKQPFPRRSPVRQEEKYCRKVKVALTFTQEGKPAALMQRGGARLKQLEL

SEQ ID NO: 12073 - DNA, 718 bp, Zea mays
  misc_feature: Ceres CLONE 1368080-F
  misc_feature: Encodes the peptide sequence at SEQ ID NO. 12074
  misc_feature (394)..(394): n is a, c, t, g, unknown, or other
  misc_feature (397)..(397): n is a, c, t, g, unknown, or other
  misc_feature (433)..(433): n is a, c, t, g, unknown, or other
  misc_feature (438)..(438): n is a, c, t, g, unknown, or other
aaagctggagctccccgcggtggcggccgctctagaactagtggatcccccgggctgcaggaattcgcacgagaccattacctagaacatcctaatcgaaaagcgcatcctaccaggagggtgggagacccaggcagcggaggtgtgcgaagctcgcttcgcaccacgcgctgcggcctgcgggggagagatcgaggcctgagctagggtctggtggcggagatgtcgacgccggcgaggaagcgcctgatgcgggacttcaagcgccttcagcaggacccgcccgccggcatcatcggcgcgccgtacgacaacaatatcatgctctggaacgccgtcatattcgggccggatgacacgccgtgggatggagggcacgtcaagctgactctgncanttacagaagattacccccacaaaccctccaactggntcggnttggttcgagggatgttcatccaaacatctatgcggatggaagcatctgggttgaacatcctacaaaaccagtggaagcctatatatgatgttggcggcaatatttgaccctcctattcagcccctggctgggggacccaaacccaaattctcttgtatactcttgagcaccccaaaagggtccgcgagaaacaagggggagtacaacccgcaaaattccggagaggtttgggaacaaaaattgggaccccccacaaaaaacttttacccctttccccgg

SEQ ID NO: 12074 - protein, 107 aa, Zea mays
  misc_feature: Ceres CLONE 1368080-F
  misc_feature (8)..(108): Pfam Name: UQ_con Pfam Description: Ubiquitin-conjugating enzyme
  misc_feature: SWISSPROT Homolog: EC 6.3.2.19 Ubiquitin--protein ligase
  misc_feature (58)..(58): Xaa is any aa, unknown, or other
  misc_feature (59)..(59): Xaa is any aa, unknown, or other
  misc_feature (71)..(71): Xaa is any aa, unknown, or other
MSTPARKRLMRDFKRLQQDPPAGIIGAPYDNNIMLWNAVIFGPDDTPWDGGHVKLTLXXTEDYPHKPSNWXGLVRGMFIQTSMRMEASGLNILQNQWKPIYDVGGNI

SEQ ID NO: 12075 - DNA, 689 bp, Zea mays
  misc_feature: Ceres CLONE 1368087-F
  misc_feature: Translation starting site: 195
  misc_feature (416)..(416): n is a, c, t, g, unknown, or other
aaagctggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatcgctctctcgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcgggacgttactccaagaagcggttccgcaaggcgcagtgcccgatcgtcgagcgcctcacaaactcgctcatgatgcancggcgcaacaacggcaagaagtcatggctgtccgcatcatcaagcataccctggagatcatccacctgctcaccgatgccaccccatccaggtcgtcgtcaacgcgatcataacaggggaccccgggaggatgcccccggatgggtccccctggggttggaggaggcaggccctgaaattcccccccctaagaggggaaacaggtcattttcctcccccccattggggcgagggaaagggtttttccgaaaataaaaactttggcgagggctt

SEQ ID NO: 12076 - DNA, 723 bp, Zea mays
  misc_feature: Ceres CLONE 1368088-F
  misc_feature: Encodes the peptide sequence at SEQ ID NO. 12077
  misc_feature (442)..(442): n is a, c, t, g, unknown, or other
  misc_feature (459)..(459): n is a, c, t, g, unknown, or other
agagctggagctccccgcggtggcggccgctctagaactagtggatcccccgggctgcaggaattcgcacgagaccattacctagaacatcctaatcgaaaagactgtctgccctgtctgcaggcactcgtcttcttcctggagagaaaaagcagaagacaatacaaagatgtccaagatggcggaggagaaggcggcggcagtgggcggactcggaggagccggggcggcggacgcggcgcagcagcagcagctggcagcaggggaggccgcggcggctcgggtgcggcccgtggaaacgctgcttcgcgcggcaccgctggggctctgcgtggccgccatgaccgtcatgctacgtaaccagcagagcaacgagtatgggcgcgtccgctactccgaccctgggaggtttcagtacctcgtctacgccaacggcctctgncggcgctactcgctggnatcccgcgttctaccctgccgtggccgagggcctgccaccgtggcgcggctcctgggtcgtttccctccttcaacaaggggtccccgtacttgattctgggggggggggcccaagggggggggaacttgtttaacccccctaacacggggacaaggggggggccgcgggaggaaactttgggggttttttgaaagttttggcccgagggggggaccacccgggaccaaaacctttgggaaccgcccttttttttctccctcgcc

SEQ ID NO: 12077 - protein, 127 aa, Zea mays
  misc_feature: Ceres CLONE 1368088-F
  misc_feature (91)..(91): Xaa is any aa, unknown, or other
  misc_feature (97)..(97): Xaa is any aa, unknown, or other
MSKMAEEKAAAVGGLGGAGAADAAQQQQLAAGEAAAARVRPVETLLRAAPLGLCVAAMTVMLRNQQSNEYGRVRYSDPGRFQYLVYANGLXRRYSLXSRVLPCRGRGPATVARLLGRFPPSTRGPRT

SEQ ID NO: 12078 - DNA, 685 bp, Zea mays
  misc_feature: Ceres CLONE 1368090-F
  misc_feature: Translation starting site: 486
agagctggagctccccgcggtggcggccgctctagaactagtggatcccccgggctgcaggaattcgcacgagaccattacctagaacatcctaatcgaaaaaacttgctctgaacgcattcctcccatctcccaagacctcctcagacccgagaagcgcagctgcggacatggacgccaccgggactggagctggagggaacgcaaaagaatggagcgggcggtcgaaaggccggcgcgccgaggaagaagtcggtgacgaggtccgcgaaggacgttctccagttccccgtcggacggatcggacgctaccgcaagaaggggcgctacgcgcagcgcgccagaagcgtggcccccgtctacctcacgtgcgccctgtagtacctcgccgctgaggtcctgcagtctcgccggcaacgctgccaaggacaacaagaagacgcgcatcgtcccgcgccacgtgctgctggcgatccgcaacgaccatgagctcgatgaagctgctgactggcgtgaccatcgcccacggtgggatgttgccccacatcgacccagtcctgctgcccaagaagacgcttgagaaggcgtccagcgtgcgtagctaggacgtcaagtcgccccatcaagtcgccaagtcccccaagaaagcatagggttcgggagacgaatgccgatgttgtcatgt

SEQ ID NO: 12079 - DNA, 701 bp, Zea mays
  misc_feature: Ceres CLONE 1368091-F
  misc_feature: Encodes the peptide sequence at SEQ ID NO. 12080
  misc_feature (676)..(676): n is a, c, t, g, unknown, or other
aaagctggagctccccgcggtggcggccgctctagaactagtggatcccccgggctgcaggaattcgcacgagaccattacctagaacatcctaatcgaaaatttccttgccgccagccagcccattaaccctcgttcctgtcgcgcagtcacgacctccacttccacatctcccccggggtcggcgcggtcagttgaaccatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggaccccaacaccatctttgtcttcaagttccgcacccacttcggaggaggaaagtccactggtttcggcctcatctacgacaacctctaggctgccaagaagttcgagcgcgaataccgcctcatcaggaatggtcttgctactagggttgagaagtcccgcaagcaaatgaaggagcggaagaacagggccaagaagatccgtgctgtcaagaagaccaaagctggtgacgccaagacaaagaaacgtccgtttacatctgaattactgctctgcgctctgagtggtctagctgcaatgtcataanttatgcgcgtgtaggttttgtgccc

SEQ ID NO: 12080 - protein, 85 aa, Zea mays
  misc_feature: Ceres CLONE 1368091-F
  misc_feature (28)..(85): Pfam Name: Ribosomal_S24e Pfam Description: Ribosomal protein S24e
MADSKATSAVTLRTRKFMTNRLLARKQFVLEVIHPGRANVSKAELKERLAKAYEVKDPNTIFVFKFRTHFGGGKSTGFGLIYDNL

SEQ ID NO: 12081 - DNA, 666 bp, Zea mays
  misc_feature: Ceres CLONE 1368092-F
  misc_feature: Encodes the peptide sequence at SEQ ID NO. 12082
aaagctggagctccccgcggtggcggccgctctagaactagtggatcccccgggctgcaggaattcgcacgagaccattacctagaacatcctaatcgaaaaatgttctctggaaaacacacacacacacacacacacagacacacacacacactgacacacacacatcgattgctgttgcaacaaagctctacacgacaacacaggctgcttctttcttgcagtctctggtccagaagcctgaagaaatggcgtcacccaacgccacattccttgccttcttcgtggtcctcgcactatcggcgcttcacaccgacacagcaacggcggtggcagaaaccttgtaccataggagcgacacatgcagcgtggccaagccgacgacgcaggacgcgacgctgcgaggcaacctgtagttcgcctgctccgagagcgactgcggcgccatccagggcaccggcgcctgctcccagcccgacagcctgctgtcgcgggcgtcgcagcacatgagcgcctactaccagacccaggggatgaactctaggaactgcttcttcatcggcaccggcataatcaccatcactgaccccagccttgacacctgaaaatatgcttgacacgacgaactgctctgctgctgctgcgctcaacggactatgaatacgg

SEQ ID NO: 12082 - protein, 55 aa, Zea mays
  misc_feature: Ceres CLONE 1368092-F
MASPNATFLAFFVVLALSALHTDTATAVAETLYHRSDTCSVAKPTTQDATLRGNL

SEQ ID NO: 12083 - DNA, 678 bp, Zea mays
  misc_feature: Ceres CLONE 1368093-F
  misc_feature: Encodes the peptide sequence at SEQ ID NO. 12084
  misc_feature (358)..(358): n is a, c, t, g, unknown, or other
  misc_feature (370)..(370): n is a, c, t, g, unknown, or other
  misc_feature (403)..(403): n is a, c, t, g, unknown, or other
  misc_feature (527)..(527): n is a, c, t, g, unknown, or other
  misc_feature (546)..(546): n is a, c, t, g, unknown, or other
aaaagctggagctccccgcggtggcggccgctctagaactagtggatcccccgggctgcaggaattcgcacgagaccattacctagaacatcctaatcgaaaagttctgtttgttgtttttcttctcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagatagggctgataaagctaattactcctacaataatgatggagagaagagcaatgttccttcattaaagaaccttcctccanttgtcatcatgnaacattctttcagcatgttcagaatgactaccnatcaacaggattagtgcctttggagggatgttctgccagtgaggcttcccgctcctcagtgatcgctggactggtgcaatccacttggacaatgaccaaccattggccccctcaaaaaaccggntatgaattctggaatctancaccttcttcagggggtcccctgaaagctccccccccaaagagactttccccgaggaattcccccggggaagggaccccttaaacagaattttgggccccctgggcgccccttgggaaataatccaaagccc

SEQ ID NO: 12084 - protein, 71 aa, Zea mays
  misc_feature: Ceres CLONE 1368093-F
  misc_feature (53)..(53): Xaa is any aa, unknown, or other
  misc_feature (57)..(57): Xaa is any aa, unknown, or other
  misc_feature (68)..(68): Xaa is any aa, unknown, or other
MSSSGPLPAGTHQTRNRAGNRRKSGDRADKANYSYNNDGEKSNVPSLKNLPPXVIMXHSFSMFRMTTXQQD

SEQ ID NO: 12085 - DNA, 704 bp, Zea mays
  misc_feature: Ceres CLONE 1368095-F
  misc_feature: Translation starting site: 187
  misc_feature (321)..(321): n is a, c, t, g, unknown, or other
  misc_feature (531)..(531): n is a, c, t, g, unknown, or other
agagctggagctccccgcggtggcggccgctctagaactagtggatcccccgggctgcaggaattcgcacgagaccattacctagaacatcctaatcgaaaaacacgcgaatcctcaaatctgcccttgccgccgccactgcccgatccaggtgtgcagactgctccctcctcctctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggnaccgtcgcgctccgcgagatccgcaagtaccagaagagcacggagctgctcatccgcaagctcccctttccagcgctcgtccgcgagatcgcgcaggacttccagacggaacctgcggttccagccctccgccggtggcggggctgcaggaggccgccgaggcgtacctggtgggcgtcttggaggacaccaccctctggggcattccgncaaaagggtcccccttcttgcccaaggaattcaaattccgcccgcccaattagggggaaaaagggtttaaactttccccccctcttggttgtcccccctgaaaaggcccaaaaaaaaaaggggggggggggcttttctttggccgggcctattttgggtattttccgaacggg

SEQ ID NO: 12086 - DNA, 700 bp, Zea mays
  misc_feature: Ceres CLONE 1368096-F
  misc_feature (382)..(382): n is a, c, t, g, unknown, or other
aaagctggagctccccgcggtggcggccgctctagaactagtggatcccccgggctgcaggaattcgcacgagaccattacctagaacatcctaatcaaaaatcacagctagctaccatacatgcgaataatctcttcgtcacctcactaacagcagctagcaactctttctctcctgcaataatggccgctcgctcctcctcctcccagccgcagctggtctgcggaggcggcgctactggcagaggaactgctgctgctggcaggccggtccgagacgcttccggcggcgatgagctgcagcgaggtgacgtcgactacgacgacaagcctctgatacacaatgagaagtgcggagtcttcatcgtcgcagtgctcgacnacgtcgagctcgctcacagccaggggacgtccacagcgcaccgaaaagccacctgtacttgctcaagagcatgacgggactgctcgcatgggggggtagaattgtcaacgcggcaaagtccccggaagtgcgggtccccgaaggggggcccatatcccccgctccccttgccaaaaatcttttgaaaacggtacccaagggcccctatccctcctcctaaaaccccccggagggggcccaaaaaaaaggggggggccggagaaaaaaaaagggcccaaaaacaggtttgtggggcccaaaaaccccccccaacaagaa

SEQ ID NO: 12087 - DNA, 703 bp, Zea mays
  misc_feature: Ceres CLONE 1368097-F
  misc_feature: Encodes the peptide sequence at SEQ ID NO. 12088
  misc_feature (572)..(572): n is a, c, t, g, unknown, or other
  misc_feature (612)..(612): n is a, c, t, g, unknown, or other
agagctggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactaggctaggttagccttttaatcgtcgtcgagaagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggaaaagaaggacgacgcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagcctacccgggttcagcttgcccggcagcggcagcatgcccctcttcggcgncggcgtccccggcttcagcggcttcggcggcatgcccggntcgcccacgccgggtccgtccccgaggacggccacaagcctgaacgccaacaaagcgtggtagaagagtggtgctactggtactggaagac

SEQ ID NO: 12088 - protein, 134 aa, Zea mays
  misc_feature: Ceres CLONE 1368097-F
  misc_feature (101)..(101): Xaa is any aa, unknown, or other
MARSSKMMVAAALLALALAVSTAEARNIKTTTTEKKDDAVVQPQTFPPFDRLGGGASPAFGGLPGGSIPGSSIPGFSMPGSGSSLPGFSLPGSGSMPLFGXGVPGFSGFGGMPGSPTPGPSPRTATSLNANKAW

SEQ ID NO: 12089 - DNA, 871 bp, Zea mays
  misc_feature: Ceres CLONE 1368098-R
tgggaccgggccccccctcgaggtcgacggtatcgataagcttttttttttttttttttggtcaatgggaaaaatacccgatttagccgctaggcacatggtggatggaccattcatcattccaagattttaccaaatcacaacaaaaaaaaaaagtcacgttcgattcgttattccaagaattactaaacaggcacgttcgttcttccaccattccaagaattacttgaatcgaacaggcgatcgggtgacgaatcgaaccaccgagtcctgcggattcctgacaccggaggacctcacttgacgccgcggccaatgaagcctaaaggcggctcgcgcgcttcggcggtctccgtggcaaggtcccccgccttcaaaatcgcttcccagagcaccataacgcccataagctgctcgctgctggggctctgctcgtcaccgtcgccggggctcgtccagagcccaaaggacctcgcctccgcgcaagtggccccaggcaagctccagggcgtcctgtacccccgtgggccaactccccccgcgttcgctaactttctctggggaaacccaaaaacccggtgtcccccggggaaggcgggccccgcaggtaaaacagcgggactgggggatggggtggcccgcccccggaaccccaagggggtgggcccccgcccccgggtggtaaaccgcgaaggcgaacatccctctaaggggcccctcaaaactcgaacccggaaacccttccggaaaagggccccgggttaacggcccctgtgtcttttaagttgggcgtttcaaggaaaaaaaaaaccctcgaagaataccccctcgcgaaacggggaaccccggcttaggcgccccacccccccct

SEQ ID NO: 12090 - DNA, 617 bp, Zea mays
  misc_feature: Ceres CLONE 1368099-F
  misc_feature (352)..(352): n is a, c, t, g, unknown, or other
  misc_feature (361)..(361): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
aaagctggagctccccgcggtggcggccgctctagaactagtggatcccccgggctgcaggaattcgcacgagaccattacctagaacatcctaatcgaaaaacacactaatcaacaagcaggaccagctagctagctcctctcactgctatcacccgcccagccatctcgctgaaagagaaaagcgcagccatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaaccccagcgagagcaancaacccaantggcttcgcaaaaaccgcttggaggggggcccccttttcaccccgggggggggggaaacccccaccccccccacaaaaggggggcccccccccggggggggttcccccccaggagggggggggaacaaataaaacccccccttttgtttccccccccccaaaaaaaaaaaaaaccccccccgggagagnnnnttcccttctttttttttttaaaaaaaaaccccccccccccccgcccnnnccccccgaggaggag

SEQ ID NO: 12091 - DNA, 753 bp, Zea mays
  misc_feature: Ceres CLONE 1368104-F
  misc_feature: Translation starting site: 165
agagctggagctccccgcggtggcggccgctctagaactagtggatcccccgggctgcaggaattcgcacgagaccattacctagaacatcctaatcgaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggccccgctgtcggcgcgcccccgagctacctgacgggcgagttcccgggcgactacggctgggacaccgcggggctggcggcgaacccggaaaacgttcgccagaacccgggagctgggaggcatccacctccgctgggccaatgttgggccctttgggcttgcgggtccccgaaattggttccccccgaaaagggttaaatttccgggaggcccgtggggttcaagggcggggttccaaaattttcaggaggggggggggggaatatcctgggaaacccggagcgtgttcccccgggaaaaaaacccccccccctttggcgcccccacaagtggttctttggggccccccaagagggaaaacacggtccccggggggcccccttagaaaaagccccccacccccctccccccc

SEQ ID NO: 12092 - DNA, 683 bp, Zea mays
  misc_feature: Ceres CLONE 1368106-F
  misc_feature: Encodes the peptide sequence at SEQ ID NO. 12093
  misc_feature (418)..(418): n is a, c, t, g, unknown, or other
  misc_feature (425)..(425): n is a, c, t, g, unknown, or other
  misc_feature (433)..(433): n is a, c, t, g, unknown, or other
  misc_feature (434)..(434): n is a, c, t, g, unknown, or other
  misc_feature (580)..(580): n is a, c, t, g, unknown, or other
aaagctggagctccccgcggtggcggccgctctagaactagtggatcccccgggctgcaggaattcgcacgagaccattacctagaacatcctaatcgaaaaagcagcctcccaaatccccaaagcctccgacccccttcctctctccctccgccgccgctgcgcacgcagggaacaagcgacatgggcgtctacacctttgtgtgccgcaacaacggcggcgagtggaccgccaagcagcactccggcgagatcgaggcttccgccgctaccccatacgagctgcagcgccgcctcgtcgctgccgcctccgcggccgactctgcctacggcgtccagtcgtccttctccatggtcacccccagctccgccgtgttccaggtgatcgtcggtgctgtcggtggtggtgcaatgatgntgagcgnaggtggcnngcgcggtgctgctgcatctggtggtgctgctgccgaggctccccaggaggagaaaaggaagaggagaaggaagagagcgacgacgacaggggattctccctgttcgactagaggtgcgtgtgtcatctggatctcaaaaggggggnttgggccctgttgccgaaataaattttgcctgcccgcctggaaactgaaaaacccttgggaaattgtaccagcggaccggtcccattttatgggaaaatttga

SEQ ID NO: 12093 - protein, 166 aa, Zea mays
  misc_feature: Ceres CLONE 1368106-F
  misc_feature (79)..(79): Xaa is any aa, unknown, or other
  misc_feature (81)..(81): Xaa is any aa, unknown, or other
  misc_feature (84)..(84): Xaa is any aa, unknown, or other
  misc_feature (133)..(133): Xaa is any aa, unknown, or other
MGVYTFVCRNNGGEWTAKQHSGEIEASAATPYELQRRLVAAASAADSAYGVQSSFSMVTPSSAVFQVIVGAVGGGAMMXSXGGXRGAAASGGAAAEAPQEEKRKRRRKRATTTGDSPCSTRGACVIWISKGGXGPCCRNKFCLPAWKLKNPWEIVPADRSHFMGKF

SEQ ID NO: 12094 - DNA, 714 bp, Zea mays
  misc_feature: Ceres CLONE 1368108-F
  misc_feature: Encodes the peptide sequence at SEQ ID NO. 12095
  misc_feature (457)..(457): n is a, c, t, g, unknown, or other
agagctggagctccccgcggtggcggccgctctagaactagtggatcccccgggctgcaggaattcgcacgagaccattacctagaacatcctaatcgaaaaataaaagatgtgcctgtccactgtgactccagagtccagaccatagcctgcagccacgaactcccgttctccatttccagccatggcggtgtcgatcgagctcaccaaggagtacggctacgtcgtgctggtgctggtggcctatgtcttcctcaacctttggatgggcttccaggtcggcaaggcccgcagaaactacaaggtgttctaccccaccatgtacgccatcgagtcggagaacaaggacgccaagctcttcaactgcgtgcagagggggcaccagaactctctagagtggatgcccgtttttcttcgtcatactgctgctgggcggtctgcagcacccgaccatcgnccgcggtctgggcggcatctacatcgtcgcgagggtcttctacttcagggatacgccaccgggggttccggacaaccgtctcaagattgggggggctcaactacttggcggtgcttggggctgatcattttgcaaagcatcctttcgggatcaaccttgctcataaggggaaatgctctaaactttggggttaatttggaagctccagggttgggttaacccgcacaagttacctcgtgggcctgggcaataaaaat

SEQ ID NO: 12095 - protein, 163 aa, Zea mays
  misc_feature: Ceres CLONE 1368108-F
  misc_feature (9)..(145): Pfam Name: MAPEG Pfam Description: MAPEG family
  misc_feature: SWISSPROT Homolog: EC 2.5.1.18 Glutathione transferase
MAVSIELTKEYGYVVLVLVAYVFLNLWMGFQVGKARRNYKVFYPTMYAIESENKDAKLFNCVQRGHQNSLEWMPVFLRHTAAGRSAAPDHRPRSGRHLHRREGLLLQGYATGGSGQPSQDWGGSTTWRCLGLIILQSILSGSTLLIRGNALNFGVNLEAPGLG

SEQ ID NO: 12096 - DNA, 704 bp, Zea mays
  misc_feature: Ceres CLONE 1368111-F
  misc_feature: Encodes the peptide sequence at SEQ ID NO. 12097
  misc_feature (475)..(475): n is a, c, t, g, unknown, or other
aaagctggagctccccgcggtggcggccgctctagaactagtggatcccccgggctgcaggaattcgcacgagaccattacctagaacatcctaatcgaaaaatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggcccgnctcggcggcagcgtcaacatgggccaacgcccgccacatccccggaaagtgcgggggtctccgtcggggtggcccatcagccccaccggtcgactgcaccaagatcaactgatccatggaaaccatagggggaggaaacctccccccttggaatggcaacggaacggtggcccatcaaccaaaattgcaaatccgtcctcctaaacaaaaaatagccccataacaacgg

SEQ ID NO: 12097 - protein, 133 aa, Zea mays
  misc_feature: Ceres CLONE 1368111-F
  misc_feature (36)..(121): Pfam Name: Tryp_alpha_amyl Pfam Description: Protease inhibitor/seed storage/LTP family
  misc_feature (92)..(92): Xaa is any aa, unknown, or other
MAARSSSQQLVAAAVLAAALLLLAAGAGTASAAVSCGEVTSSVAPCLGYAMGSAASPSAACCSGVRSLNSRASSAADRQATCNCLKSMTGPXRRQRQHGPTPATSPESAGVSVGVAHQPHRSTAPRSTDPWKP

SEQ ID NO: 12098 - DNA, 749 bp, Zea mays
  misc_feature: Ceres CLONE 1368113-F
  misc_feature: Encodes the peptide sequence at SEQ ID NO. 12099
  misc_feature (371)..(371): n is a, c, t, g, unknown, or other
agagctggagctccccgcggtggcggccgctctataactagtggatcccccgggctgcaggaattcgcacgagaccattacctagaacatcctaatcaaaaatcacagctagctaccatacatacgaataatctcttcttcacctcactaacaccagctaacaactctttctctcctgcaataatggccgctcgctcctcctcctcccagccgcagctggtcgcggtggcagcggtcctggcacgagaactgctgctgctgaagaagccgaccgggacgaagtctgccccagtgaactgcggcgaggtgacgtcgtcggtgacgccaagactcggctacaccaatggcaccacagcgtcgaccatctccanatgctgctgcgggagtgcgctcaatcaagagccgccggtcctccggaattgtaaccgaggggctgctgccactgacctcaatatcaagacggctcttttcggaggtcggcttcacaatgccccaccccccccacgttccccgaaaaaggccgcctctcccgccgcgggagcataaaaccccccgggtgacttgacacaaattgaactggcccaaaaaacctccagggacagaagcccccccctccggaagccaaattataactgccccaaaaaaaaggagaagaactccccggggaaaacaaaatcgccctaaacaccaccccgttttggcgtggaatacaaacgcggcaacaaaaaaaaagacaacacactcccccc

SEQ ID NO: 12099 - protein, 120 aa, Zea mays
  misc_feature: Ceres CLONE 1368113-F
  misc_feature (63)..(63): Xaa is any aa, unknown, or other
MAARSSSSQPQLVAVAAVLARELLLLKKPTGTKSAPVNCGEVTSSVTPRLGYTNGTTASTISXCCCGSALNQEPPVLRNCNRGAAATDLNIKTALFGGRLHNAPPPPRSPKKAASPAAGA

SEQ ID NO: 12100 - DNA, 743 bp, Zea mays
  misc_feature: Ceres CLONE 1368114-F
  misc_feature: Encodes the peptide sequence at SEQ ID NO. 12101
  misc_feature (697)..(697): n is a, c, t, g, unknown, or other
agagctggagctccccgcggtggcggccgctctagaactagtggatcccccgggctgcaggaattcgcacgagaccattacctagaacatcctaatcgaaaaaactacggtaactcgtctgctcgcatttcctcccaatccatcccgcctccaaacccgaactccaagtcgccccgcatcgatggcgcccaaggccgagaagaagcccgcggcgaagaagccggcggaggaggagcccgcggccgagaaggcgccggccgggaagaagcccaaggcggagaagcgtgtcccagcgggcaagtccgccggcaaggagggcggtgagggaaagaggggccggaagaagggcaagaagagcgtggagacttacaagatctacattttcaaggtgctgaagcaagtgcacccggacatcggcatttcctccaaagccatgtccatcatgaactcctttcatcaacgacatcttccagaagctccgctgccgaggccgccaagctcgggcgggacaacaagaagcccaccaataacctcccgcgagatccaaaatttccgtggcgcctcgtcctccccggggaagctcggcaaagaacgcctgtcctccaaggggcaccaagggcccgtcacccaaagttcccccctccggcctaaaggctgggcaaacaccccccgggttgggcggggctttcctctccgntaatgtttccacccaccccccttgggccggacaaaataagcggcgg

SEQ ID NO: 12101 - protein, 172 aa, Zea mays
  misc_feature: Ceres CLONE 1368114-F
MAPKAEKKPAAKKPAEEEPAAEKAPAGKKPKAEKRVPAGKSAGKEGGEGKRGRKKGKKSVETYKIYIFKVLKQVHPDIGISSKAMSIMNSFHQRHLPEAPLPRPPSSGGTTRSPPITSREIQNFRGASSSPGKLGKERLSSKGHQGPVTQSSPLRPKGWANTPRVGRGFPLR

SEQ ID NO: 12102 - DNA, 655 bp, Zea mays
  misc_feature: Ceres CLONE 1368115-F
  misc_feature: Encodes the peptide sequence at SEQ ID NO. 12103
tggagctccccgcggtggcggccgctctagaactagtggatcccccgggctgcaggaattcgcacgagaccattacctagaacatcctaatcgaaaaatgcgcgcacactcccaagtcctaagctagccagctgagctcgctcccagtccaagcgccggccccaccaccgcagctcgatcacaccatgagcaaggagaagcaccaccgcgactggatcctccggcgctgctgcggctccctcgccgcctgcatcctgacgctggccgccgtcgtcggcttcatcgtgctcgtcatctacctggcgctgcgcccctccaagccgtccttctacctgcaggacgtgcagctgcgctccatcgacctcagcgacccggcgctctccctcgacccctcagtgacgatcgcgtcgcggaacccgaacgagcgggtgggcgtgtactacaagacgctggacgcgttcaccacgtaccgcgaacaagggtggacggtccccgtggccatgccgcggactaccaggggcacaaggactgtccgggggggccccggtcatggccggcaaccggcccccgggggcaagaactgggcgcccccatggaaccgggactcgagggggaaaaacggcctggccccccccaggggggaccgccccctaaa

SEQ ID NO: 12103 - protein, 156 aa, Zea mays
  misc_feature: Ceres CLONE 1368115-F
  misc_feature (38)..(148): Pfam Name: Hin1 Pfam Description: Harpin-induced protein 1 (Hin1)
MSKEKHHRDWILRRCCGSLAACILTLAAVVGFIVLVIYLALRPSKPSFYLQDVQLRSIDLSDPALSLDPSVTIASRNPNERVGVYYKTLDAFTTYREQGWTVPVAMPRTTRGTRTVRGGPGHGRQPAPGGKNWAPPWNRDSRGKNGLAPPRGDRPL

SEQ ID NO: 12104 - DNA, 693 bp, Zea mays
  misc_feature: Ceres CLONE 1368117-F
  misc_feature: Translation starting site: 247
  misc_feature (693)..(693): n is a, c, t, g, unknown, or other
aaagctggagctccccgcggtggcggccgctctataactagtggatcccccgggctgcaggaattcgcacgagaccattacctagaacatcctaatcgaaaaaaaagggttccctcaggccatttccttgagccgttccgctgccattcgaccaccaccgccacggcggcgccgacgccgactacaaccactcgcagagactaccgcctccacccccgctgcttctcatctccacgcagccgtccgatggccaagcggctcgccggcgccgacaaagaggtgctcgtcgaggtggtgaggttcacgcataagagcggactgaggggctgtgacggcggctggaaggatttcctggcccagaacgacaggaagtttggcgcgtcggtgagcgacccgaggaagcgctccagggacgtgctgttcgccttcctgcagaccttccccaaggatttccagaacaaacacttgatgccactagtctgacgagagccaccggaagattttattgcttcaggtgcataggctctgcattaatattctcatgacagcatacgcagccgcaatttttggaggagcggcctctacgaacctgtatcaaaagattgtcattgtggctgggcatggccttggttgcctccaccctctggcaaagagcacaacaattttgacattgagaataagggattgtatccn

SEQ ID NO: 12105 - DNA, 647 bp, Zea mays
  misc_feature: Ceres CLONE 1369397-F
  misc_feature: Encodes the peptide sequence at SEQ ID NO. 12106
tggagctccccgcggtggcggccgctctagaactagtggatcccccgggctgcaggaattcgcacgagaccattacctagaacatcctaatcgaaaaatctccagcggcttcttccaaagctccaactccgacgagaaccgccactcctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctaccaagggctacaaacttacactcacaatgcctggctccatgagcatggagaggaggatcatattgaagggcttttggtgcttaaactggcctttactgaaacacttttttgggaaatgaaagggagtttgtcacaaaaaaggggaaaaaatatccaggcaaaaacaccccccctctta

SEQ ID NO: 12106 - protein, 129 aa, Zea mays
  misc_feature: Ceres CLONE 1369397-F
  misc_feature: SWISSPROT Homolog: EC 2.5.1.47 Cysteine synthase
MGEASPSIAKDVTELIGNTPLVYLNKVTDGCVGRVAAKLESMEPCSSVKDRIGYSMITDAEEKGLITPGVSVLIEPTSGNTGIGLAFMAATKGYKLTLTMPGSMSMERRIILKGFWCLNWPLLKHFFGK

SEQ ID NO: 12107 - DNA, 687 bp, Zea mays
  misc_feature: Ceres CLONE 1369429-F
  misc_feature: Encodes the peptide sequence at SEQ ID NO. 12108
  misc_feature (687)..(687): n is a, c, t, g, unknown, or other
aaagctggagctccccgcggtggcggccgctctagaactagtggatcccccgggctgcaggaattcgcacgagaccattacctagaacatcctaatcgaaaaaaggaaatgtcccggtttagaattcggccctttatactatagctgttcgtttgggcccagattgaaaccgagagtgatccgatttgaagttttctcttctacaacggcccgacatgaatcctggtctactgacctccggatccgatctcgacgacacagcgcagcactggcgcagaggaggcaaagaggcgacgacaccagtgacggcgtggcggcgcagcgcagcgtcgacggccaccctcccgtcgctttctcaccgtgcagaaaattggcgttttgcggcaaagcacttcatcaggaaacaccctgaagacgtggttgttcactgcagtgggtgcaactcagcagctcgaacctttgatggagttgatgtgatggggagaagattggcagacgaggtggcttctattgttgacagtagaccagagctttgcaagatttcctttgttgcgcattcattgggtggactaattgcaagatatgctattgcattattatatgagagcgagacacaaaaagattctcatgaaaagtttgagaaccatgctgttgactattctagtaaccagcacagcatagggaaan

SEQ ID NO: 12108 - protein, 157 aa, Zea mays
  misc_feature: Ceres CLONE 1369429-F
  misc_feature (1)..(155): Pfam Name: DUF676 Pfam Description: Putative serine esterase (DUF676)
MNPGLLTSGSDLDDTAQHWRRGGKEATTPVTAWRRSAASTATLPSLSHRAENWRFAAKHFIRKHPEDVVVHCSGCNSAARTFDGVDVMGRRLADEVASIVDSRPELCKISFVAHSLGGLIARYAIALLYESETQKDSHEKFENHAVDYSSNQHSIGK

SEQ ID NO: 12109 - DNA, 697 bp, Zea mays
  misc_feature: Ceres CLONE 1369442-F
  misc_feature: Encodes the peptide sequence at SEQ ID NO. 12110
aaagctggagctccccgcggtggcggccgctctagaactagtggatcccccgggctgcaggaattcgcacgagaccattacctagaacatcctaatcgaaaaaaaaaaccctaattcgaacaaccgcgccgccgtcaccgactcaccgtcgtctcttgctcactcgctcgttctctccatccagatcggagcgctcggttcggataggggcgtctcggaggtgaaggcgggcgcgtcagccatggcggacgaggagcacccggagaggagggaagaggcctccgagcttgccccctttgatccaaccaagaagaagaaaaagaagaaggttgtcatccaagagccttctgatgaagtggacaagcttgcagagaagacagaatcactagcagtcgcagaacctgctgaacttaactttactggaatgaagaagaaaaagaagaagcaggtggatcttgattcatctattgatgaccttgtagatggggaggacactcaaggtgatcaagttgtagaggaacaaggggacggtattgtgcttggaggtggccctacatatccttgggaaggaactgaccgggattataaatacgaagagctgctggacagggtgttcaacattcttcgtgagaacaacccagatcttgctggtgataggcggagaaccgttatgaggccacctcaagttcttagggag

SEQ ID NO: 12110 - protein, 152 aa, Zea mays
  misc_feature: Ceres CLONE 1369442-F
MADEEHPERREEASELAPFDPTKKKKKKKVVIQEPSDEVDKLAEKTESLAVAEPAELNFTGMKKKKKKQVDLDSSIDDLVDGEDTQGDQVVEEQGDGIVLGGGPTYPWEGTDRDYKYEELLDRVFNILRENNPDLAGDRRRTVMRPPQVLRE

SEQ ID NO: 12111 - DNA, 605 bp, Zea mays
  misc_feature: Ceres CLONE 1369443-F
  misc_feature (358)..(358): n is a, c, t, g, unknown, or other
  misc_feature (372)..(372): n is a, c, t, g, unknown, or other
  misc_feature (373)..(373): n is a, c, t, g, unknown, or other
  misc_feature (525)..(525): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (534)..(534): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggncagaacatggtggnncgccgcttcctgggggccccaaccccctccagggaaactacaccccactcgggttttcccggggggggggaaaaacaagaaacccctttttttttttaaagggggggggggaaaaaaaaaaaacccccccccccccgggggggggggggggngagnnnngngggggggggggggggaatatttcctttgggggggcccacccccccggcgggggggggggggggggcggccc

SEQ ID NO: 12112 - DNA, 646 bp, Zea mays
  misc_feature: Ceres CLONE 1369445-F
  misc_feature: Encodes the peptide sequence at SEQ ID NO. 12113
  misc_feature (618)..(618): n is a, c, t, g, unknown, or other
tggagctccccgcggtggcggccgctctagaactagtggatcccccgggctgcaggaattcgcacgagaccattacctagaacatcctaatcgaaaaagcaaatcactacacacaccttgtctctaatcagatatcaaagaagtagccattaagttaacgatggcttccgccgacctcgcagaggccatcgagcccagcaggaagaagaagagcaacgtcaagtatgcctccatctgcgccatcctcgcctccatggcctccgtcatccttggctacgatattggggtgatgagcggagcggccatgtacatcaagaaggacctgaagatcacggacgtgcagctggagatcctgatagggatcctcagcctctactcgctcatcgggtccttcgcgggcgcgcggacgtccgacaggatcggccgccgcctgactgtcgtcttcgccgccgtcatcttcttcgcgggcgcgctgctcatgggtttcgccgtcaactactccatgctcatggtgggccgcttcgtggccggagttggcgtgggctacgggggcatgatcgcgcccgtgtacacggccgagatctcgccggcggcgtcccgcggcttcctcacgccttncccggaagtgttcatcaacgtcggcatc

SEQ ID NO: 12113 - protein, 162 aa, Zea mays
  misc_feature: Ceres CLONE 1369445-F
  misc_feature (153)..(153): Xaa is any aa, unknown, or other
MASADLAEAIEPSRKKKSNVKYASICAILASMASVILGYDIGVMSGAAMYIKKDLKITDVQLEILIGILSLYSLIGSFAGARTSDRIGRRLTVVFAAVIFFAGALLMGFAVNYSMLMVGRFVAGVGVGYGGMIAPVYTAEISPAASRGFLTPXPEVFINVGI

SEQ ID NO: 12114 - DNA, 707 bp, Zea mays
  misc_feature: Ceres CLONE 1369446-F
  misc_feature: Encodes the peptide sequence at SEQ ID NO. 12115
  misc_feature (411)..(411): n is a, c, t, g, unknown, or other
  misc_feature (412)..(412): n is a, c, t, g, unknown, or other
  misc_feature (427)..(427): n is a, c, t, g, unknown, or other
  misc_feature (428)..(428): n is a, c, t, g, unknown, or other
aaagctggagctccccgcggtggcggccgctctagaactagtggatcccccgggctgcaggaattcgcacgagaccattacctagaacatccaatcgaaaagttgcgtagccaaatcgagatctccgtctcccccgtgacgaatcccacgcccacctctccccgacccggctggccgcagcaacagcgcatcgcaccgggaggcgggagccgaagaaccaaacaggagatggcgtcggcgctgtcctccctgcgctacggcgacagcctctcggtggtgggcatctccgccgcgacggccgtgctctgcgaggccatctcctggcttctcatctaccgcaccgccacctacgactccctccgcgcctccatcgaaacgcactcacgcaagctggacgccatgaagtccggnntccactccctccggnngctgctctcctcgcgcagggcgcggcgtcgggggttaaaaaatgaacggcgtcaagaccacctcagggacccggggggaagctctccttgcaaggtcaagtggggggccgtttcccccgcgggtcttttggggttttggcgggtaaacccccctttagggggccccccgggccaaggtggccttttggccttcccctttttccgggggagacccccggggtgggcgggaaaaaaaccccacaggggcgggggggccccctatcctcccgcgctaggaga

SEQ ID NO: 12115 - protein, 159 aa, Zea mays
  misc_feature: Ceres CLONE 1369446-F
  misc_feature (9)..(158): Pfam Name: DUF841 Pfam Description: Eukaryotic protein of unknown function (DUF841)
  misc_feature (62)..(62): Xaa is any aa, unknown, or other
  misc_feature (67)..(67): Xaa is any aa, unknown, or other
MASALSSLRYGDSLSVVGISAATAVLCEAISWLLIYRTATYDSLRASIETHSRKLDAMKSGXHSLRXLLSSRRARRRGLKNERRQDHLRDPGGSSPCKVKWGAVSPAGLLGFWRVNPPLGGPPGQGGLLAFPFFRGRPPGWAGKKPHRGGGAPYPPALG

SEQ ID NO: 12116 - DNA, 710 bp, Zea mays
  misc_feature: Ceres CLONE 1369451-F
  misc_feature: SWISSPROT Homolog: EC 2.7.11.24 Mitogen-activated protein kinase
  misc_feature (53)..(53): n is a, c, t, g, unknown, or other
aaagctggagctccccgcggtggcggccgctctagaactagtgggatcccccngggctgcaggaattcgcacgagaccattacctagatcatcctaatcgaaaacccggcccgcgcctcgctctctcttgtctcgcccgctagctcccatcccagcctcccaccgcgcccgcctgccccaacatcccccctccccgctccgctccacgcacggctccagatctgctacggcggcggccggtggacgccgcgccgcgcgtgccggaggcggtgacgtgagcggcggatcctgcccggccgtgccatcctggcgacgatgacagcgtaagcgggcggcggacgacccgcgccccccggcccctaactccgaggtcattggcgtgtgctccttggcagaaaatggcgatgatggtggatccccccatgccatgggcagtcaggaaagcattactatactatggggcagaccctggttgaaatcaaccccagtacgtgccgatcaagccctcggaaaaggacttacgggattcgttggtccattggtaacccggagaacaatgaaaaaattccggaaaaaaaaataaaccacgcctttaaaaacccgggggaatgcccttaagacccttaaaaaaattaaaccccttccgccccgggggcccaaaaaattttttggttcccaaaaaaaaaaaagggccccgccaaaaaaaagaa

SEQ ID NO: 12117 - DNA, 702 bp, Zea mays
  misc_feature: Ceres CLONE 1369455-F
  misc_feature: Pfam Name: AWPM-19 Pfam Description: AWPM-19-like family
  misc_feature (130)..(130): n is a, c, t, g, unknown, or other
  misc_feature (131)..(131): n is a, c, t, g, unknown, or other
  misc_feature (316)..(316): n is a, c, t, g, unknown, or other
  misc_feature (317)..(317): n is a, c, t, g, unknown, or other
  misc_feature (352)..(352): n is a, c, t, g, unknown, or other
  misc_feature (362)..(362): n is a, c, t, g, unknown, or other
  misc_feature (547)..(547): n is a, c, t, g, unknown, or other
  misc_feature (548)..(548): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccatnntcgcattggtctgaatactggtagctactaagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggnnggctagctagctgagctcgtgcgacgaagaatggnccggaattgncaagaacatggtgacgccgctcctggtgctcaacctcatcatgtacatcatcgtcatcggcttcgcgagctggaaccctgaccacttcatcaacgggagaacaactacccccgggtgggccggaaccggggcgacgtctacttcctggggtccccaaccctggccggggggggggccggcccaanntggtgtggggggggggcaccaagggaacccttggggccccaaaagctgggccccaaaggccggggtgtgtttattgccggggccataaggggctctcctttgggtggggcggggaaaggaacccacttgggggaacccggggtgggcggcgggg

SEQ ID NO: 12118 - DNA, 708 bp, Zea mays
  misc_feature: Ceres CLONE 1369457-F
  misc_feature: Encodes the peptide sequence at SEQ ID NO. 12119
  misc_feature (399)..(399): n is a, c, t, g, unknown, or other
  misc_feature (463)..(463): n is a, c, t, g, unknown, or other
  misc_feature (551)..(551): n is a, c, t, g, unknown, or other
tggagctccccgcggtggcggccgctctagaactagtggatcccccgggctgcaggaattcgcacgagaccattacctagaacatcctaatcgaaaaaatgtcgcgtgcggccactagatttttcctgacgcggtgtctgctcccacttcccctcctctcccccaggtggcggcagcggcggcggggtagcatttgtgctacgagggcttttgcaatggcggcttcggggttcggcggcggcgaggcgttccggctctcggccgcgccgggggccggcttactgaagctgcacaagggcgacatcaccctctggtccgtcgactgcgccaccgacgccatcgttaatgctgctaatgagcgaatgttaggtggcggaggtgttgatggagctatacatncagctgctggaccagagctagtgcaagcatgccggaaagttccagaggtcaaaccagagtccgntgtcctactggagaaagctagattactcctgcttttgagcttcctggctctcgggtgattccccctggtggccctaataattgatttnaccaagcatctggaggtggcattaaagaaggcctattgaaaaaactttggagcttggctagggataaagggatttcagaaaactccctttcccctggtatatccttggggggggtataaccgttcccctcccagagaaaaatccaaaaaatacgtgg

SEQ ID NO: 12119 - protein, 101 aa, Zea mays
  misc_feature: Ceres CLONE 1369457-F
  misc_feature: SWISSPROT Homolog: EC 1.1.1.27 L-lactate dehydrogenase
  misc_feature (62)..(62): Xaa is any aa, unknown, or other
  misc_feature (83)..(83): Xaa is any aa, unknown, or other
MAASGFGGGEAFRLSAAPGAGLLKLHKGDITLWSVDCATDAIVNAANERMLGGGGVDGAIHXAAGPELVQACRKVPEVKPESXVLLEKARLLLLLSFLALG

SEQ ID NO: 12120 - DNA, 659 bp, Zea mays
  misc_feature: Ceres CLONE 1369458-F
  misc_feature: Encodes the peptide sequence at SEQ ID NO. 12121
  misc_feature (460)..(460): n is a, c, t, g, unknown, or other
  misc_feature (589)..(589): n is a, c, t, g, unknown, or other
  misc_feature (615)..(615): n is a, c, t, g, unknown, or other
  misc_feature (616)..(616): n is a, c, t, g, unknown, or other
  misc_feature (648)..(648): n is a, c, t, g, unknown, or other
  misc_feature (652)..(652): n is a, c, t, g, unknown, or other
  misc_feature (659)..(659): n is a, c, t, g, unknown, or other
tggagctccccgcggtggcggccgctctagaactagtggatcccccgggctgcaggaattcgcacgagaccattacctagaacatcctaatcgaaaaaattccggccacaccccccgctacgcctgtgctgccgcctccccttcctcttcgcttcccgtgcaagcttcaccgccgccatctcgtcctctcgtcgcgatgcttccccttccgcgccgcggttcctctatccccgccttccctgcccgctccggctcttgcacctgacccagtccgccaatctgttccccttttccgtacgagggtactatcgccggccatttcgattcggggttgatcggatcagcgtaggctgatgggtcgcgatgctgagaagacctctccgccggtgccatcgtcggaattggaacaggaagaagacgacgactgctacctaagcgatcaggaggacgatgccctagnaagagtccgttctccatgtcctcgaggacgagcacctcgaggactgccattggtccgccctcatgcgtgatcaccaaggaatccctcttggcagcgcaagaaggaggatcttagggaaggtgatggagnctgcttaggggttgagggagcaccanntgcccggacgctcctcaccatacccgctgggnaagntgggaan

SEQ ID NO: 12121 - protein, 58 aa, Zea mays
  misc_feature: Ceres CLONE 1369458-F
  misc_feature (36)..(36): Xaa is any aa, unknown, or other
MGRDAEKTSPPVPSSELEQEEDDDCYLSDQEDDALXRVRSPCPRGRAPRGLPLVRPHA

SEQ ID NO: 12122 - DNA, 739 bp, Zea mays
  misc_feature: Ceres CLONE 1369459-F
  misc_feature: Encodes the peptide sequence at SEQ ID NO. 12123
aaagctggagctccccgcggtggcggccgctctagaactagtggatcccccgggctgcaggaattcgcacgagaccattacctagaacatcctaatcgaaaattaaatactccgtaactttgcctgcctagctcctcctctatccatcgatcactgtaccggccggcggcaccgcgttcacatgggctacccatcgatactacagccatgacggaacgagaccgcagaggtatatacggtagaggccacgccacctacggagagcagaagcaacagcggagcagacggatacccgatatgtgagcaattgaaggccatgttccacgacaaggcgataacggggcctgaccccactaaccaggggtgtcaactgttccccctggtgggggctggttgccataaaggaccttctctggagcttggagacctccccaatttttttattcctgggaaaaccccggggttccgagatttcccgcccccagtgtattttccccaaaggaggaattaattggaaaatccccaaaatggggtttcttaaaaccatttcgaaagaagggtttggggtgcctaactaaaacataaaaaccccccccaacaaggtgttgggccttttttttttccccccgccccaacgggggggaagacccccctttttatatttccttgccaagagccacaaggggccccacaaaacccctgtcgaacaaaaaaaaaaaagacgcccgcggggggcccg

SEQ ID NO: 12123 - protein, 31 aa, Zea mays
  misc_feature: Ceres CLONE 1369459-F
MTERDRRGIYGRGHATYGEQKQQRSRRIPDM

SEQ ID NO: 12124 - DNA, 729 bp, Zea mays
  misc_feature: Ceres CLONE 1369459-R
  misc_feature: Translation starting site: 475
  misc_feature (487)..(487): n is a, c, t, g, unknown, or other
  misc_feature (488)..(488): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (510)..(510): n is a, c, t, g, unknown, or other
  misc_feature (511)..(511): n is a, c, t, g, unknown, or other
  misc_feature (523)..(523): n is a, c, t, g, unknown, or other
  misc_feature (568)..(568): n is a, c, t, g, unknown, or other
  misc_feature (576)..(576): n is a, c, t, g, unknown, or other
  misc_feature (577)..(577): n is a, c, t, g, unknown, or other
  misc_feature (581)..(581): n is a, c, t, g, unknown, or other
  misc_feature (682)..(682): n is a, c, t, g, unknown, or other
cgattgggtaccgggccccccctcgaggtcgacggtatcgataagcttttttttttttttttttaacaattagatgtcacaaattattcagcaagagaatacattgaccaattttccacaacagacgacgatcatacagttgatgcatgcacaacacaaccagtgaccagagtgcccagccacactagcaaagctcaaacattaccttccagacagacttatcacttattcccctagcaaagtatattcacatctacgacctggagcggcgatgaacagacaccggaattcaactggagcggcgatgaacacacacgacgaacaccaggacatacgtaacacacactcggggggagaaagacgaaggacggaaggacggtcacccacacgtacaggaacacagcattccgcgacgaccctgctggctgctgatactgatagacacgcacgcgcgcatctatccataatccatgcatggatgacttgnnctacgagaagccnnntgcgcgnncgcagcgccggnacctgcacctcccccggcggccgggctcctgcgccctgccctggnatggctgnnctgnctgcccggtctttgtgcccgcgtgcgccgccgcctcccgcatcctgcggggcggctcctccactaatcggggtgccctggaacccctgcccccctggttgncaaagcctttaacaagaaaaggcccccgaacccaggcggccgaggag

SEQ ID NO: 12125 - DNA, 686 bp, Zea mays
  misc_feature: Ceres CLONE 1369464-F
  misc_feature: Encodes the peptide sequence at SEQ ID NO. 12126
  misc_feature (612)..(612): n is a, c, t, g, unknown, or other
  misc_feature (668)..(668): n is a, c, t, g, unknown, or other
tggagctccccgcggtggcggccgctctagaactagtggatcccccgggctgcaggaattcgcacgagaccattacctagaacatcctaatcgaaaaaaactcaccgccggggcacaacaggccagttctcctttcgccggaatctgtccctcctccccgcctctgtgggtactggaccaccgtggagcgggcattcatccaggctaggtccattccttcctttgctcgttctcttctccatcgcggaagctccacccgagttgacgccagaagagaatcggtgccctagggtgttctcgcagaattattttccagaagatttgcagatcgagtcgaaccctatgccccacgttaagcctgccgccggcctgcccccttaccaccaccgggcgctccctggccccgggcagggtccagttcccacgggacatgggatgatgcaccgggaggtccgtgatcagtacgggccgccggggccgaggatgcacctaccaccgctggggcacgggcccgctccgttcccctacgacatgctgcctccgctgcccccaccggaggtcctggagcagaagcttgtgggacagcacggggaaatgcaaaagctgtttatnaagaacgcccggttgctgcaagcacgcctcgttgagaaagagctaaccgggggcancagaactgcaaagcttga

SEQ ID NO: 12126 - protein, 114 aa, Zea mays
  misc_feature: Ceres CLONE 1369464-F
  misc_feature (90)..(90): Xaa is any aa, unknown, or other
  misc_feature (109)..(109): Xaa is any aa, unknown, or other
MPHVKPAAGLPPYHHRALPGPGQGPVPTGHGMMHREVRDQYGPPGPRMHLPPLGHGPAPFPYDMLPPLPPPEVLEQKLVGQHGEMQKLFXKNARLLQARLVEKELTGGXRTAKL

SEQ ID NO: 12127 - DNA, 706 bp, Zea mays
  misc_feature: Ceres CLONE 1369482-F
  misc_feature: Encodes the peptide sequence at SEQ ID NO. 12128
  misc_feature (493)..(493): n is a, c, t, g, unknown, or other
  misc_feature (510)..(510): n is a, c, t, g, unknown, or other
  misc_feature (573)..(573): n is a, c, t, g, unknown, or other
  misc_feature (575)..(575): n is a, c, t, g, unknown, or other
  misc_feature (642)..(642): n is a, c, t, g, unknown, or other
  misc_feature (658)..(658): n is a, c, t, g, unknown, or other
aaagctggagctccccgcggtggcggccgctctagaactagtggatcccccgggctgcaggaattcgcacgagaccattacctagaacatcctaatcgaaaatcatttttctctctcctgcgccgcgacgtccctcgccttcgccgccgaatccgagactccgatctcgggttcaccgcagcgcacagagcagccccgactcccggcccgatccgcgctctcctctccgtcgcttcagtcatggcaggaatggcacctgagggttctcagttcgatgctaagcactatgattctaagatgcaggagctgctgagcactggtgagactgaggagttcttcacttcatatgatgaagtttttgagagttttgatgatatgggcctccaagagaatcttctgagaggcatttatgcttatggttttgagaagccctctggcattcagcagagaggaattgttcccttctgcaggggtcttgatgtcattcagcaangcacatctggtacaggnaaagacagcaccttctggtctgggatcttgcagcagctggactatgggctggttgaatggcangnccctggtctttgctcccaccggtgagctgcacagcaaatggaggaagtcatgcgagcggctggggantactttgggggtaggnccatgcatggggtggaaggacatccggccggaggaccaaagattcttg

SEQ ID NO: 12128 - protein, 119 aa, Zea mays
  misc_feature: Ceres CLONE 1369482-F
  misc_feature (85)..(85): Xaa is any aa, unknown, or other
  misc_feature (111)..(111): Xaa is any aa, unknown, or other
  misc_feature (112)..(112): Xaa is any aa, unknown, or other
MAGMAPEGSQFDAKHYDSKMQELLSTGETEEFFTSYDEVFESFDDMGLQENLLRGIYAYGFEKPSGIQQRGIVPFCRGLDVIQQXTSGTGKDSTFWSGILQQLDYGLVEWXXPGLCSHR

SEQ ID NO: 12129 - DNA, 643 bp, Zea mays
  misc_feature: Ceres CLONE 1369487-F
  misc_feature: Encodes the peptide sequence at SEQ ID NO. 12130
  misc_feature (368)..(368): n is a, c, t, g, unknown, or other
  misc_feature (369)..(369): n is a, c, t, g, unknown, or other
  misc_feature (477)..(477): n is a, c, t, g, unknown, or other
aagctggagctccccgcggtggcggccgctctagaactagtggatcccccgggctgcaggaattcgcacgagaccattacctagaacatcctaatcgaaaaacactacatcccacctacctcctcgcatcaggcaggcgggcctcgcgtttataagccacccttcctctcctccacggccctcgccctgcaaagcacagacacaaaccacgagcgcgaggcacgacctacatcgaatcggccacgaaccaccatggcggcctcacgcgcgctcctccccagcccgcaggtgagccctgcgagcgcgcgggtccgcctggccgcggccgtgccgtcgtcgctcacgctcgcggcgcgcggcggggccgnngccggcgcgcgtctccgcgtgcggtgcgcgatcttgtcgtcgcccgcgcccgtggcgcccaccgagtcgaggccggtgcgccggatctcgccgtccgcgccggacggngcgctgcggcccaagccggcggtgctggccggcgaaaaactgagcgaggccggcctggccggggtgcggcagttccccgaaaggggaaggggcccacggcatggcccccgcggaggtcttcggcaaggcggcgcaaatcgacggggtcttcgggggagcggcaact

SEQ ID NO: 12130 - protein, 130 aa, Zea mays
  misc_feature: Ceres CLONE 1369487-F
  misc_feature (39)..(39): Xaa is any aa, unknown, or other
MAASRALLPSPQVSPASARVRLAAAVPSSLTLAARGGAXAGARLRVRCAILSSPAPVAPTESRPVRRISPSAPDGALRPKPAVLAGEKLSEAGLAGVRQFPERGRGPRHGPRGGLRQGGANRRGLRGSGN

SEQ ID NO: 12131 - DNA, 659 bp, Zea mays
  misc_feature: Ceres CLONE 1369493-F
  misc_feature: Translation starting site: 264
  misc_feature (350)..(350): n is a, c, t, g, unknown, or other
  misc_feature (609)..(609): n is a, c, t, g, unknown, or other
  misc_feature (610)..(610): n is a, c, t, g, unknown, or other
aaagctggagctccccgcggtggcggccgctctagaactagtggatcccccgggctgcaggaattcgcacgagaccattacctagaacatcctaatcgaaaaataaataccactcctgcgattccaccttgcagttggaccggccgttgttgctttgcttcttcgcaaaaaaaaaacaaaaaaacaaaataggcctgtcttgctccgatcaggcgtgttcttaggcttcgctgcccctaccgcgtcttcgccgggatcggtccatggccggcgccgagcgcgcggaggcggtcgcgctggaacaagggctcctcgatccggaggaatccaaccaagtagtatacactggnagatggatcagtcgacttttctggaaatcctgttgtcaaggaaagaacgggtagatggaaggcatgtccattcatattaggtaatgaatgctgtgaacgactggcctactatggcatctccacaaaccttgttacttacttgacaaaaaaactgcatgctggcaatgcctctggctgctagcagtgtgactaacatgggtcgggaacttgctacctaactccacttattggagcaatcctggctgagcaaaaaaggggnngggaggtactggacaatcgcaacattttccacagtatactttcatcggg

SEQ ID NO: 12132 - DNA, 707 bp, Zea mays
  misc_feature: Ceres CLONE 1369494-F
  misc_feature: Encodes the peptide sequence at SEQ ID NO. 12133
  misc_feature (340)..(340): n is a, c, t, g, unknown, or other
  misc_feature (372)..(372): n is a, c, t, g, unknown, or other
  misc_feature (393)..(393): n is a, c, t, g, unknown, or other
  misc_feature (409)..(409): n is a, c, t, g, unknown, or other
  misc_feature (410)..(410): n is a, c, t, g, unknown, or other
  misc_feature (415)..(415): n is a, c, t, g, unknown, or other
  misc_feature (453)..(453): n is a, c, t, g, unknown, or other
  misc_feature (469)..(469): n is a, c, t, g, unknown, or other
  misc_feature (542)..(542): n is a, c, t, g, unknown, or other
tccccgcggtggcggccgctctagaactagtggatcccccgggctgcaggaattcgcacgagaccattacctagaacatcctaatcgaaaaaaccgcagcagggcgttgggcgagtgagtgagtcagtgaggctgggatagcagcagcagcatcagtgcgccgcactcaacttctcttcttgccgtgcggtgcggcgcggcgcggggaggcaccgcacggccgcaagcaatgccgcgccggcagaggacgcgcagcagcgaggagctcaaggcggaggacttcgtcgactcggtgctcaacttcggcggcgaggaggaggatggggaaagagagaagcanggaggcggcggggacggccagccggcggcggnagtcaagtccaagaacctggnagccgagcgaaagcgnngcggnaagctcaaccgcaacatcctcgcgctcagggccgtggntgccgaacatcaccangatgagcaagggagccaaccctctcggacgctatcgacttccatcaggaagttccagaaccagttccttgaantggaagggccagttcccccaattccccccggaaaagcctggaaaaaaaaagggaaaccgggccgggcctctaaacccttccccggccccggaaaaaaaagcgccgaaaaagggggaaaaaacgaggtgggttccccctgggggccctggggagacccccccccga

SEQ ID NO: 12133 - protein, 159 aa, Zea mays
  misc_feature: Ceres CLONE 1369494-F
  misc_feature (37)..(37): Xaa is any aa, unknown, or other
  misc_feature (48)..(48): Xaa is any aa, unknown, or other
  misc_feature (55)..(55): Xaa is any aa, unknown, or other
  misc_feature (61)..(61): Xaa is any aa, unknown, or other
  misc_feature (75)..(75): Xaa is any aa, unknown, or other
  misc_feature (80)..(80): Xaa is any aa, unknown, or other
  misc_feature (105)..(105): Xaa is any aa, unknown, or other
MPRRQRTRSSEELKAEDFVDSVLNFGGEEEDGEREKXGGGGDGQPAAXVKSKNLXAERKRXGKLNRNILALRAVXAEHHXDEQGSQPSRTLSTSIRKFQNQFLEXEGPVPPIPPGKAWKKKGKPGRASKPFPGPGKKSAEKGGKNEVGSPWGPWGDPPP

SEQ ID NO: 12134 - DNA, 721 bp, Zea mays
  misc_feature: Ceres CLONE 1369494-R
cgattgggtaccgggccccccctcgaggtcgacggtatcgataagcttttttttttttttttttaaattgtttttgcaggattttagtcatcgcaaaattcaggtgaagtatatgggtccgtaaaagtagatccttgtgtaacagactgatctaaacttcgaatcattttaacaaagcatgacagtttttttcacgactgccttgcttttctatctatgagagctgaaatcaggacagcacagcacagcatccgatcgacccttgctgcctacatgggtcagtagatatcatcatggtgctaacattgcaaacagaatccaggtctaacggaagcgaacgcaatggagaggaactgtgaatttgtccacaatcacaagttcattcctcgatgcccatcgtgctatgcgttcaacacaaaatccagcctttatccgtcagtaaaccagtttgaccatgtactcttgtcacactgcctgcacaaacactccaccgctagaagtcttcgtcgaaagtgaggtttctgcactgaaacatgtgagctcaatcgggaacctcgtcagttgcttgggacttccacgatgtgggataaaagctccctaattcaccattaaaaaatcctggtcggctttcccctcgatggggaaaaacctctcacgctaacccctaaaactttatccgggtcagggctggggaactggcccttttaaactcccaaagggt

SEQ ID NO: 12135 - DNA, 660 bp, Zea mays
  misc_feature: Ceres CLONE 1369507-F
  misc_feature: Encodes the peptide sequence at SEQ ID NO. 12136
  misc_feature (427)..(427): n is a, c, t, g, unknown, or other
  misc_feature (505)..(505): n is a, c, t, g, unknown, or other
tggagctccccgcggtggcggccgctctagaactagtggatcccccgggctgcaggaattcgcacgagaccattacctagaacatcctaatcgaaaataagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttggnggctattctgtttggttaccatcttggtgtggtcaatggcgcacttgatatctcgcgaaggatcttgggattgctganatgctgcttgcagggggggggggtggttaacacatcccttggctggtgcacactaggtcttttttaacgggggggtttctttggcagataaaatttggggcggacaagaacattcatcccctggatgcagtcccactttgctctaggtggcattt

SEQ ID NO: 12136 - protein, 155 aa, Zea mays
  misc_feature: Ceres CLONE 1369507-F
  misc_feature (108)..(108): Xaa is any aa, unknown, or other
  misc_feature (134)..(134): Xaa is any aa, unknown, or other
MMRCAATGGGCVASWSGDWRLPAVNPCSVRMPTGNDGWCAGLRSRAADLAGLEMANLRGGVGGLFRASPRYGRLQATAAVDPEDIPLEKVQVKSSGHVLPYVGVACLXAILFGYHLGVVNGALDISRRILGLLXCCLQGGGVVNTSLGWCTLGLF

SEQ ID NO: 12137 - DNA, 640 bp, Zea mays
  misc_feature: Ceres CLONE 1369509-F
  misc_feature: Encodes the peptide sequence at SEQ ID NO. 12138
  misc_feature (431)..(431): n is a, c, t, g, unknown, or other
  misc_feature (561)..(561): n is a, c, t, g, unknown, or other
  misc_feature (562)..(562): n is a, c, t, g, unknown, or other
  misc_feature (585)..(585): n is a, c, t, g, unknown, or other
aaagctggagctccccgcggtggcggccgctctagaactagtggatcccccgggctgcaggaattcgcacgagaccattacctagaacatcctaatcgaaaaactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccggcggcgcaggcgctccgctctacctctccctctccgcccggtgggcgcgcactcctgctcggattggctggtgagatgcccaaaggctttgtgatcttagnatgatgttggtgcacacaccctgactaatttgcacagtattcacaaaagcttactaattttggcaggccaaggctgagggaacaattctcagaaagtgtactttatgaattttggagagaggtccaaggnncttttggtgatggcacatatcanacactcactagactcgggagcaatggacgccctgtccaatacattttgcattctc

SEQ ID NO: 12138 - protein, 96 aa, Zea mays
  misc_feature: Ceres CLONE 1369509-F
MATSPPQNPSSGEPSDASSLAAAALEAPVRVWRSLVARFPPLPDSSSFLAGVSDLQLRYFGNSRPRRRRRSALPLPLRPVGAHSCSDWLVRCPKAL

SEQ ID NO: 12139 - DNA, 678 bp, Zea mays
  misc_feature: Ceres CLONE 1369521-F
  misc_feature: Encodes the peptide sequence at SEQ ID NO. 12140
  misc_feature (305)..(305): n is a, c, t, g, unknown, or other
  misc_feature (385)..(385): n is a, c, t, g, unknown, or other
  misc_feature (394)..(394): n is a, c, t, g, unknown, or other
aaagctggagctccccgcggtggcggccgctctagaactagtggatcccccgggctgcaggaattcgcacgagaccattacctagacatcctaaaaaaaactgaggcgagggagagagagagagagtgagtgagtgagtaatgggcggttcatcaggccttgtggactggagaggacggccggtgaacaccaagaagcatggaggagtgagagcttcaattttcattcatgcgctggtgctgctcagcaacgtagcccacattgccagtatactgaatcttgtaagctatctgcgcgaggaatgncacatggatgtcgcgagggcgacgacgatggcgagcaattttcttttgcgcgctgcaaatgttctccatccagcagcttnccttgctgnactctacatcagcgtttctacactgtcctcatctttggccccaattgaatactggctacatccctgctcggggcccaggaaatgtcccttcctggacaaacaacgggggtccctggaaaagaaaaagacacggggagccccgggaggggtttaaactagaccgggcccccgggggtccttccgggccccccgggggaaggggggggtttggaatttcccccgtttttggggggggagaatttccagggggggttccccaaaaaaaaagggggggtttttttttt

SEQ ID NO: 12140 - protein, 135 aa, Zea mays
  misc_feature: Ceres CLONE 1369521-F
  misc_feature (55)..(55): Xaa is any aa, unknown, or other
  misc_feature (82)..(82): Xaa is any aa, unknown, or other
  misc_feature (85)..(85): Xaa is any aa, unknown, or other
MGGSSGLVDWRGRPVNTKKHGGVRASIFIHALVLLSNVAHIASILNLVSYLREEXHMDVARATTMASNFLLRAANVLHPAAXLAXLYISVSTLSSSLAPIEYWLHPCSGPRKCPFLDKQRGSLEKKKTRGAPGGV

SEQ ID NO: 12141 - DNA, 647 bp, Zea mays
  misc_feature: Ceres CLONE 1369529-F
  misc_feature: Encodes the peptide sequence at SEQ ID NO. 12142
  misc_feature (337)..(337): n is a, c, t, g, unknown, or other
  misc_feature (376)..(376): n is a, c, t, g, unknown, or other
  misc_feature (410)..(410): n is a, c, t, g, unknown, or other
  misc_feature (492)..(492): n is a, c, t, g, unknown, or other
tccccgcggtggcggccgctctagaactagtggatcccccgggctgcaggaattcgcacgagaccattacctagaacatcctaatcgaaaaagttggaccggccgttgttgctttgcgtcttcgccaaaaacagaataagcttgtcttgctccgatcaggcgtgttcttaggcttcgctgcccctaccgcgtcttcgccgggatcggtccatggccggcgccgagcgcgcggaggcggtcgcgctggaacaagggctcctcgatccggaggaatccaaccaagtagtatacactggagatggatcagtcgacttttctggaaatcctgttgtcaggnaaagaacgggtagatggaaggcatgtccattcatattangtaatgaatgctgtgaacgactggcctactatgncatctccacaaacttggtacttacttgacaaaaaaactgcatgctggcaatggctctgctgctagcagtgtgactacatggntcgggaacttgctacttaactccacttatgggagcatcctggctgatgaaacgggggggaggtactggacaatcgcaacattttcaaggatacttcatcgggatgacctgctgactctttcaaatcagtcctatgtcagtgccccttcctgggga

SEQ ID NO: 12142 - protein, 75 aa, Zea mays
  misc_feature: Ceres CLONE 1369529-F
  misc_feature (43)..(43): Xaa is any aa, unknown, or other
  misc_feature (56)..(56): Xaa is any aa, unknown, or other
  misc_feature (67)..(67): Xaa is any aa, unknown, or other
MAGAERAEAVALEQGLLDPEESNQVVYTGDGSVDFSGNPVVRXRTGRWKACPFILXNECCERLAYYXISTNLVLT

SEQ ID NO: 12143 - DNA, 980 bp, Zea mays
  misc_feature: Ceres CLONE 1369533
  misc_feature: Encodes the peptide sequence at SEQ ID NO. 12144
aactgacgcggtcaccctcgcccccaacacagagagaaggtctgctctccaccggatggactcccacggcaagcccaagcccgccggttcgccgccgccgacgccgccgactccgccgacaccgccgactccgccgacgccgccgacaccgccgacgccgccgacgccgccgacgccgccgacgctgccgacgccgccgacgccgctgacgccgccgacgccgccgacgcccgaggcgaggaaggggttcatgcgccgcatcttccctttcctcctagccgccaacctctttgttggagcttatgtcctcgtgcgggccaaccaaaaggactcagcaaagaaggacccaacgactgatcctgctactgcaactgctgggaagcctgctgagccagtctctatccccagaaaggagctcccaccaatccctgaagatgaccagcgcaagctctacaaatggatgctggaagagaagcggaagatcaagccacgcaatgctgccgagaagaagaaactcgatgaggagaaggcccttctaaaagagttcatccgagcaggatccctcccaagcttatgagctcacccatttgggtctcttgtgcctgatgttcagccaagaagatgattgggcctgattggattgtgtacaaacacagtactgtgctatcttgtaaactgatgtctccatgatgtagcctcctcgagttcaaaggttgtgtggatgcaaactagtgttgtgtgcattggttctagagattcttcaaggctaaaaaaacttcagtgtgtcaaattcttctgttccattccatccgcaatttgctccgttgacaattttatgttctgtggctctcgtgtgatgagtgaactcatcgcgtgtgatgagctcatcgattgccatgtactgtattgttgagaccccaactgggccccaaccctatttagaatgttcttaaccgcgtagtgcaaaaaaaaaaaaaaaa

SEQ ID NO: 12144 - protein, 173 aa, Zea mays
  misc_feature: Ceres CLONE 1369533
MDSHGKPKPAGSPPPTPPTPPTPPTPPTPPTPPTPPTPPTPPTLPTPPTPLTPPTPPTPEARKGFMRRIFPFLLAANLFVGAYVLVRANQKDSAKKDPTTDPATATAGKPAEPVSIPRKELPPIPEDDQRKLYKWMLEEKRKIKPRNAAEKKKLDEEKALLKEFIRAGSLPSL

SEQ ID NO: 12145 - DNA, 660 bp, Zea mays
  misc_feature: Ceres CLONE 1369554-F
  misc_feature: Encodes the peptide sequence at SEQ ID NO. 12146
  misc_feature (348)..(348): n is a, c, t, g, unknown, or other
  misc_feature (368)..(368): n is a, c, t, g, unknown, or other
  misc_feature (459)..(459): n is a, c, t, g, unknown, or other
  misc_feature (460)..(460): n is a, c, t, g, unknown, or other
  misc_feature (519)..(519): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (619)..(619): n is a, c, t, g, unknown, or other
  misc_feature (630)..(630): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (640)..(640): n is a, c, t, g, unknown, or other
aaagctggagctccccgcggtggcggccgctctagaactagtggatcccccgggctgcaggaattcgcacgagaccattacctagaacatcctaatcgaaaaatctcatatcattcgtctgttctgtccttgatgtgctaaacgcgtgcatgcaggcgcgatctgcgggccggcgagcctggtgaacgcgatgatggacctgcaggagggggcgctgatgctgctgggccccacgatgaacgccaaggtggcgttcgagctgtcggagcggctgccacacctgccgctgcggatgcaggagcactcgcgccgcgcgctggcgttcgccgagcggatgcaggggctggngcctgcgcgtgctgtaccgnggcctcccgggccacccgcaccacgcgcgcctggccgccatgggcaacccgggcttacggctggcggcggcatgctgtgcctcgacatggnngcaccgaggagcgcgccaaccgcctcatgcaccacctccgaacaccaacccagttcggncctcatggccgtcagcctcggctactacgagacgctcatgtcctgctccggcagcagcaccagcagcgagaggccgcccgaggaccnnnncgcgcgcggnatctcccggcntcgnnnnncntagtggtcgtcggctaaaac

SEQ ID NO: 12146 - protein, 148 aa, Zea mays
  misc_feature: Ceres CLONE 1369554-F
  misc_feature (53)..(53): Xaa is any aa, unknown, or other
  misc_feature (60)..(60): Xaa is any aa, unknown, or other
  misc_feature (90)..(90): Xaa is any aa, unknown, or other
  misc_feature (110)..(110): Xaa is any aa, unknown, or other
  misc_feature (139)..(139): Xaa is any aa, unknown, or other
  misc_feature (140)..(140): Xaa is any aa, unknown, or other
  misc_feature (147)..(147): Xaa is any aa, unknown, or other
MMDLQEGALMLLGPTMNAKVAFELSERLPHLPLRMQEHSRRALAFAERMQGLXPARAVPXPPGPPAPRAPGRHGQPGLTAGGGMLCLDMXAPRSAPTASCTTSEHQPSSXLMAVSLGYYETLMSCSGSSTSSERPPEDXXARGISRXR

SEQ ID NO: 12147 - DNA, 660 bp, Zea mays
  misc_feature: Ceres CLONE 1369630-F
  misc_feature: Encodes the peptide sequence at SEQ ID NO. 12148
  misc_feature (574)..(574): n is a, c, t, g, unknown, or other
  misc_feature (631)..(631): n is a, c, t, g, unknown, or other
  misc_feature (651)..(651): n is a, c, t, g, unknown, or other
aaagctggagctccccgcggtggcggccgctctagaactagtggatcccccgggctgcaggaattcgcacgagaccattacctagaacatcctaatcgaaaaacgttgttcctcccgaccctcgccgtccctcccgccgcgacccgccctcctcctcccgaccacgccgcccagcccgtgtaccactccctcccagcctcgccctcccacgccgtccctcccgccgtgacccttcctcctcctcccgacctcgccgcctagcccgtgtcgccgccgtcgcccgtgccactctgctgctgcgaccacgacaatggggatgtggaatttggtgtgcgtcaccgacgcatcagcgtacatcgcgtcctggatcgtcaggctcctcctcgaccgtggctacaccgtccgcgccaccgtgcgagacacagcctttggaaatgtagagcccacctcagttgatctattcaagaacttccattatagcaaaaacaatggatttaccgagtttgtacagaaagcaattgatgatatggaaggcatcatgagtgaaccagtacaagatggacatgaaccaaangtagcaaatgaagttgttttctcaggttgtcaaaatcaactaacttttcttcgcgtngcacaggtgttttgttcggncctccaaga

SEQ ID NO: 12148 - protein, 116 aa, Zea mays
  misc_feature: Ceres CLONE 1369630-F
  misc_feature: SWISSPROT Homolog: EC 1.1.1.219 Dihydrokaempferol 4-reductase
  misc_feature (88)..(88): Xaa is any aa, unknown, or other
  misc_feature (114)..(114): Xaa is any aa, unknown, or other
MGMWNLVCVTDASAYIASWIVRLLLDRGYTVRATVRDTAFGNVEPTSVDLFKNFHYSKNNGFTEFVQKAIDDMEGIMSEPVQDGHEPXVANEVVFSGCQNQLTFLRVAQVFCSXLQ

SEQ ID NO: 12149 - DNA, 563 bp, Zea mays
  misc_feature: Ceres CLONE 1369650-F
  misc_feature (277)..(277): n is a, c, t, g, unknown, or other
  misc_feature (291)..(291): n is a, c, t, g, unknown, or other
aagctggagctccccgcggtggcggccgctctagaactagtggatcccccgggctgcaggaattcgcacgagaccattacctagaacatcctaatcgaaaaagaaatccatcccgatcctatcgtccccaatttcttctgctccacctaaatagatccgtagccgtagcctaggcgcgcacattgcagaaagatcgagcgaaaggtcggcagcaggcgcatagatgcaggggtgagggcacgggcggcagcgcttgacgggcgacgagtaaaccctnacgctttgattgcngggcggcgtcgtctgagccagtccccgagtccgaaaggctgccatgcttggcaaaccccccccgcccaccccccgggggccccccttttttgggtcccgggggggcaatatttcccgctcctttccccggggaaaacaaccccccccccccaaggggggcccccccatggggggggagagtttttataaattttaaaaaggggggtttggggccctattttttctcgggggggggggggaaaaaaaatcccccgggggggggggagggggga

SEQ ID NO: 12150 - DNA, 648 bp, Zea mays
  misc_feature: Ceres CLONE 1369657-F
  misc_feature: Encodes the peptide sequence at SEQ ID NO. 12151
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (628)..(628): n is a, c, t, g, unknown, or other
gctggagctccccgcggtggcggccgctctagaactagtggatcccccgggctgcaggaattcgcacgagaccattacctagaacatcctaatcgaaaaagatcgttccgtaagggcacccatcgtcatagatacgattcatagcttctgccactacttgtgcgcgaagagccaagaaatgcgtcaggggttgtgaagggaaggagtgccgatggccggtggccacccggcgccgctgcggcctgtggtggttgcgatgaaaggccacccagggtctggcaagtccacggcggcgcgcgccatcgcgaccgcgctttgctgtccgctcctggacaaggacgatgtgagggactgcatgttgcccctagagggcttggctgctgctgggatgctcaacgacctctcctacgccgtgctgtggcggatggctgagcgccaggtaaggctcggactgtctgtcgtcatcgattcaccgctgtcacgccgctctcacctcgacatgctgacacgcctagccggtgtgcttgtggtcgtcgtggagtgtcgccctggtgataacgaggaatggcgcccggagctggagaccgtggtcgtgcaacaaatggggggggggggnnnnnnaaaaatnataaaaatttaaaatttttt

SEQ ID NO: 12151 - protein, 142 aa, Zea mays
  misc_feature: Ceres CLONE 1369657-F
  misc_feature: SWISSPROT Homolog: EC 2.7.4.14 Cytidylate kinase
  misc_feature (136)..(136): Xaa is any aa, unknown, or other
  misc_feature (137)..(137): Xaa is any aa, unknown, or other
  misc_feature (139)..(139): Xaa is any aa, unknown, or other
MAGGHPAPLRPVVVAMKGHPGSGKSTAARAIATALCCPLLDKDDVRDCMLPLEGLAAAGMLNDLSYAVLWRMAERQVRLGLSVVIDSPLSRRSHLDMLTRLAGVLVVVVECRPGDNEEWRPELETVVVQQMGGGGXXKXIKI

SEQ ID NO: 12152 - DNA, 635 bp, Zea mays
  misc_feature: Ceres CLONE 1369671-F
  misc_feature: Encodes the peptide sequence at SEQ ID NO. 12153
  misc_feature (219)..(219): n is a, c, t, g, unknown, or other
  misc_feature (367)..(367): n is a, c, t, g, unknown, or other
aagctggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcnacccaggcgcgttcgcatgcggtgcgtggggcggctcaggtcccaccgtcacctccacgagcccgaccaacaatcaggtcatcgcagaggtcgtggaggcgtccgtgcacgactacaaaagaggcatgcgcggctgcttcgatgccgncagacatggatggcgattcctggtccaagcgaggagagatcggtaggcaaatccgtgatgccatgagagcgaagctccatcaccttggcagggttgtgtcacattgagatggggaaaattcttcctgaaaggatcggtggaggttcaagaaatcatcgacatgtgtgattatagctgtgggggctaagtcgccactaaatggattcattattaccatctgaacgacaaacattgatgggtgggggggggtggatcccttggggggggg

SEQ ID NO: 12153 - protein, 84 aa, Zea mays
  misc_feature: Ceres CLONE 1369671-F
  misc_feature: SWISSPROT Homolog: EC 1.2.1.3 Aldehyde dehydrogenase (NAD(+))
  misc_feature (21)..(21): Xaa is any aa, unknown, or other
  misc_feature (70)..(70): Xaa is any aa, unknown, or other
MGAFAKEEHQFLAELGLAQRXPGAFACGAWGGSGPTVTSTSPTNNQVIAEVVEASVHDYKRGMRGCFDAXRHGWRFLVQARRDR

SEQ ID NO: 12154 - DNA, 673 bp, Zea mays
  misc_feature: Ceres CLONE 1369681-F
  misc_feature (531)..(531): n is a, c, t, g, unknown, or other
  misc_feature (571)..(571): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (634)..(634): n is a, c, t, g, unknown, or other
  misc_feature (639)..(639): n is a, c, t, g, unknown, or other
  misc_feature (657)..(657): n is a, c, t, g, unknown, or other
aagctggagctccccgcggtggcggccgctctagaactagtggatcccccgggctgcaggaattcgcacgagaccattacctagaacatcctaatcgaaaaaccaacagccaatccacacctcgcttgcgttgtcctcgccgcggcctcgccctgattcggttcccccgttcctcgcctctgtcatcgtctcctctgacccaaattgagccaagcgaagccgtggccgtgatccggtccatgcgcggagcgtggtagccggattctatcgccgtcgcctccccttcgccgctattttccagtcgccgggatcagccgagttggatctcgaggcataaagcgttgcgggcgcccggcgaggatacgatgcctgcggtgctcgccgcattcgctacccttcgagccgccgctgccatcgcctccggggactcctccttccccctgttccatcgtctcaagcatcgttttagtagtagtaattttagtagtagtaattgtcattaaactttgcgttcccctcgtcgcgcagctncctcggttcggtctcactttcccatttttcgtttttgggntctggtttgtgctcgatcgaggctttaactttgggttttggcgcttctctcttgnnnnaaagnttggnggtctggattcgacctgncagatcgaaggggaaa

SEQ ID NO: 12155 - DNA, 642 bp, Zea mays
  misc_feature: Ceres CLONE 1369687-F
  misc_feature: Encodes the peptide sequence at SEQ ID NO. 12156
tggagctccccgcggtggcggccgctctagaactagtggatcccccgggctgcaggaattcgcacgagaccattacctagaacatcctaaaaaaaaaggaattctgccttcttctctcatcttcctgctcaacatcagtagcagctttagctgtagcagcgccaccggccaccgccacgctatggccaccacgttgcacaagcccctgggggcgatcaccgttgacgacctcgccgcggcggcgcctgggtcggacgccaccgcgctccacgcagcgctccggcgcgcgctcgactcgcacggacccaccgaagtgtggggcgagctctgccggtccgtgctctgtccgtctgtcaccttcgccgtacaccggatgctctactacggttgcttcgccgggttccagtctcccacgccgccgcctggacgcccgaccccatggaggctgtcttgaccaatgtcggccgtgtcctcgaggcgcgtgataggcacttcatcggcgacgcgtacaaggatccccatcacagcttcccagaccctcacaagttctccaacgagaacccagagtagtactggaaagatgtactttgaggatatgggtatccaattcagcgtagagccatcctgcatctggagagagac

SEQ ID NO: 12156 - protein, 90 aa, Zea mays
  misc_feature: Ceres CLONE 1369687-F
MATTLHKPLGAITVDDLAAAAPGSDATALHAALRRALDSHGPTEVWGELCRSVLCPSVTFAVHRMLYYGCFAGFQSPTPPPGRPTPWRLS

SEQ ID NO: 12157 - DNA, 646 bp, Zea mays
  misc_feature: Ceres CLONE 1369690-F
  misc_feature: Encodes the peptide sequence at SEQ ID NO. 12158
ggagctccccgcggtggcggccgctctataactagtggatcccccgggctgcaggaattcgcacgagaccattacctagaacatcctaatcgaaaaactagtcccaactcccaaccaccgccagccgtccgctctccgcaagcgcgaccttccggccagatccgccgcgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacggtgatcgtgcgaggtgggacgccatcagtgctctgtctggggttcggtctcttcttcggctgcagatctggaaaggtttcgtggtatccgccgctacgatctgtcccagtcaaagcacctgcatcatctcgggtcgggccatggagactctgctcatctcgggaggagcgcaaccaccagctccaccacttctcgggccgccggaagaaggtgttagcagcgccgcctcagtccactcgcaggtacaatgcgggcaactgccgggggttccactcccgaatcaccggcgggaatcctgccggtccccgcccggggaaaagggttgccctga

SEQ ID NO: 12158 - protein, 63 aa, Zea mays
  misc_feature: Ceres CLONE 1369690-F
METLLISGGAQPPAPPLLGPPEEGVSSAASVHSQVQCGQLPGVPLPNHRRESCRSPPGEKGCP

SEQ ID NO: 12159 - DNA, 648 bp, Zea mays
  misc_feature: Ceres CLONE 1369697-F
  misc_feature: Encodes the peptide sequence at SEQ ID NO. 12160
aagctggagctccccgcggtggcggccgctctagaactagtggatcccccgggctgcaggaattcgcacgagaccattacctagaacatcctaatcgaaaacctttcgggcagaaagagccagagagagagagagagagaggtcggggctggggagcacacacccatcacccatggcctgactgacctccggactctccctgcttccgtcgccgccgcgggccgcccagctgactgctcctgccctccgcccgccctccatggcgtccgtcaagctcggctccaagcctgacgccttcaagcggcaaggccaggcatggttctgcacaacaggacttcctagcgatgtcaccgttgaggttggggatatgtctttccaccttcacaagttccctttactttcaaaaagtgcctttcttgaacggtcaattgaagaaaattctgaccaagaagaatgcatcatcaaactaaatgacattcctgggggtgccaagtcatttgagctagttgcaaggttctgctatggtgtgaaaatagagctttcacctgcaaatgttgtctaacctacggtgtgcctcagagcatctagaaatgactgaagaagtagctgaggaaaacctgattgcacagtcagaaatgtcctcccacc

SEQ ID NO: 12160 - protein, 100 aa, Zea mays
  misc_feature: Ceres CLONE 1369697-F
MASVKLGSKPDAFKRQGQAWFCTTGLPSDVTVEVGDMSFHLHKFPLLSKSAFLERSIEENSDQEECIIKLNDIPGGAKSFELVARFCYGVKIELSPANVV

SEQ ID NO: 12161 - DNA, 666 bp, Zea mays
  misc_feature: Ceres CLONE 1369699-F
  misc_feature: Encodes the peptide sequence at SEQ ID NO. 12162
  misc_feature (531)..(531): n is a, c, t, g, unknown, or other
  misc_feature (612)..(612): n is a, c, t, g, unknown, or other
  misc_feature (637)..(637): n is a, c, t, g, unknown, or other
aaagctggagctccccgcggtggcggccgctctagaactagtggatcccccgggctgcaggaattcgcacgagaccattacctagaacatcctaattgaaaaacatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccacccccaacgtcgtgcagctgcnacgaggtgatggccagcaagagcagatatcttcgccatgaaagtacgttccgggggcggcgagcttcttcgcccgcgtcgncccgcggcgggttccaaggaggacncccgccgagaaggtacttcaccagcttcc

SEQ ID NO: 12162 - protein, 78 aa, Zea mays
  misc_feature: Ceres CLONE 1369699-F
  misc_feature: SWISSPROT Homolog: EC 2.7.11.1 Non-specific serine/threonine protein kinase
MEKKPTILMNRYELGRTLGQGTFAKVYHGRNLASGESVAIKVIDKEKVMRVGMIDQIKREISVMRLVRHPQRRAAATR

SEQ ID NO: 12163 - DNA, 673 bp, Zea mays
  misc_feature: Ceres CLONE 1369706-F
  misc_feature: Encodes the peptide sequence at SEQ ID NO. 12164
agagctggagctccccgcggtggcggccgctctagaactagtggatcccccgggctgcaggaattcgcacgagaccattacctagaacatcctaatcgaaaaaccgtccccgtctcaccgcactgcttaccccctcctctcgtctgcctcgcttagcttagccgccgctgctacgcactctcgccgtccttgttcccgcgtcgctctgctcgcgatggcgtcccgcgttgcagtgctgctcgtggccgtggcggccgtgctgttcgccgcggcgtcggcgcaggagatggacctgggcgtgccgcccgcgccggcgcccgtcacgggcgcggcagcggggaccgcggcatcggccctggtcgtggcttgctctgccgtcttctccatcctcgtcgccggtcgcctcgtgcagtaggcgctgccgtcgacgtggttcggggtccggcggagccctgttcgatcgttttcgccttagctagtagcagaagtagcagccatgggctgcgttgattgtttccctgtctcccacctggtgggcgttgtgaccttgtgctattgcttattctttttggaccatactgcattggtccacgtataccttgcgttgaggccggtgttgtatgaataaagatgatggatcccgtccgtcaatcgccattaggactgctggggc

SEQ ID NO: 12164 - protein, 66 aa, Zea mays
  misc_feature: Ceres CLONE 1369706-F
MASRVAVLLVAVAAVLFAAASAQEMDLGVPPAPAPVTGAAAGTAASALVVACSAVFSILVAGRLVQ

SEQ ID NO: 12165 - DNA, 715 bp, Zea mays
  misc_feature: Ceres CLONE 1369707-F
  misc_feature: Translation starting site: 131
  misc_feature: Pfam Name: Ank Pfam Description: Ankyrin repeat
  misc_feature (277)..(277): n is a, c, t, g, unknown, or other
  misc_feature (357)..(357): n is a, c, t, g, unknown, or other
  misc_feature (363)..(363): n is a, c, t, g, unknown, or other
  misc_feature (425)..(425): n is a, c, t, g, unknown, or other
tggagctccccgcggtggcggccgctctagaactagtggatcccccgggctgcaggaattcgcacgagaccattacctagaacatcctaatcgaaaaacaactcgaagtacgagtaactccggagtccggatggctgcagcgatggacgtcgacgaagccggcggcgaggagaggcgaccgtcagagaaggagctcttccgcgccgctgagtccggcgacgccgccgcgttcgcctccctcgcccccgccgacctctccctgcgcaacgaggacggncgctccctcctccacgtcgccgccgctgccgggcatcccccagtgatgctcgcgcttgcccagtgcggtggtgacgccgncgctancgtgcttaatgcgcagggacgagagggggtgggcgcccatccactcccgcgcgagctccggnaactctcaaatcgtcgacatcctgcttgagcgaggggctgatggtaactggttactggaggggggtcgacctgcccttcctaatggtgcaaggaaagggagggttaaacttagttgaaaaacataaagcccctgggggttatggcaccaaaaaaagacaagttgggggggcccccttttgcaaaaaaccttgcaaccttggaaaccgcgggggttgggtgaattccccttttagagaaagggcttaaaatttaagtgtttttaaaaaaaaaggaaaaaacccctttttgg

SEQ ID NO: 12166 - DNA, 666 bp, Zea mays
  misc_feature: Ceres CLONE 1369714-F
  misc_feature: Translation starting site: 130
  misc_feature: Pfam Name: SPRY Pfam Description: SPRY domain
  misc_feature (494)..(494): n is a, c, t, g, unknown, or other
  misc_feature (633)..(633): n is a, c, t, g, unknown, or other
ggagctccccgcggtggcggccgctctagaactagtggatcccccgggctgcaggaattcgcacgagaccattacctagaacatcctaatcaaaaatactgttttcccttctcgggagtggataggcgaatggtgacgaaccaggacgcggaggcggcagcgccaggggcaggggcggcggtagatccgatgcggctagcatcgcggtggcggcgatcccggccagagtggaactgcgcgtcggcggagctggaggctgagccgtccgagctcaacaccgtcaacagctcgggactcttctccgtcgtctctaccgacaagttatcggtaaaatacctcggcagccatcaccacggccacgacgtcggtgtcgtgcaggccgaccgtcccgcgccgacgcgccgagccgtgtactacttcgagatgggcgtcaggaatgctgggatacaggggcagacatccattggggtcacgagcgagagctttcagatgangcgaccaccgggcggggagacaaacagtgtggataccatggtgacgacggccatcttttatcgggtcaagggaaaagtgaatcatttgggcaaaaattcccatctggggacataatttgggctggcatccactacttgncccaagaatttttcttcccaaaaaggggacttt

SEQ ID NO: 12167 - DNA, 665 bp, Zea mays
  misc_feature: Ceres CLONE 1369720-F
  misc_feature: Encodes the peptide sequence at SEQ ID NO. 12168
  misc_feature (293)..(293): n is a, c, t, g, unknown, or other
  misc_feature (389)..(389): n is a, c, t, g, unknown, or other
  misc_feature (526)..(526): n is a, c, t, g, unknown, or other
  misc_feature (530)..(530): n is a, c, t, g, unknown, or other
aaagctggagctccccgcggtggcggccgctctagaactagtggatcccccgggctgcaggaattcgcacgagaccattacctagaacatcctaatcgaaaaaccagagtcatcgcggcgtgttcaaatcccacaatcttcttgtagcacaccactgtcttcgtccaactcggcggcgatgtctgggcgcggcaagggcggcaaggggctgggcaagggtggtgcgaaacgccaccgtaaggttctccgcgacaacatccagggtatcacgaagcccggcatccggaggctgncgaggagggggcgcgtgaaacgtatctcggggcttatctacgaggagacccgcggcgtgctcaaaatcttcctcgagaatgtcatcggcgacgcgntcacctacaccgagcacgctcgccgcaagaccgtcaccgccatggaatgtgtgtacgccctcaagcggccaggcccgcactctgtacgggttcggtgggtgagcgcatctcttccctcgtctgcagcgggtgcgggnggcntttcctcagtcccctctgccttgcttgcctggatgaaaaaagttatcagataaaaatatctcggatgggcttcggtattggggggaatccatggccccagcagggctggaaatcaagataaaatgattcttcttt

SEQ ID NO: 12168 - protein, 134 aa, Zea mays
  misc_feature: Ceres CLONE 1369720-F
  misc_feature (25)..(94): Pfam Name: Histone Pfam Description: Core histone H2A/H2B/H3/H4
  misc_feature (39)..(39): Xaa is any aa, unknown, or other
  misc_feature (71)..(71): Xaa is any aa, unknown, or other
  misc_feature (118)..(118): Xaa is any aa, unknown, or other
MSGRGKGGKGLGKGGAKRHRKVLRDNIQGITKPGIRRLXRRGRVKRISGLIYEETRGVLKIFLENVIGDAXTYTEHARRKTVTAMECVYALKRPGPHSVRVRWVSASLPSSAAGAGGXSSVPSALLAWMKKVIR

SEQ ID NO: 12169 - DNA, 697 bp, Zea mays
  misc_feature: Ceres CLONE 1369721-F
  misc_feature: Encodes the peptide sequence at SEQ ID NO. 12170
aaagctggagctccccgcggtggcggccgctctagaactagtggatcccccgggctgcaggaattcgcacgagaccattacctagaacatcctaatcaaaactctatcttcgcatctggcacgagcagccaagcaaataaaagtagagcggcgagcgacgaccggcctgggccactctttcggccgagcgtagccagcaggtcgtcgtcgtcgtcgtcgtcgcagcacccggccggctagcatggccacgaggaggcagtggtggtggtggtgcctgctgctgctggcggcgtggtgctgcgccgccgccgcgcagtcgccgccggcggcggacccgctgcagagcaagtgccagggggacttcgggaagctgacggactgcatggactacgcgacggggcacgcggcgtcgccctcgtccacctgctgcggggacgccggcgacacggagaaggcgcgccccgagtgcctctgctacatcatccagcagacgcacaccgggggcgcaaccagggtggcaggcgctcggactgcgcttcgaccgactcatggcgctccccggcgcctggaaccttcccaactccaacgtttcgctcggcatccccctgctgaacctgaaaccgggcttctgggaattacgcctccttcgcaacgccttcaaagatcacgcccgtcggcggcggaaacccttggagag

SEQ ID NO: 12170 - protein, 152 aa, Zea mays
  misc_feature: Ceres CLONE 1369721-F
MATRRQWWWWCLLLLAAWCCAAAAQSPPAADPLQSKCQGDFGKLTDCMDYATGHAASPSSTCCGDAGDTEKARPECLCYIIQQTHTGGATRVAGARTALRPTHGAPRRLEPSQLQRFARHPPAEPETGLLGITPPSQRLQRSRPSAAETLGE

SEQ ID NO: 12171 - DNA, 535 bp, Zea mays
  misc_feature: Ceres CLONE 1369725-F
  misc_feature (213)..(213): n is a, c, t, g, unknown, or other
  misc_feature (243)..(243): n is a, c, t, g, unknown, or other
tggagctccccgcggtggcggccgctctagaactagtggatcccccgggctgcaggaattcgcacgagaccattacctagaacatcctaatccaaaaacaccaacccgttctgcctccgcttcgatcatggggtggtcgcgctttcgtcgccgccatcaacggtgtcgctatctcctccctatccggcgtccgcgatgctcgccacccctccntcccccacgcgtcgggacgctcgccatggntcgccctccctccccttccgggtccggcttcggttcccctttcggccctttcggtgcggggggggttgggaaaaaaggtcagaaacccccaaatcccccaggggggccattttgcccacctttcctggaagcccgaatcccggcggtccccacattggcctggggtggggcccaaaccaattccttttatggccttaaaagggaaattttttcgcccaacccacccccccggggggggggtcccccccccccggggcggggttttccacacccccctccccaagaggaatat

SEQ ID NO: 12172 - DNA, 673 bp, Zea mays
  misc_feature: Ceres CLONE 1369734-F
  misc_feature: Encodes the peptide sequence at SEQ ID NO. 12173
  misc_feature (422)..(422): n is a, c, t, g, unknown, or other
  misc_feature (455)..(455): n is a, c, t, g, unknown, or other
  misc_feature (499)..(499): n is a, c, t, g, unknown, or other
  misc_feature (546)..(546): n is a, c, t, g, unknown, or other
  misc_feature (556)..(556): n is a, c, t, g, unknown, or other
aaagctggagctccccgcggtggcggccgctctagaactagtggatcccccgggctgcaggaattcgcacgagaccattacctagaacatcctaatcaaaatctcctgccgccgccgccgctcccgctcccagctcgtgttccgcttcttgcagccgtcgccgcgaagcgctccagagaacttccgtcaacatggggaagacacgtggtatgggagccgggcgcaagctcaagacccaccgcaggaaccagcggtgggctgacaaggcatacaagaagagccatttgggcaatgagtggaagaaacccttcgctgggtcatcccatgccaagggcattgtcctggagaagattggtattgaggccaagcagcccaactccgctatccgtaagtgtgctcgtgttcagcttgttaagaatggncagaagattgctgccttcgtgccagatgacggntgtttgaactacattgaggaaaatgatgaggtcttgattgctgnatttggtcgtaaggggcacgctgtgagagatattcctggtgtcgggntcaggtcgtncaggtttccgtgtgtctctgcctgccttttcaagaaagaaagaaaagccagggcttaaatggttctgctacaaaatccacaaggtggatttaaacggagggcgttaaatattaaaaa

SEQ ID NO: 12173 - protein, 140 aa, Zea mays
  misc_feature: Ceres CLONE 1369734-F
  misc_feature (8)..(141): Pfam Name: Ribosomal_S12 Pfam Description: Ribosomal protein S12
  misc_feature (103)..(103): Xaa is any aa, unknown, or other
  misc_feature (119)..(119): Xaa is any aa, unknown, or other
  misc_feature (122)..(122): Xaa is any aa, unknown, or other
MGKTRGMGAGRKLKTHRRNQRWADKAYKKSHLGNEWKKPFAGSSHAKGIVLEKIGIEAKQPNSAIRKCARVQLVKNGQKIAAFVPDDGCLNYIEENDEVLIAXFGRKGHAVRDIPGVGXRSXRFPCVSACLFKKERKARA

SEQ ID NO: 12174 - DNA, 664 bp, Zea mays
  misc_feature: Ceres CLONE 1369737-F
  misc_feature: Encodes the peptide sequence at SEQ ID NO. 12175
aaagctggagctccccgcggtggcggccgctctagaactagtggatcccccgggctgcaggaattcgcacgagaccattacctagaacatcctaatcaaaaaagatcagagagaccgaggcgcccgcggttctgctttccttccttgccccgttcacgagagaattttctggagtcttcgactcgagcagggttccgatggcgctgcaatggatgatcctgacgtgcgtgctgacggtgtaagctgcggtggctgcgctggtcacgctcccggtgccccgcgctgtgcggggacagatcgtcgcgctcacgtccttgttcctgcagcccctgtccagtgtgatacccttcgccgccttccagatcctcgatctctactggaagaagggagcacagactgatgtgcacctcggagatttgcaccgccgaagagcgcattcgcttcgagaaatctatggttaaagctcagagaaatgtcattctttgtgtttcagcatgtctcctttattggtgcattatcggattgcaaaatggaacaaggatattagggctttgaaagagaccgagaacgcctcagggaagagacatctattgtgtttaagggggctggtgtctgctcctggtcttcagagatattgtaaaatatcagggtcataggaatctag

SEQ ID NO: 12175 - protein, 51 aa, Zea mays
  misc_feature: Ceres CLONE 1369737-F
MCTSEICTAEERIRFEKSMVKAQRNVILCVSACLLYWCIIGLQNGTRILGL

SEQ ID NO: 12176 - DNA, 718 bp, Zea mays
  misc_feature: Ceres CLONE 1369741-F
  misc_feature: Encodes the peptide sequence at SEQ ID NO. 12177
aaagctggagctccccgcggtggcggccgctctagaactagtggatcccccgggctgcaggaattcgcacgagaccattacctagaacatcctaatcgaaaaagctgaaagcagccaaaacgcagaagctgcactgcatacatcgagctaactatctgcagcgatgtctcgctcctgctgcgtcgccgtgtcggtgcttctcgctgtcgccgcgacagccagcgccaccgcgccggcatggctgcacgaggaggccatggccacgggcccgctggtcgcagagggtgcaagggtggcgccctccgcgtccacctgggctgccgacaaggcgtctccggcgaggccgagcggcggcatggccacgccccccgacgaccagagctcgtccggcgtcagcgccagcagcggtgagcacggaaaggaggagggcgaaaaacgggccaagacctgcctcaccaaggaggagtgccccaagaaaaaagatgatctggcggaaaggcctgcaccgcctctcgccgcacaggcaagggcccccgccagtgcaaccaagtccctgtgtcccccaccctgctaagaagcccgaaggcccgaagcttggccggcgggccaagacctccaaaccgaatcgagggcctccccttccactccctttggtaaaaagttccctgggggggcccgcccgtttgccccttccctccccgaaaaaaccaaaggggaa

SEQ ID NO: 12177 - protein, 136 aa, Zea mays
  misc_feature: Ceres CLONE 1369741-F
MSRSCCVAVSVLLAVAATASATAPAWLHEEAMATGPLVAEGARVAPSASTWAADKASPARPSGGMATPPDDQSSSGVSASSGEHGKEEGEKRAKTCLTKEECPKKKDDLAERPAPPLAAQARAPASATKSLCPPPC

SEQ ID NO: 12178 - DNA, 674 bp, Zea mays
  misc_feature: Ceres CLONE 1369744-F
  misc_feature: Encodes the peptide sequence at SEQ ID NO. 12179
  misc_feature (399)..(399): n is a, c, t, g, unknown, or other
  misc_feature (503)..(503): n is a, c, t, g, unknown, or other
  misc_feature (523)..(523): n is a, c, t, g, unknown, or other
  misc_feature (524)..(524): n is a, c, t, g, unknown, or other
  misc_feature (585)..(585): n is a, c, t, g, unknown, or other
tggagctccccgcggtggcggccgctctagaactagtggatcccccgggctgcaggaattcgcacgagaccattacctagaacatcctaatcgaaaaatcgcagaaatcctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaagcccaaggcggagaagcggctacctgcgggcaagtccgccggcaaggagggcggcgacaagaagggtaggaagaaggcgaagaagagcgtggagacctacaagatctacatcttncaggtcctgaagcaggtgcaccccgacatcggcatctcctcccaggccatgtccatcatgaactccttcatcaacgacatcttcgagaagctcgccgcggaggnccgccagctcgcccggtacnnacagaagcccaccatcacctcccgcgagatccagacctccgtcccgctcgtcctccccggngagctcgccaagcacgccgtctcggagggtacaaaggccgtcacccagtcacctcgtcttagcccccttgtagtaggcgtcgttgttac

SEQ ID NO: 12179 - protein, 163 aa, Zea mays
  misc_feature: Ceres CLONE 1369744-F
  misc_feature (61)..(131): Pfam Name: Histone Pfam Description: Core histone H2A/H2B/H3/H4
  misc_feature (72)..(72): Xaa is any aa, unknown, or other
  misc_feature (107)..(107): Xaa is any aa, unknown, or other
  misc_feature (114)..(114): Xaa is any aa, unknown, or other
MAPKAEKKPAAKKVAEEEPSEKAAPAEKAPAGKKPKAEKRLPAGKSAGKEGGDKKGRKKAKKSVETYKIYIXQVLKQVHPDIGISSQAMSIMNSFINDIFEKLAAEXRQLARYXQKPTITSREIQTSVPLVLPGELAKHAVSEGTKAVTQSPRLSPLVVGVVV

SEQ ID NO: 12180 - DNA, 660 bp, Zea mays
  misc_feature: Ceres CLONE 1369745-F
  misc_feature: Encodes the peptide sequence at SEQ ID NO. 12181
  misc_feature (444)..(444): n is a, c, t, g, unknown, or other
  misc_feature (578)..(578): n is a, c, t, g, unknown, or other
aaagctggagctccccgcggtggcggccgctctagaactagtggatcccccgggctgcaggaattcgcacgagaccattacctagaacatcctaatcgaaaaatccatcgagctgcccgcgcgcggcagttaagctcacacatcagctagctcaccttggacggccgaccaggtacgttgcgagcgatggcgggatacaaagcgtcgggcggcacggcgctcggcgtcgtcctggctgttgccgcgctcctcgccgcggcggcgatggcggtggacgacgagcacatgtaccactggaagtgcttcaactcgtgcacggggaagtgccgcgacgaggacgcctttgacgacggccaccgttccggggattcgaacgtctcttccgtcgtctctggcggcaagtgcaacaacaggtgcctcagcgagtgcttcgaggacctgccnggcatctgctaccaccagtgcgtcgtcagcaagtgcctctgcttcccaccctttagcaaagagaaaacgatgtgcatgaagagctgctgcaacaagtgcttccaccacggcccgccagcgcctggtcctggccngaaagcgaggccgccattggctggtcctccggagccgcctggcccgaagccgaaagcgagggcggcggcgcaaagccaccgg

SEQ ID NO: 12181 - protein, 158 aa, Zea mays
  misc_feature: Ceres CLONE 1369745-F
  misc_feature (131)..(131): Xaa is any aa, unknown, or other
MAGYKASGGTALGVVLAVAALLAAAAMAVDDEHMYHWKCFNSCTGKCRDEDAFDDGHRSGDSNVSSVVSGGKCNNRCLSECFEDLPGICYHQCVVSKCLCFPPFSKEKTMCMKSCCNKCFHHGPPAPGPGXKARPPLAGPPEPPGPKPKARAAAQSHR

SEQ ID NO: 12182 - DNA, 751 bp, Zea mays
  misc_feature: Ceres CLONE 1369749-F
  misc_feature (224)..(224): n is a, c, t, g, unknown, or other
  misc_feature (283)..(283): n is a, c, t, g, unknown, or other
tggagctccccgcggtggcggccgctctagaatagtggatcccccgggctgcaggaattcgcacgagaccattacctagaacatcctaatcaaaaaacgctctccgccgccacttctcctccggcatcgacgaggcgaagccccagcgcccgagtccctctccctgctcccacgacccatggcggcggatatggcgtacgcgccgccgatgaaggcggcaaggnccggttcgaggctggcatgatggatccgcagcacaggatccgcatcacgctctcctccnagagcgtcaagaacctcgagaaagtctgcggggatctggtggaagggcgcaaagggtaggagctcaagggcaaaggccccctggggaatggctacaaaagggcttcccattccccccaagaaagcctccctggggagaaaggaaccaacccccggggaatccttttgaaaatggggttcccaaaggggggggtccatttcccccaaaaaacccaaagaggttgggagagaaaaccccccccatacataattgaacccgggggggggggggtgggggcggaatttcggggggccctttataatggggccccttttattttttaaaagagggttttaagaggaaagagtatttttcctcctcccaaagagaaaattttgggaaaaaaaagacaccccccttttttttttaaaaaaaaaaaaaaatttttttctgggggcccccgaaagagaaattctttttttttatttt

SEQ ID NO: 12183 - DNA, 705 bp, Zea mays
  misc_feature: Ceres CLONE 1369754-F
  misc_feature: Encodes the peptide sequence at SEQ ID NO. 12184
agagctggagctccccgcggtggcggccgctctagaactagtggatcccccgggctgcaggaattcgcacgagaccattacctagaacatcctaatcgaaaagacgaaggtaagatgttcctgcggaggatcctgaccggcgggggcggcctggcggccctgagggcggcgcgcgccgtgaaggagacgacggggatcgtgggccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgccaggagggagaggacctggaagcccatccaagacccgaatcgggatgcgggcaggtcaaggagctcatcgaggaggccgaggacgagctcaagctcatcgttaaaatgattgaatgggatccatgggggggtccccgatgactacgaatgtgggggggattaaaaacaacacccccatttcctaagcttggtccttcagccccggggctggttggtcttcccggacgatttcttaaaggggactaaaatggtggaaaacctgatcctggttcttttaggggaatggtcccccccccagggaaaagcgcaaaaggatggcttgtcccctgggtaaacggccttttccctcttttgtcccggggg

SEQ ID NO: 12184 - protein, 122 aa, Zea mays
  misc_feature: Ceres CLONE 1369754-F
  misc_feature (35)..(92): Pfam Name: ETC_C1_NDUFA5 Pfam Description: ETC complex I subunit conserved region
MFLRRILTGGGGLAALRAARAVKETTGIVGLEVVPNAREVLVGLYERTLKEIKAVPEDEGYRKAVESFTGHRLQICQEGEDLEAHPRPESGCGQVKELIEEAEDELKLIVKMIEWDPWGGPR

SEQ ID NO: 12185 - DNA, 727 bp, Zea mays
  misc_feature: Ceres CLONE 1369763-F
  misc_feature: Encodes the peptide sequence at SEQ ID NO. 12186
  misc_feature (225)..(225): n is a, c, t, g, unknown, or other
  misc_feature (237)..(237): n is a, c, t, g, unknown, or other
  misc_feature (253)..(253): n is a, c, t, g, unknown, or other
  misc_feature (294)..(294): n is a, c, t, g, unknown, or other
  misc_feature (333)..(333): n is a, c, t, g, unknown, or other
  misc_feature (401)..(401): n is a, c, t, g, unknown, or other
aaagctggagctccccgcggtggcggccgctctagaactagtggatcccccgggctgcaggaattctcacgagaccattacctagaacatcctaatcgaaaaattcaatccggccgggtccgcgcgcaaggggcagcgagcgagccacgtacgaagtagtacgtgctgccgccaagctagtgccaatggcgagggcggtggcgatgctcgtggccctggccctgncgctgatcgtgncggtggcgagcgcggncggcgcccgcgcccaacagtgcagcgcggcgcagctggcgncgtgcgccccggcgatcatcaggcggtcgccgcccacgngtcgtgctgctccacctgcgcgcgcaggagccgtgcttctgccagtacgcggcgacccgggggtaagnatttaattaaaaggccccagggccggcggaggtcacctcttggggaatcccgtcccgaggtgttaggggttaattcggcccccgggggggggggaaaaaaaaaaggggggccattccgtttttggttatccaatcttgaaccccccggggattaaaacatttttttttttttttcaaaaaaaaaaaaaaatttttttccccccccccccccccggggggccccccccccccccttcccccctaaaggggggttttaccccccccccccgggccctttttttaacagggggggggaaaaaaccccgggggcaacacctttattgtgg

SEQ ID NO: 12186 - protein, 73 aa, Zea mays
  misc_feature: Ceres CLONE 1369763-F
  misc_feature (14)..(14): Xaa is any aa, unknown, or other
  misc_feature (18)..(18): Xaa is any aa, unknown, or other
  misc_feature (23)..(23): Xaa is any aa, unknown, or other
  misc_feature (37)..(37): Xaa is any aa, unknown, or other
  misc_feature (50)..(50): Xaa is any aa, unknown, or other
  misc_feature (72)..(72): Xaa is any aa, unknown, or other
MARAVAMLVALALXLIVXVASAXGARAQQCSAAQLAXCAPAIIRRSPPTXRAAPPARAGAVLLPVRGDPGVXI

SEQ ID NO: 12187 - DNA, 604 bp, Zea mays
  misc_feature: Ceres CLONE 1369766-F
  misc_feature: Encodes the peptide sequence at SEQ ID NO. 12188
  misc_feature (358)..(358): n is a, c, t, g, unknown, or other
  misc_feature (603)..(603): n is a, c, t, g, unknown, or other
  misc_feature (604)..(604): n is a, c, t, g, unknown, or other
tggagctccccgcggtggcggccgctctagaactagtggatcccccgggctgcaggaattcgcacgagaccattacctagaacatcctaatcgaaaaacatgaaaatgtcacacctaagaaaatgattcgtgggaggcttaagtgcccaaactgcggtgaatttgaccacgggacaacaagctataaatgtcctttcattggaacaaagaaaaggaaaaggagaccaaggaaaaatgtgactaaaggttggtttccaaaacatgtccaagcttcgtcgcagctcgtcctgcaagagaacgaagtgcatccactagctacttaactacctgcaacagaaccaaggaagggtgatgctgncaagctgtcactacaaccgggagtagcgtgtgtcccatgcagcacgcaggctcggattagtcgtactcagacgaagagaccgtagccaatcctactaacccaacttactctacagactcactcggtaatcgcgtcttcttggacgaatactgccataccagtggcatgagtacattgtcaatgactatgcaagttcatatctaaggcagtctagtgccaataaaagagggctgtgactactaggnn

SEQ ID NO: 12188 - protein, 66 aa, Zea mays
  misc_feature: Ceres CLONE 1369766-F
MIRGRLKCPNCGEFDHGTTSYKCPFIGTKKRKRRPRKNVTKGWFPKHVQASSQLVLQENEVHPLAT

SEQ ID NO: 12189 - DNA, 631 bp, Zea mays
  misc_feature: Ceres CLONE 1369767-F
  misc_feature (296)..(296): n is a, c, t, g, unknown, or other
  misc_feature (316)..(316): n is a, c, t, g, unknown, or other
  misc_feature (530)..(530): n is a, c, t, g, unknown, or other
  misc_feature (531)..(531): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (555)..(555): n is a, c, t, g, unknown, or other
  misc_feature (556)..(556): n is a, c, t, g, unknown, or other
  misc_feature (603)..(603): n is a, c, t, g, unknown, or other
  misc_feature (604)..(604): n is a, c, t, g, unknown, or other
caaagctggagctccccgcggtggcggccgctctagaactagtggatcccccgggctgcaggaattcgcacgagaccattacctagaacatcctaatcgaaaaactccttctccctccgcctttctctctcttctctctctaccgccccaggccccccgatctcctcctcccactccgatcgcccgaccgatcgccgagcttccctgttccctccccgccctcgcgatgccgtggagccgccgcacgccgagcaggccgtcgacgaacaacgctgagcaggacgtcgccgctgtancagcagggaggaagagcggnactgctacctccgggcaccgggccttcaaagggagctgcctgccttaaacccttttttttgggtttccaaagaaaaaacttttgggggccccccccccccgggggatttttgggggtttttttatctcccccccccaaaaaaatttttgggggggggggggggcccccctcccctctcccgggaggaaaaaaaaaatttttctttttttttttnnagggnnnngggggggggggggggnnaaggaaaaaaaaaaaaaaatattttttttttttttatttttttaaanntaagggggggtggtgctcgcctcttcc

SEQ ID NO: 12190 - DNA, 682 bp, Zea mays
  misc_feature: Ceres CLONE 1369774-F
  misc_feature: Encodes the peptide sequence at SEQ ID NO. 12191
  misc_feature (274)..(274): n is a, c, t, g, unknown, or other
  misc_feature (292)..(292): n is a, c, t, g, unknown, or other
  misc_feature (361)..(361): n is a, c, t, g, unknown, or other
  misc_feature (410)..(410): n is a, c, t, g, unknown, or other
aaagctggagctccccgcggtggcggccgctctagaactagtggatcccccgggctgcaggaattcgcacgagaccattacctagaacatcctaatcgaaaaatcaccaccatctcacttcatataccactccctaggaggacccagcaacacacacagccgagctttgcttaggcaagatgaacaggaagccaggagactgggactgcagggcgtgccagcacctcaacttcagccgccgagacatatgccagcgctgcagcgagccacgtgnagttgctgatcgtggcgncggaggaagaagaggcgactacgccagcttcggtgggcgcggtggctcctcctttcgcggcggctttgncgctgctggctctgacgtccgggctggtgactggtactgctccctgcgngcgcacaacttcggccagcgctccagctggtttcagggctcccgcctacaggaggagcccgctgggaaacaggggcgctggcggtttttgacgggacatgtccacgctcacgggttacggtttccaaaagggggctgctggggctggggttggccttcccccaacaacaacccgcccgggtgaaaatccgaaaattggattccccaaatccggaggaaaaaacaacttcccacaggggggaaggttttagggcaccccccccgggatttgga

SEQ ID NO: 12191 - protein, 137 aa, Zea mays
  misc_feature: Ceres CLONE 1369774-F
  misc_feature (32)..(32): Xaa is any aa, unknown, or other
  misc_feature (38)..(38): Xaa is any aa, unknown, or other
  misc_feature (61)..(61): Xaa is any aa, unknown, or other
MNRKPGDWDCRACQHLNFSRRDICQRCSEPRXVADRGXGGRRGDYASFGGRGGSSFRGGFXAAGSDVRAGDWYCSLRAHNFGQRSSWFQGSRLQEEPAGKQGRWRFLTGHVHAHGLRFPKGGCWGWGWPSPNNNPPG

SEQ ID NO: 12192 - DNA, 711 bp, Zea mays
  misc_feature: Ceres CLONE 1369775-F
  misc_feature: Encodes the peptide sequence at SEQ ID NO. 12193
  misc_feature (144)..(144): n is a, c, t, g, unknown, or other
  misc_feature (292)..(292): n is a, c, t, g, unknown, or other
  misc_feature (293)..(293): n is a, c, t, g, unknown, or other
  misc_feature (353)..(353): n is a, c, t, g, unknown, or other
  misc_feature (362)..(362): n is a, c, t, g, unknown, or other
  misc_feature (363)..(363): n is a, c, t, g, unknown, or other
  misc_feature (373)..(373): n is a, c, t, g, unknown, or other
  misc_feature (383)..(383): n is a, c, t, g, unknown, or other
aagctggagctccccgcggtggcggccgctctagaactagtggatcccccgggctgcaggaattcgcacgagaccattacctagaacatcctaatcgaaaaacgatcacacaccactccacagcagtagcaagagggatagagnaaggccacacacacacacacaccactaggctaggttagccttttaatcgtcgtcgagaagcaagaagggcgcgcacgcaagcaggcaagcaagaagagagccgatcgaccgagagctagcacgcgatggcgaggtcttccagatgatnngtggcgcagctctgctggccttggccctggccgtgtcgaccgccgaggcgagaacatcangacacgacnnacgaaaaaangacgacgcgntggtggcaccggaaaacttcccggccttcaaccgcctcggggggggccggtccccggggttcggggcctcccgggggaagaatcctggagagaaattcccgggtcaaaaggccgggaggggaaaaacctacccggggttactttgccggaaagggaaaatgccccctttggggggggtcccccggttttagggttttgggggatggccggggtcccccccgcggttcccccccgagaacccaaaaaaccctgaaaccaaaaaaggggggaaaaaaggggggcctttttatttgaaaaacccccctccttggggggggggggtccggct

SEQ ID NO: 12193 - protein, 95 aa, Zea mays
  misc_feature: Ceres CLONE 1369775-F
  misc_feature (2)..(2): Xaa is any aa, unknown, or other
  misc_feature (3)..(3): Xaa is any aa, unknown, or other
  misc_feature (23)..(23): Xaa is any aa, unknown, or other
  misc_feature (26)..(26): Xaa is any aa, unknown, or other
  misc_feature (29)..(29): Xaa is any aa, unknown, or other
  misc_feature (33)..(33): Xaa is any aa, unknown, or other
MXXGAALLALALAVSTAEARTSXHDXRKXDDAXVAPENFPAFNRLGGGRSPGFGASRGKNPGEKFPGQKAGRGKTYPGLLCRKGKMPPLGGVPRF

SEQ ID NO: 12194 - DNA, 694 bp, Zea mays
  misc_feature: Ceres CLONE 1369777-F
  misc_feature: Encodes the peptide sequence at SEQ ID NO. 12195
  misc_feature (537)..(537): n is a, c, t, g, unknown, or other
  misc_feature (561)..(561): n is a, c, t, g, unknown, or other
  misc_feature (562)..(562): n is a, c, t, g, unknown, or other
  misc_feature (584)..(584): n is a, c, t, g, unknown, or other
  misc_feature (588)..(588): n is a, c, t, g, unknown, or other
  misc_feature (594)..(594): n is a, c, t, g, unknown, or other
  misc_feature (595)..(595): n is a, c, t, g, unknown, or other
aaagctggagctccccgcggtggcggccgctctagaactagtggatcccccgggctgcaggaattcgcacgagaccattacctagaacatcctaatcgaaaaaaaaccctagcccagagcagccgcatcgaactctacctgcctttctctcgtccctggcggcggcggcaggatggcggcttctactgcgaggacggtgaaggatgtgaacccccacgagtttgtcaaggcctactccgcccatctcaaacgctccggcaagatggagcttcctgagtgggttgacattgtgaagactgcgaggttcaaggagctccctccttatgaccctgactggtactacatcagggctgcatctgtagcaaggaagatctacttgagacaaggcattggtgttggtggcttccagaagatttatggtggccgccagaggaatggctcacgcccacctcacttctgcaagagcagtggtgccatttcacgcaacatcctccagcagctgcaggagatgggcatcattgatgtcgatcccaaggntggacggcgcatcacctcccaggnnaagcgtgatctgcacccagtgnctgnaagggnntgctgtgaagcttgagcatctcatatttggtttctatgatgtcatgtttgattgttgagatggctacatttttattgcactttggattaggatttttgt

SEQ ID NO: 12195 - protein, 145 aa, Zea mays
  misc_feature: Ceres CLONE 1369777-F
  misc_feature (7)..(146): Pfam Name: Ribosomal_S19e Pfam Description: Ribosomal protein S19e
  misc_feature (122)..(122): Xaa is any aa, unknown, or other
  misc_feature (130)..(130): Xaa is any aa, unknown, or other
  misc_feature (138)..(138): Xaa is any aa, unknown, or other
  misc_feature (139)..(139): Xaa is any aa, unknown, or other
  misc_feature (141)..(141): Xaa is any aa, unknown, or other
MAASTARTVKDVNPHEFVKAYSAHLKRSGKMELPEWVDIVKTARFKELPPYDPDWYYIRAASVARKIYLRQGIGVGGFQKIYGGRQRNGSRPPHFCKSSGAISRNILQQLQEMGIIDVDPKXGRRITSQXKRDLHPVXXRXCCEA

SEQ ID NO: 12196 - DNA, 682 bp, Zea mays
  misc_feature: Ceres CLONE 1369778-F
  misc_feature: Encodes the peptide sequence at SEQ ID NO. 12197
  misc_feature (585)..(585): n is a, c, t, g, unknown, or other
aagctggagctccccgcggtggcggccgctctagaactagtggatcccccgggctgcaggaattcgcacgagaccattacctagaacatcctaatcgaaaaacgttcacggatcaccagtctcgtcgtgtccgttcgcgatcggacaaacctgcaaccctttcctcttcgtccccccgctctctcgttgccccaagtcggagtacggagtacgggagtcgcacccccgtcgtcccgttccttgctcgccccaacttcgccgccgcgtccccctcggatcctagtgatgtctggtggtaacgcgtggtcgccgctcccttcgcacggatttgaatccgactccggcggcatggagagccgcgcaggcgaccctgtggcgaggaccaacagcagcggcggtggcgctagcagcaaggactcgcgcagcttcgagtgcaacatctgtctggacctggcgcaggatcccgtggtcaccctctgcggtcacctcttctgctgggcatgcctctacgagtggatccacgtgcacgcgcactaccaggagtgccccgtctgcaaggtcgtcgtcgaggaggtgaagctcgtncctctctacgggcgtggatgtcactccacctcaccccgtgcaaggtcgatggctggtgtgaaaatcccgagcaggccgccggggcagcggtcctcac

SEQ ID NO: 12197 - protein, 132 aa, Zea mays
  misc_feature: Ceres CLONE 1369778-F
  misc_feature (50)..(90): Pfam Name: zf-C3HC4 Pfam Description: Zinc finger, C3HC4 type (RING finger)
MSGGNAWSPLPSHGFESDSGGMESRAGDPVARTNSSGGGASSKDSRSFECNICLDLAQDPVVTLCGHLFCWACLYEWIHVHAHYQECPVCKVVVEEVKLVPLYGRGCHSTSPRARSMAGVKIPSRPPGQRSS

SEQ ID NO: 12198 - DNA, 694 bp, Zea mays
  misc_feature: Ceres CLONE 1369779-F
  misc_feature: Encodes the peptide sequence at SEQ ID NO. 12199
  misc_feature (482)..(482): n is a, c, t, g, unknown, or other
  misc_feature (563)..(563): n is a, c, t, g, unknown, or other
  misc_feature (564)..(564): n is a, c, t, g, unknown, or other
  misc_feature (615)..(615): n is a, c, t, g, unknown, or other
  misc_feature (616)..(616): n is a, c, t, g, unknown, or other
  misc_feature (639)..(639): n is a, c, t, g, unknown, or other
aaagctggagctccccgcggtggcggccgctctagaactagtggatcccccgggctgcaggaattcgcacgagaccattacctagaacatcctaatcgaaaagctagatcgttccgtaagggcacccatcgtcatagatacgattcataggttctgccactacttgtgcgcggagagccaagaaatgcgtcaggggttgtgaagggaaggagtgccgatggccggtggccacccggcgccgctgcggccggtggtggttgcgatgaaaggccacccagggtctggcaagtccacggcggcgcgcgccatcgcgaccgcgctttgctgtccgctcctggacaaggacgatgtgagggactgcatgttgcccctagagggcttggctgctgctgggctgctcaacgacctctcctacgccgtgctgtggcggatggccgagcgccaggtaagactcggactgtctgtcgtcatcgattcaccgntgtcacgccgctctcacctcgacatgctgacacgcctagccggtgtgctttgtgtcgtcgtggagtgtcgccctggtgatnnacgagaatggcgccggagctggagagccgtgggtcggctgttgccaatggnntgcgtggtgatggatggcataanccaaagacatgggctgagctggagaggcttctggaagggtaccagggtgcacgaa

SEQ ID NO: 12199 - protein, 159 aa, Zea mays
  misc_feature: Ceres CLONE 1369779-F
  misc_feature (89)..(89): Xaa is any aa, unknown, or other
  misc_feature (116)..(116): Xaa is any aa, unknown, or other
  misc_feature (133)..(133): Xaa is any aa, unknown, or other
  misc_feature (141)..(141): Xaa is any aa, unknown, or other
MAGGHPAPLRPVVVAMKGHPGSGKSTAARAIATALCCPLLDKDDVRDCMLPLEGLAAAGLLNDLSYAVLWRMAERQVRLGLSVVIDSPXSRRSHLDMLTRLAGVLCVVVECRPGDXREWRRSWRAVGRLLPMXCVVMDGIXQRHGLSWRGFWKGTRVHE

SEQ ID NO: 12200 - DNA, 700 bp, Zea mays
  misc_feature: Ceres CLONE 1369781-F
  misc_feature: Encodes the peptide sequence at SEQ ID NO. 12201
  misc_feature (356)..(356): n is a, c, t, g, unknown, or other
  misc_feature (377)..(377): n is a, c, t, g, unknown, or other
  misc_feature (391)..(391): n is a, c, t, g, unknown, or other
aaagctggagctccccgcggtggcggccgctctagaactagtggatcccccgggctgcaggaattcgcacgagaccattacctagaacatcctaatcgaaaaacacacaaacacacaatggcaccagaaacgatgctcctcggcgtctgtgccgtgctgatggtggtcggcgtcacgaacgcggcggagggccaggtggcgtcggtcgtcgtgggcctggcgaggtgcgccgacagcacgaggaagaacatgaagggctgaggccggtttcaaggtcttcaggtggcgatcaagtgcaagaaacagcacggcgagtacgagacaagggccgtgagtgagatcccaagctccggagncttcagggtcccacttcgcgncggactccacgggngcgactggcacgcgcagcttcacagcgccggcaataacccgccttgccctgggcaggagccgtccaggattcgccccatggcaggggggaacctttctccgccgggcctggaaaaatcaccacccgtcccggggagggggggcccggtgttttctggttccccaataaaaaacctttggttaaatctctccccaaggggccccctgggcggggggggaaaccccccgtgggttgaacaaaaaaggggcggggggggagaaaccacccggggggtaaaaaaaaaaggcgggggcgagaaccccccccccg

SEQ ID NO: 12201 - protein, 47 aa, Zea mays
  misc_feature: Ceres CLONE 1369781-F
MAPETMLLGVCAVLMVVGVTNAAEGQVASVVVGLARCADSTRKNMKG

SEQ ID NO: 12202 - DNA, 706 bp, Zea mays
  misc_feature: Ceres CLONE 1369783-F
  misc_feature: Translation starting site: 198
aaagctggagctccccgcggtggcggccgctctagaactagtggatcccccgggctgcaggaattcgcacgagaccattacctagaacatcctaatcgaaaaatcacacactcgactctcctctctcgcatccgcagcctttcgagctctactccaccccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcggggcggtacctgaagaagggccggtacgcgcagcgcgtcgggacgggcgcccccgtctacctggccgccgtcctcgagtacctgggccgccgaggggctggagctggccggcaacgctgccaagggacaacaagagaacccggatcatccggggccaatggttcctggcattcccaaaaaaaaagaattcggaaaattggtgtccgggggtccacttgccccgggggggcccctcccaaaaataacccgggggtcctggccaaaaaaacccttaaaaagggggggcaaagggggccaaatccccaaaaaagggcccaatccccccaaaagggaaaagggggggggcccctctacccggggggagaaaaagcccccc

SEQ ID NO: 12203 - DNA, 721 bp, Zea mays
  misc_feature: Ceres CLONE 1369785-F
  misc_feature: Encodes the peptide sequence at SEQ ID NO. 12204
  misc_feature (331)..(331): n is a, c, t, g, unknown, or other
  misc_feature (390)..(390): n is a, c, t, g, unknown, or other
tggagctccccgcggtggcggccgctctagaactagtggatcccccgggctgcaggaattcgcacgagaccattacctagaacatcctaatcgaaaattttttccggcctcccattcctcgcgcggcgaccacccgattcgaagcgtgcggagagaccgaagaagcgggagagatggctcgtaccaagcagactgctcgcaagtccacgggggggaaggctcccaggaagcagcttgccaccaaggctgcccgtaagtctgcccccaccactggtggagtgaagaagcctcaccgctaccgccctggaaactgtgccctccgtgagatccngcagtatcagaagagcactgagctgctgatcaggaagctgccgtgccagaggctcgtcnaggaaattgcacaggacttcaaaactgattggcgtttccagaagcatggcgtgcttgcccctcaggagggtgctggagcataccctggttggcctggttgaggacaccaccctggggcgcatccatgctaagggggggcccatcatgccaaagggatttcacctgggaaaggaggatccggggggaaggggcctaaccccccccctcaaaatttggggaaaaaaaatgaagcccgggggttatgggaaaatgggggcacttgaaggacaatatgaaaagggttgttttttggggacccaaaattccccttcggaaaggggggggggcccct

SEQ ID NO: 12204 - protein, 105 aa, Zea mays
  misc_feature: Ceres CLONE 1369785-F
  misc_feature (53)..(53): Xaa is any aa, unknown, or other
  misc_feature (73)..(73): Xaa is any aa, unknown, or other
MARTKQTARKSTGGKAPRKQLATKAARKSAPTTGGVKKPHRYRPGNCALREIXQYQKSTELLIRKLPCQRLVXEIAQDFKTDWRFQKHGVLAPQEGAGAYPGWPG

SEQ ID NO: 12205 - DNA, 715 bp, Zea mays
  misc_feature: Ceres CLONE 1369789-F
  misc_feature: Translation starting site: 170
  misc_feature: SWISSPROT Homolog: EC 1.15.1.1 Superoxide dismutase
  misc_feature (481)..(481): n is a, c, t, g, unknown, or other
aaagctggagctccccgcggtggcggccgctctagaactagtggatcccccgggctgcaggaattcgcacgagaccattacctagaacatcctaatcgaaaaattttcatcagcagcattacccatcgctcgccaacgtgcagactaaggaagcactgaccggccggtcatggcgaggatccacctctacgtcgtctccgcgtgctgcgccgtcgccctcgcgctcgccggcgacccggacatgctccaggacgtctgcgtgactgactacgcttccccggtcaagctgaacggcttcccgtgcaaggcgaatatctcggcggacgacttcttcttcgacgggctgaggagcccgggcaacaccaacaacccggcgtgatctgcggagaccgcgtccaacgtgcatcagtccacaggggtgaacacgctgggcgtctccatggtgcgcatcgactacgcgccggtcggcagtaaccgtcgnagacggaaccgagagccacggagattatcttcgtcatcgaagaaacgttcgatgtcggattcctccccaccgccaaaaggttcctcatcaagacgtcgccttggggggaagtcttttaattcccccggggcctcctccatttcaaaaaaaagagggggcgggccccgccggcggacttcccccccttaaaagccgttccggggaagttgccctctctttaagcttttttggggc

SEQ ID NO: 12206 - DNA, 715 bp, Zea mays
  misc_feature: Ceres CLONE 1369793-F
  misc_feature: Pfam Name: Ribosomal_S19e Pfam Description: Ribosomal protein S19e
  misc_feature (571)..(571): n is a, c, t, g, unknown, or other
  misc_feature (603)..(603): n is a, c, t, g, unknown, or other
aaagctggagctcaccgcggtggcggccgctctataactagtggatcccccgggctgcaggaattcgcacgagaccattacctagaacatcctaatcgaaaaagaatcatagtatcggagaagccgcatctacaacgtgcatctcttgttacctggctgcatacacgtaaagatcgtgctactctacgcctgtgcaacgtgaatcattacaacccccacgagtacgtccagggctactccgtccacctcaagtgatcccgtaatcatggagctcccttgactgcttgacatcgcgaacactgccatctccagtcgaccttcctctttatgatcgtgactggtactacatcagacctgcatcctttgcaccgaacatctacctaaggcatggcatccgagtaggaggctttcagaaaatctaccgtggacgccagaggaatgcctcccacccacctcacttctgtaaagcagtggtgctgatgaacgcaatatcctgcaacagctgcagattatccgcactctccatgtcgatccccaggtggacctgcctcatcaccacccacgtgaacgngagctctgtaccaaactggctggcaagtgtcnacttctgtacgagtgagaactggcactctttggttttcagtggaagttctgttccgatccctcgataaggttgcccttctatttagctcttttatgataaaaatgtattcag

SEQ ID NO: 12207 - DNA, 711 bp, Zea mays
  misc_feature: Ceres CLONE 1369795-F
  misc_feature: Encodes the peptide sequence at SEQ ID NO. 12208
  misc_feature (517)..(517): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
aagctggagctccccgcggtggcggccgctctagaactagtggatcccccgggctgcaggaattcgcacgagaccattacctagaacatcctaatcgaaaaacaacacaacaacaacaaccatctccaacgcagcaagcagacagaaggacaggcaggcagcgagtgcaaccgcgagagcgatcagcgatgggctccttcttctcgaccttagtgacgccccctccggccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggccttcaaggagctggcctcccgcttcaccgatgccatcttcgtcaaggttgacgtcgacgagctcgcggaggtcgcaaggacatggaaggtagaggcgatgccaacgttcgtgctggtcagatggaagagtagcggtgatgngctaagacactgaaacgagccgctcaaatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12208 - protein, 113 aa, Zea mays
  misc_feature: Ceres CLONE 1369795-F
  misc_feature (22)..(113): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (110)..(110): Xaa is any aa, unknown, or other
MGSFFSTLVTPPPAADDPNCAVVAAHSKATYDEQWAAHKSSSKLMVIDFSASWCGPCRFIEPAFKELASRFTDAIFVKVDVDELAEVARTWKVEAMPTFVLVRWKSSGDXLRH

SEQ ID NO: 12209 - DNA, 720 bp, Zea mays
  misc_feature: Ceres CLONE 1369798-F
  misc_feature: Translation starting site: 171
  misc_feature (406)..(406): n is a, c, t, g, unknown, or other
  misc_feature (413)..(413): n is a, c, t, g, unknown, or other
aagctggagctccccgcggtggcggccgctctagaactagtggatcccccgggctgcaggaattcgcacgagaccattacctagaacatcctaatcgaaaaatacatttcgactctcaactcccaaggtccctttttttttctcgatctggaagcgccgcagtagcagccatggacgtgagcggagcaggcgggaaggcgaagaagggcgcggccgggcgcaaggccggcgggccgacgaagaagtcggtgtcgcggtcctccagggcccggctgcagttccccgtcagccgcgtcgggcggtacctcaaaaggggccgtacgcgcagcgtgtaggcacggttgcccccgtctacttcgccgccgtcctggagtacctcggggccggaggggtcgagctcgccggnaacgggnaagggaaaacaagaaaacgggatttttcccgggccaggggttcctcccatcccaaaaaaaaaggacttcgaaaagtgggtggcgggggcccccttcccccgggggggggcctccccaaaatccacgtggggtccccccacaaaaaggtggcccaaaaagggccccaaagacccccaaaagggcgcccccccccccccgaagagggaaaagggggccccccctataaaaaaaaaatatacaaaaaggggcggggggggaaaaaaaaaaattttttgttggggaaaaccccccggattttttccccgcc

SEQ ID NO: 12210 - DNA, 681 bp, Zea mays
  misc_feature: Ceres CLONE 1369803-F
  misc_feature: Translation starting site: 215
  misc_feature: Pfam Name: X8 Pfam Description: X8 domain
  misc_feature: SWISSPROT Homolog: EC 3.2.1.39 Glucan endo-1,3-beta-D-glucosidase
  misc_feature (523)..(523): n is a, c, t, g, unknown, or other
aaagctggagctccccgcggtggcggccgctctagaactagtggatcccccgggctgcaggaattcgcacgagaccattacctagaacatcctaatcgaaaaatgttctttggcaaacacacacacacacacatcgtttgctgttgcaacaaagctctacacgggaagacaggctgcttctttcttgcagtctctggtccagaagcctgaagaaatggcgtcacccaacgacacattcctcgccttcttcgtggccctcgcactattggagcttcacaccaccgacgcagcggcggcggcagaaaccttgcgccataagagcgacacatggtgcgtggccaagccgtcgacgcacgaggcggcgctgcggagcaacctggagttcgcctgctccgagagcgactgcggcgccatccagggcaccggcggctgcgcccagcccgacagcactgctgtcacggacgtcggtggccatgaacgcctactaccaggcccgggggaggaactcgtggaactgcttcancaacgggagcggcctaatcaccatcactgaccccagccttggcacctgcaaatatgcttgacacgacgggctgctctgctgctgctgtgctcaacggacgatgaataaggctgtagggcaatgatgcatcttttccgttctctttgatttgtgatggt

SEQ ID NO: 12211 - DNA, 719 bp, Zea mays
  misc_feature: Ceres CLONE 1369855-F
aaagctggagctccccgcggtggcggccgctctagaactagtggatcccccgggctgcaggaattcgcacgagaccattacctagaacatcctaatcgaaaaagctagctagtagcgcatcaccaccgatcagctatacaagcaaggtagctacctagcatagtacgtagaggccgggtctccagaagacgaacatgtcgtggagctccgacgagaaccacaggttcgagcaggcgctggtagattacgacgaggatactccaggacgctggcagctcgtggtccacgcggtccccggtgccaggacgccggacgacgtctggcgccactacctgcatctggagggggacatccacgacctgggcgtcacggagcgggcgaaacgtcgccgccaacagcactgccgcaacgcccagtataaccaatatccgcccggcgccccacttttacccctccgtctctcgtccgcccgcatttttattatttccccgcaccaacggttgtcccccccttgcccccttaacacctcaccaacaccaccacgtcattccgcgcttactaacacgaacccacagaacccccaacctcccactcggcattgagcccgccccccctgtcgtgtgaggacgaacccacccaccccacggatccgcaccctgcccttaccaccctataactatgcgcggcatatccccccaccttttccgctgtttgaaccc

SEQ ID NO: 12212 - DNA, 695 bp, Zea mays
  misc_feature: Ceres CLONE 1369856-F
  misc_feature: Encodes the peptide sequence at SEQ ID NO. 12213
agagctggagctccccgcggtggcggccgctctagaactagtggatcccccgggctgcaggaattcgcacgagaccattacctagaacatcctaatcaaaaaatctccaccctcgccaccaaccgcccccgcaccacggccagaaccctagtcacttctccgccgcccactccatggaggacgacgccatctcgacgctcatggacatcgacgactcgccgctcagcgctgcgggggccgggttcctcgacgaggaggacggggaaggcgagatgttcttcgccccgcaccgcgcggcccgcggcggcgctggcgatgcccgcgggcccctccccttttccgggttcttcaacagcttcgacggcgccgattttgacgacgacgacctcgcctgagggaactcccaccccgttcggtaacggatggtgttcgtggatcgcgaatcgtgttatgtcgataccgtgatggggtctcttaattagcgcatcgattcagactcgtttgagcaatctgaagatgtttagggatcacaatacctttgggaacccttggggctatggttcgtgaatgcccaggaacaatataagacccttgggccccctgggtcggggaaacctgggcatggggtcctcccggccttgtgtggaatttggcgccccctggaagaacaaaggaccctccttttgtatcattcg

SEQ ID NO: 12213 - protein, 73 aa, Zea mays; identical to SEQ ID NO: 11368
  misc_feature: Ceres CLONE 1369856-F

SEQ ID NO: 12214 - DNA, 635 bp, Zea mays
  misc_feature: Ceres CLONE 1369857-F
  misc_feature: Encodes the peptide sequence at SEQ ID NO. 12215
  misc_feature (614)..(614): n is a, c, t, g, unknown, or other
  misc_feature (615)..(615): n is a, c, t, g, unknown, or other
agagctggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatcgctctctcgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcgggacgttactccaagaagcggttccgcaaggcgcagtgcccgatcgtcgagcgcctcacaaactcgctcatgatgcacgggcgcaacaacggcaagaaggtcatggctgtccgcatcatcaagcataccctggagatcatccacctgctcaccgatgccaaccccatcccaggtcgtcgtcgacgcgaatcatccaccggggaaccccccgggggggagtcccccccccgattggggccccccccggggggggggaaaaaaaaaaaaaagcccccnnatataatacccccccccccg

SEQ ID NO: 12215 - protein, 147 aa, Zea mays
  misc_feature: Ceres CLONE 1369857-F
  misc_feature (44)..(138): Pfam Name: Ribosomal_S7 Pfam Description: Ribosomal protein S7p/S5e
  misc_feature (141)..(141): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIPGRRRRESSTGEPPGGESPPRLGPPPGGGKKKKKPPXIIPPPP

SEQ ID NO: 12216 - DNA, 834 bp, Zea mays
  misc_feature: Ceres CLONE 1369861-F
  misc_feature: Encodes the peptide sequence at SEQ ID NO. 12217
  misc_feature (685)..(685): n is a, c, t, g, unknown, or other
  misc_feature (725)..(725): n is a, c, t, g, unknown, or other
  misc_feature (809)..(809): n is a, c, t, g, unknown, or other
tcgatcccctttaatgcttagcccccccccctcacccggggggggggcaaaggtggggctccccgcggtggcggccgctctataactagtggatcccccgggctgcaggaattcgcacgagaccattacctagaacatcctaatcgaaaaaacacccaccagcctttttcttctccccgcgagcggtctctttctctatggactggtgaggactccgccaccgccgccgctctacgcgagacgcccaggtcttccccaacgacgagcatccgccgtcgcgaggaagaaattgcgaccgaaaggatgggggcagattccggcgctcgcagacaaccaagcttcagcagggtcgaccaggtgcgccctgggacccacggcgacaacctcatcccgcagggtgtagactcgaggagggccgtccagagcaggccgcggagggagggcctccgggaagacggcatcacccattgccggaacgattggctggggggcaggaacccggcatcactgggcatctcctggaaggaaagcgagcaagccggaatgccacagtacgccctggcgacccactggtgagaacctgagggacccgcaaacggatcgaacatggttccacgggtttcccaccgccggaggttggccggtgggaccaacgtcggggaatttggtcaacagcggcctgcanagggtttcccgttgtgtgggtccaagtcgaagtgggggancaacaaaccctggtccccaagacttgagtttataagcctgggtgccccggcggccgggcgggtgaaccttccgtctgttggccntcggtggggcgcccgcggagaccct

SEQ ID NO: 12217 - protein, 90 aa, Zea mays
  misc_feature: Ceres CLONE 1369861-F
MGADSGARRQPSFSRVDQVRPGTHGDNLIPQGVDSRRAVQSRPRREGLREDGITHCRNDWLGGRNPASLGISWKESEQAGMPQYALATHW

SEQ ID NO: 12218 - DNA, 679 bp, Zea mays
  misc_feature: Ceres CLONE 1369862-F
  misc_feature: Encodes the peptide sequence at SEQ ID NO. 12219
aaagctggagctccccgcggtggcggccgctctagaactagtggatcccccgggctgcaggaattcgcacgagaccattacctagaacatcctaatcgaaaaattcttaaaaacctctgctcgggcctagggtttcctcccagtcgtcatcgcttggcgtccgcctcagcccgccgccaggagagttcaggagagtttcgagaagctgaaatggctcctaaagctgctcctgccaagaagggtgatgccaagacccaggccttgaaggttgccaaggctgtgaagtctgggtcagtaaagaagaccaagaagatccgcacgtccgtgacatttcaccgccccaagaccctgaagaaggctagggaccccaagtacccaagaatcagcactaccggaaggaacaagcttgatcagtaccaaattctcaagtatcccctcaccacagaatcggcgatgaagaagattgaagataacaacactcttgtcttcattgtcgacctcaaggcagacaagaagaagatcaaggctgctgtcaagaagatgtatgacattccagccaagaaggtcaacaccctgatcaggcctgatggaaagaagaaggcttacgtgaagcttatgcctgactatgatgctcttgatgtggccaacaaaatcggcatcatctaaaggtaccgcgccg

SEQ ID NO: 12219 - protein, 151 aa, Zea mays
  misc_feature: Ceres CLONE 1369862-F
  misc_feature (69)..(148): Pfam Name: Ribosomal_L23 Pfam Description: Ribosomal protein L23
  misc_feature (11)..(63): Pfam Name: Ribosomal_L23eN Pfam Description: Ribosomal protein L23, N-terminal domain
MAPKAAPAKKGDAKTQALKVAKAVKSGSVKKTKKIRTSVTFHRPKTLKKARDPKYPRISTTGRNKLDQYQILKYPLTTESAMKKIEDNNTLVFIVDLKADKKKIKAAVKKMYDIPAKKVNTLIRPDGKKKAYVKLMPDYDALDVANKIGII

SEQ ID NO: 12220 - DNA, 687 bp, Zea mays
  misc_feature: Ceres CLONE 1369864-F
  misc_feature: Encodes the peptide sequence at SEQ ID NO. 12221
  misc_feature (596)..(596): n is a, c, t, g, unknown, or other
  misc_feature (626)..(626): n is a, c, t, g, unknown, or other
  misc_feature (673)..(673): n is a, c, t, g, unknown, or other
agagctggagctccccgcggtggcggccgctctagaactagtggatcccccgggctgcaggaattcgcacgagaccattacctagaacatcctaatcgaaaaacaattcacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctgaccgggaacgcggcgaaggacaacaagaagacgcgcatcgtcccgcgacacttgctcctggcgattcgtaacgacgttgagctcggcaagctgctgactggcgtcaccatcgcgcacggcggtgtcctccccaacatcaccctggtctcctgccaatcaaggtggcggagaaggcgtccagcgncggcagcaggagagcaagtcccctaagaangtcgccagtccccaaggaggcagcccagtcccgaagaaggctaaaantagtcactcccaag

SEQ ID NO: 12221 - protein, 146 aa, Zea mays
  misc_feature: Ceres CLONE 1369864-F
  misc_feature (29)..(102): Pfam Name: Histone Pfam Description: Core histone H2A/H2B/H3/H4
  misc_feature (139)..(139): Xaa is any aa, unknown, or other
MDASGAGSKAKKGAAGRKAGGPRKKSVSRSVKAGLQFPVGRIGRYLKKGRYAQRVGTGAPVYLAAVLEYLAAEVLELTGNAAKDNKKTRIVPRHLLLAIRNDVELGKLLTGVTIAHGGVLPNITLVSCQSRWRRRRPAXAAGEQVP

SEQ ID NO: 12222 - DNA, 738 bp, Zea mays
  misc_feature: Ceres CLONE 1369865-F
  misc_feature: Encodes the peptide sequence at SEQ ID NO. 12223
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
aaagtggagctccccgcggtggcggccgctctagaactagtggatcccccgggctgcaggaattcgcacgagaccattacctagaacatcctaatcgaaaaccccgggaatggagtgcgtattgggcgtggttggccgcgacttcgcgctggtggcggccgacacctccgccgtgcagagtattctcgtccacaagaccgacgaggacaaggtgatggtgctcgactcgcaaaagctgatgggcgcttcaggggagcctggtgatcgggtgcaatttacggagttcatacagaagaacctccacctgtaccagttccggaacaccatcccgctctcaaccgccgccgccgccaacttcacacgcggcgaactcgccacaggccttcgcaagaatccatatatggtcaatattatttcttggtggtatgataaggatgtgggcttcctctactactcgactacttgcaaccttgcacaaattgacaggttggcgatctactctgtgtagtgtnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 12223 - protein, 132 aa, Zea mays
  misc_feature: Ceres CLONE 1369865-F
  misc_feature (1)..(132): Pfam Name: Proteasome Pfam Description: Proteasome A-type and B-type
  misc_feature: SWISSPROT Homolog: EC 3.4.25.1 Proteasome endopeptidase complex
MECVLGVVGRDFALVAADTSAVQSILVHKTDEDKVMVLDSQKLMGASGEPGDRVQFTEFIQKNLHLYQFRNTIPLSTAAAANFTRGELATGLRKNPYMVNIISWWYDKDVGFLYYSTTCNLAQIDRLAIYSV

SEQ ID NO: 12224 - DNA, 698 bp, Zea mays
  misc_feature: Ceres CLONE 1369870-F
  misc_feature: Encodes the peptide sequence at SEQ ID NO. 12225
aaaagctggagctccccgcggtggcggccgctctagaactagtggatcccccgggctgcaggaattcgcacgagaccattacctagaacatcctaatcaaaatctcctgccgccgccgccgctcccgctcccagctcgtgttccgcttcttgcagccgtcgccgcgaagcgctccagagaacttccgtcaacatggggaagacacgtggtatgggagccgggcgcaagctcaagacccaccgcaggaaccagcggtgggctgacaaggcatacaagaagagccatttgggcaatgagtggaagaaacccttcgctgggtcatcccatgccaagggcattgtcctggagaagattggtattgaggccaagcagcccaactccgctatccgtaagtgtgctcgtggtcagcttgttaagaatggcaagaagattgctgccttcgtgccaaatgacggttgttttgactacatttgagaaaatgatgaggtcttgattggctggatttgtcgtaaggggcacgctgtggaagatatccctgtgtccggttcaaggccgtcaaggtttccggggggcccctgctttgccttttcagggaaaaaaaaaaaaagccaaggcttaaaatggcccttgctacaaaaaccccaaaggggggatttaaaacggagagccttaaaatattaaaaaaaaagggttctttt

SEQ ID NO: 12225 - protein, 93 aa, Zea mays
  misc_feature: Ceres CLONE 1369870-F
  misc_feature (8)..(94): Pfam Name: Ribosomal_S12 Pfam Description: Ribosomal protein S12
MGKTRGMGAGRKLKTHRRNQRWADKAYKKSHLGNEWKKPFAGSSHAKGIVLEKIGIEAKQPNSAIRKCARGQLVKNGKKIAAFVPNDGCFDYI

SEQ ID NO: 12226 - DNA, 705 bp, Zea mays
  misc_feature: Ceres CLONE 1369874-F
  misc_feature: Encodes the peptide sequence at SEQ ID NO. 12227
  misc_feature (329)..(329): n is a, c, t, g, unknown, or other
  misc_feature (386)..(386): n is a, c, t, g, unknown, or other
  misc_feature (391)..(391): n is a, c, t, g, unknown, or other
  misc_feature (396)..(396): n is a, c, t, g, unknown, or other
  misc_feature (607)..(607): n is a, c, t, g, unknown, or other
  misc_feature (608)..(608): n is a, c, t, g, unknown, or other
ctctagaactagtggatcccccgggctgcaggaattcgcacgagaccattacctagaacatcctaatcaaaaaaacacagctagctagcatacagacaaataatcccttcttcacctcactaagaccagatagccactcattctctcctgaaataatggccgctcgctcctcctcctcccagccgcaactggactaggcggaggaggacctggaagcgagcgctgctgctgctggcgtcggtgatctatatggcatcgatagcggtgaactgaggcgaggtgacgacgttcatcaggccttgcctcgagcacgcgatgggcagcgcggngcaaccctccaaggtggcgctgcagtggcgagcgctcggttcaacaggggggccgtncctcncgggngcgacgggaagggcaacctgcaacagggtaaaaagaatattgaaggaaccgaactcggcgggcggcccccccaaggggccaatctcggaggaggatccctccagcaagtggccgccgttccaaaagggggagggggatgagtccccccggccccagcggcgccaaaaataaacccgccggggcggaaccttgaaagggagaaaccccaatnnctctggggggcccgcggacggggccaaccacaaggataaaacccccctacgcaaccaataatgggcaaaaaacaacggcccacaccccacaacagga

SEQ ID NO: 12227 - protein, 83 aa, Zea mays
  misc_feature: Ceres CLONE 1369874-F
  misc_feature (5)..(5): Xaa is any aa, unknown, or other
  misc_feature (24)..(24): Xaa is any aa, unknown, or other
  misc_feature (26)..(26): Xaa is any aa, unknown, or other
MGSAXQPSKVALQWRALGSTGGPXLXGATGRATCNRVKRILKEPNSAGGPPKGPISEEDPSSKWPPFQKGEGDESPRPQRRQK

SEQ ID NO: 12228 - DNA, 655 bp, Zea mays
  misc_feature: Ceres CLONE 1369875-F
  misc_feature: Encodes the peptide sequence at SEQ ID NO. 12229
  misc_feature (444)..(444): n is a, c, t, g, unknown, or other
  misc_feature (580)..(580): n is a, c, t, g, unknown, or other
  misc_feature (581)..(581): n is a, c, t, g, unknown, or other
  misc_feature (587)..(587): n is a, c, t, g, unknown, or other
agagctggagctccccgcggtggcggccgctctagaactagtggatcccccgggctgcaggaattcgcacgagaccattacctagaacatcctaatcgaaaagctagatcgttccgtaagggcacccatcgtcatagatacgattcataggttctgccactacttgtgcgcggagagccaagaaatgcgtcaggggttgtgaagggaaggagtgccgatggccggtggccacccggcgccgctgcggccggtggtggttgcgatgaaaggccacccagggtctggcaagtccacggcggcgcgcgccatcgcgaccgcgctttgctgtccgctcctggacaaggacgatgtgagggactgcatgttgcccctagagggcttggctgctgctgggctgctcaacgacctctcctacgccgtgctgtggcggatggccgagcgccnagtaagactcggactgtctgtcgtcatcgattcaccgttgtcacgccgctctcacctcgacatgctgacacgcctagccggtgtgcttgtggtcgtcgtggagtgtcgccctggtgataacgaggaatgccgccgnnagctgnagagcccgtgggtcgctgttgccaatggtggcggtggtgatggatggcataacccaagacatgggctg

SEQ ID NO: 12229 - protein, 146 aa, Zea mays
  misc_feature: Ceres CLONE 1369875-F
  misc_feature (76)..(76): Xaa is any aa, unknown, or other
  misc_feature (122)..(122): Xaa is any aa, unknown, or other
  misc_feature (124)..(124): Xaa is any aa, unknown, or other
MAGGHPAPLRPVVVAMKGHPGSGKSTAARAIATALCCPLLDKDDVRDCMLPLEGLAAAGLLNDLSYAVLWRMAERXVRLGLSVVIDSPLSRRSHLDMLTRLAGVLVVVVECRPGDNEECRRXLXSPWVAVANGGGGDGWHNPRHGL

SEQ ID NO: 12230 - DNA, 704 bp, Zea mays
  misc_feature: Ceres CLONE 1369877-F
  misc_feature: Encodes the peptide sequence at SEQ ID NO. 12231
  misc_feature (407)..(407): n is a, c, t, g, unknown, or other
  misc_feature (450)..(450): n is a, c, t, g, unknown, or other
  misc_feature (470)..(470): n is a, c, t, g, unknown, or other
  misc_feature (496)..(496): n is a, c, t, g, unknown, or other
  misc_feature (671)..(671): n is a, c, t, g, unknown, or other
agagctggagctccccgcggtggcggccgctctagaactagtggatcccccgggctgcaggaattcgcacgagaccattacctagaacatcctaatcgaaaaaatagcctccgcctctccttccagtgtccgccgtcgtgcgctcgctacccctctccctcgaggcctttgccggcgaagagcgcccagtcgcccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgagcggtaaggacattaccgagctcattgccgccggcagggagaaagttgcttcagtcccatgtggcgntggcggtgtggctgtcgcggcagctgcccctgctgctggcggngctcctgcaactggagcaanaaagaaaaaaggggggggaaaggaanaaaggggtgccccttggccttaccccccttccaataagtttgggaaaaaacaaaaaaatttgtttttagccccccgaaaccaaagggaaaaaaaaccttacccggggtggaatttacactttttttttgtggggaaaaactttaaaaaacttttcggggggaaatcttcagccanaggcgcttgggctggggggggttattggggaca

SEQ ID NO: 12231 - protein, 167 aa, Zea mays
  misc_feature: Ceres CLONE 1369877-F
  misc_feature (17)..(98): Pfam Name: Ribosomal_60s Pfam Description: 60s Acidic ribosomal protein
  misc_feature (69)..(69): Xaa is any aa, unknown, or other
  misc_feature (90)..(90): Xaa is any aa, unknown, or other
  misc_feature (99)..(99): Xaa is any aa, unknown, or other
  misc_feature (157)..(157): Xaa is any aa, unknown, or other
MKFVAAYLLAVLAGNSSPSAEDLTAILESVGCEVDNEKMELLLSQLSGKDITELIAAGREKVASVPCGXGGVAVAAAAPAAGGAPATGAXKKKGGGKEXRGAPWPYPPSNKFGKKQKNLFLAPRNQREKKPYPGWNLHFFFVGKNFKKLFGGKSSAXGAWAGGGYWG

SEQ ID NO: 12232 - DNA, 717 bp, Zea mays
  misc_feature: Ceres CLONE 1369878-F
  misc_feature: Encodes the peptide sequence at SEQ ID NO. 12233
agagctggagctccccgcggtggcggccgctctagaactagtggatcccccgggctgcaggaattcgcacgagaccattacctagaacatcctaatcgaaaaattgctcgcgacgtccgacttctctctctctctaacccactgccagccgcctctgcgaccgtcgcgaccactctccaagaaaattttcttccgctcgcacctgactacgcctcgacctcggactcggcgccggctccgtccgccggacgcggcagccatggcgccagcggtggtgctcaagcgctccgccacgcagaccatcactctgccgccgccccacacgcggctggctgtgcgcgatggcatgagctccacgatcccgtcgcaacccgccgtggcgccggagtccacggagaggcaggcgcccgccgcgggcgttgaaggggttcctgtgtctggaggacgtggacggaaggccgtggtactacttcctggacgatgggccccccaaagagaggagccggggcggggcccgcccccgctggccccgaccgtcaagggccgggccgatgaaatgagccggtttccgccttcctaagcaaaaaactggtaattcataaaaaaccaatatggggcaggcctgcaagggatttaccaaaacagtggggttcctccccctccaatagtggacccctataacaggggaccctgggagagggccttctgaacacactt

SEQ ID NO: 12233 - protein, 106 aa, Zea mays
  misc_feature: Ceres CLONE 1369878-F
MAPAVVLKRSATQTITLPPPHTRLAVRDGMSSTIPSQPAVAPESTERQAPAAGVEGVPVSGGRGRKAVVLLPGRWAPQREEPGRGPPPLAPTVKGRADEMSRFPPS

SEQ ID NO: 12234 - DNA, 701 bp, Zea mays
  misc_feature: Ceres CLONE 1369879-F
  misc_feature: Encodes the peptide sequence at SEQ ID NO. 12235
agagctggagctccccgcggtggcggccgctctagaactagtggatcccccgggctgcaggaattcgcacgagaccattacctagaacatcctaatcgaaaaacaagtcgaagtacgagtaactccggagtccggatggctgcagcgatggacgtcgacgaagccggcggcgaggagaggcgaccgtcagagaaggagctcttccgcgccgctgagtccggtgacgccgccgtgttcgcctccctcgcccccgccgacctctccctgcgcaacgaggacggacgatccctcctccacgtcgacgccgctggcgggcatccccaggtgatgctcgcgcttgcccagtgaggaggagaccccgcgcctagcgtgctgaatgcccaggacgaaggaggttgcgcgccgatacactctgacgagagatcagtgaactctcaaatcggctgacatctgctagaacgaggcgctgatgtaaccctgatactggtggggggcgaactgccttttttagcgccccagccaagggagcttaaaaaaagggaaaaactaaaaccccccggggcgaatggccaacaaaaaaaaaggttgggttggcccccttttgaaaaaggtttaaaaccctggaaacccgaaggggggggaaacccccctttgggaaaggggttaaaaagaggcggtgaaaacaaattgtattttctttt

SEQ ID NO: 12235 - protein, 70 aa, Zea mays
  misc_feature: Ceres CLONE 1369879-F
  misc_feature: SWISSPROT Homolog: EC 3.5.1.2 Glutaminase
  misc_feature: The sequence is a functional homolog of SEQ ID NO 184 in the 10/225,068 US patent application
  misc_feature: The sequence is a functional homolog of SEQ ID NO 382 in the 10/374,780 US patent application
  misc_feature: The sequence is a functional homolog of SEQ ID NO 972 in the 10/225,066 US patent application
MAAAMDVDEAGGEERRPSEKELFRAAESGDAAVFASLAPADLSLRNEDGRSLLHVDAAGGHPQVMLALAQ

SEQ ID NO: 12236 - DNA, 688 bp, Zea mays
  misc_feature: Ceres CLONE 1369884-F
  misc_feature: Encodes the peptide sequence at SEQ ID NO. 12237
tggagctccccgcggtggcggccgctctagaactagtggatcccccgggctgcaggaattcgcacgagaccattacctagaacatcctaatcgaaaaagcacgactagcggaataatatccaccggcgacgggaacgggaggcggcgcggccggagattcgaagcgatggcgttcacgatgcgggcagtgaaggtgcctccgaactcggcctcgctggaggaggcccggcaccgcgtcttcgatttcttcaagcaggcatgccgctctatccccaccgtcatggagatctacaacctcgacgacgttgtcacgccctctcagctccgctcgaccatcgctaaggagatccgtaaaaaccagaacgtcaccaccccgagggtgattgatatgcttttctgtcacgcgacggaagagctgaacaacatagtcgaacatgcaaagcagcgccatcatgtgattgggcagtatgggatccgccaagaaggcctggtgcacgagctggggtcaaaggactagggaactctgactttctgaaaaattctacccaggcatttacttccggaccggggcgcaaatttacaaccttgggtatacccccggggggggccctaaaaaaaccccccctggggccctttcggggcccattttgttcccccggggagggtttgaacaatttggggccctgga

SEQ ID NO: 12237 - protein, 116 aa, Zea mays
  misc_feature: Ceres CLONE 1369884-F
  misc_feature (19)..(89): Pfam Name: Complex1_LYR Pfam Description: Complex 1 protein (LYR family)
MAFTMRAVKVPPNSASLEEARHRVFDFFKQACRSIPTVMEIYNLDDVVTPSQLRSTIAKEIRKNQNVTTPRVIDMLFCHATEELNNIVEHAKQRHHVIGQYGIRQEGLVHELGSKD

SEQ ID NO: 12238 - DNA, 682 bp, Zea mays
  misc_feature: Ceres CLONE 1369887-F
  misc_feature: Encodes the peptide sequence at SEQ ID NO. 12239
  misc_feature (635)..(635): n is a, c, t, g, unknown, or other
aaagctggagctccccgcggtggcggccgctctagaactagtggatcccccgggctgcaggaattcgcacgagaccattacctagaacatcctaatcgaaaaaaaaactatctatatatctgcaaagtcaaatcatcacaggctgttgtttgcttcttttgggaaaggttttatatgaggcagatccaccggcggggcccccagaatccaatatgacgttgaaggtgatcgaatcgccaactgcgtcctaggtgtaccacgttctgttctgtctgatccagaaggacgtccagttccagctcatccgcgtcgactccttccgcggcaccaaacgcctgccccaaagattcgacgtccccacagccgatatggtctacagactccactacctgccacccgacatgcagctcgacgatatgtgcggcgatggactcccggtactaaccgggacgatgaacccggcgcaccgtcacaaggtggaggagatgctgcatctgttcgagaagaatcgcacgcaactgagcaagctgctgcacatctacaagcagcgccttgcataggaggccttcctgcccgtatgcaaattcacgctcgccgacctgtcgcacctgtccaacgccaaccgcctcgccggngacactcagatcgcacgactcatgtagtctcgtaggaactccagaaa

SEQ ID NO: 12239 - protein, 63 aa, Zea mays
  misc_feature: Ceres CLONE 1369887-F
MVYRLHYLPPDMQLDDMCGDGLPVLTGTMNPAHRHKVEEMLHLFEKNRTQLSKLLHIYKQRLA

SEQ ID NO: 12240 - DNA, 694 bp, Zea mays
  misc_feature: Ceres CLONE 1369890-F
  misc_feature: Translation starting site: 264
  misc_feature (331)..(331): n is a, c, t, g, unknown, or other
  misc_feature (440)..(440): n is a, c, t, g, unknown, or other
  misc_feature (585)..(585): n is a, c, t, g, unknown, or other
caaagctggagctccccgcggtggcggccgctctagaactagtggatcccccgggctgcaggaattcgcacgagaccattacctagaacatcctaatcgaaaagaagcatgccacgcctgaccgacccccttctcgcctaatcacccgcagcctgtctctgctcggcggcggccgtctcgactgcgggagaggggatcgccccttcgccgatctgatcgggagctgcaggccaaacggcgaggcgagcccatcaggaaccaccatggcagcggcagccgccgactccgatcccgccgcagctgtggccgacatgtccctgcgcccattgtncacgagagatcccttcttcgaacatcgacttgcattctgtacattgtgcccgtaacctcaaaagtgccagcactgtgaagaaatgattccctaggaacttatggatgancactatgatgcaaaccatgccccgatcagttgctctcttttgcaagaacaataaaaccggggaggggggtatcttcctaaagtccaaaaagggcccccaagaaaccggcgcttgggaatattggcaattttgaatggcctggcanttgatcccccggggctttcggggggtggggggaaccggaaagaaattttgcccaaatggggggaagaatttaaaattgggggaaggggaggggccccaaataccgggcc

SEQ ID NO: 12241 - DNA, 694 bp, Zea mays
  misc_feature: Ceres CLONE 1369891-F
  misc_feature: Encodes the peptide sequence at SEQ ID NO. 12242
  misc_feature (432)..(432): n is a, c, t, g, unknown, or other
  misc_feature (495)..(495): n is a, c, t, g, unknown, or other
  misc_feature (546)..(546): n is a, c, t, g, unknown, or other
aaagctggagctccccgcggtggcggccgctctagaactagtggatcccccgggctgcaggaattcgcacgagaccattacctagaacatcctaatcgaaaaagactccagtctcctctagccgtctcgcgcgcttcaccttccccaccccgccgccgccatcgcacgcccgcagccgcatccgctatgggtgcgtacaagtacgtctcggagctatggcggaggaagcagtccgatgtgatgcggttcgtgcagcgcgtgcgctgctgggagtacaggcagcagccggccatcgtccgcctcacaaggcccactcgccctgacaaggcgcgccgcctcggctacaaggccaagcagggttatgttgtttaccgtgtccgtgttaggcgtggtggcaggaagaaggctgtgcctaaaggtattgtctatggncagccaaagcaccagggtatcacccagctcaagttccagaggaaaacagacgtctgtgctgangagagggctggacaaaagcttgtggactcaggggtctcaactcctactggntgaatggagatagcacctaccagtactttgaaaatattcctggttgatgggccccccctaccattccgcatgggtccaaggatcaactgggtatgcaatccctggggccaagcaacgggaattcccggggtcccacctcccagggaaa

SEQ ID NO: 12242 - protein, 120 aa, Zea mays
  misc_feature: Ceres CLONE 1369891-F
  misc_feature (2)..(121): Pfam Name: Ribosomal_L15e Pfam Description: Ribosomal L15
  misc_feature (103)..(103): Xaa is any aa, unknown, or other
MGAYKYVSELWRRKQSDVMRFVQRVRCWEYRQQPAIVRLTRPTRPDKARRLGYKAKQGYVVYRVRVRRGGRKKAVPKGIVYGQPKHQGITQLKFQRKTDVCAXERAGQKLVDSGVSTPTG

SEQ ID NO: 12243 - DNA, 692 bp, Zea mays
  misc_feature: Ceres CLONE 1369892-F
  misc_feature: Encodes the peptide sequence at SEQ ID NO. 12244
  misc_feature (448)..(448): n is a, c, t, g, unknown, or other
  misc_feature (485)..(485): n is a, c, t, g, unknown, or other
  misc_feature (521)..(521): n is a, c, t, g, unknown, or other
agagctggagctccccgcggtggcggccgctctagaactagtggatcccccgggctgcaggaattcgcacgagaccattacctagaacatcctaatcgaaaagaagcatcacacactaatcaacaagcaggaccagctagctagctcctctcactgctatcacccgcccagccatctcgctgaaagagaaaagcgcagccatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacaggcaggccacgtgccggtgcctcaaggcggnctacgttcaggtccacgctgtgctctccgcggcgcangagctgcccggcgactgcggcctctcgctgtcctancacatcacccccgacatcgactgcgacaagatcgaatgaagggatactggtcccttaccagaaatcatacgacgggatgttgatgttcagtgccctgctagcagtaggctgcatctgcactgagtgactagaaaaaggatttgggggatgttgtgctgaataaggtggtcg

SEQ ID NO: 12244 - protein, 119 aa, Zea mays
  misc_feature: Ceres CLONE 1369892-F
  misc_feature (28)..(115): Pfam Name: Tryp_alpha_amyl Pfam Description: Protease inhibitor/seed storage/LTP family
  misc_feature (83)..(83): Xaa is any aa, unknown, or other
  misc_feature (95)..(95): Xaa is any aa, unknown, or other
  misc_feature (107)..(107): Xaa is any aa, unknown, or other
MKTTSSGIAVVLLVAMLAVHSALADISCSDVLNDLSPCLPFLQGKAAKPSESNNQCCDGVRALYAAADTRPDRQATCRCLKAXYVQVHAVLSAAXELPGDCGLSLSXHITPDIDCDKIE

SEQ ID NO: 12245 - DNA, 705 bp, Zea mays
  misc_feature: Ceres CLONE 1369895-F
  misc_feature: Encodes the peptide sequence at SEQ ID NO. 12246
  misc_feature (521)..(521): n is a, c, t, g, unknown, or other
  misc_feature (557)..(557): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcaaaaaatcgccgaggaacctaagctacagaccaccgctgtgtaaacgaagccatcgccatggggaatggttgcgttgagcagggggacttctcctcctgcctctgctcagagccccccctcggtgggctaatctctcgacgcgggcttgaccatgccgaagaccgtgatggatctgcaaatgtggccttgcggaaagatccggtaaggcccagaaagcggaaagaagagcactttcttctacgaagactctccaagcgagctgatattttatatgcccggtacaaactttttagaggaaagaaggaaagcacgactgacgccggatcttccccaacatacgtgggggggatgtaattctatccctatctgtggtctggcaacaatgttaaataaaacgaatgcctaatgctgctgccttcaagngtgataaattcgggcaagcagcggcagtttgcattntacctaagccatatattttagaagagagctcttattgcatccaccatggaaaaaactctttttctggtgcgggcatcttaatgtttagtcnnnanaaatggaaaaggggtgggacttcgcttcatggcggaatcgaaaaaagtgcttt

SEQ ID NO: 12246 - protein, 98 aa, Zea mays
  misc_feature: Ceres CLONE 1369895-F
MGNGCVEQGDFSSCLCSEPPLGGLISRRGLDHAEDRDGSANVALRKDPVRPRKRKEEHFLLRRLSKRADILYARYKLFRGKKESTTDAGSSPTYVGGM

SEQ ID NO: 12247 - DNA, 681 bp, Zea mays
  misc_feature: Ceres CLONE 1369896-F
  misc_feature: Encodes the peptide sequence at SEQ ID NO. 12248
agagctggagctccccgcggtggcggccgctctagaactagtggatcccccgggctgcaggaattcgcacgagaccattacctagaacatcctaatcaaaaaaccaaaacccgcatccataaacaagaaaaagaaaagaaaacccccgctgccagcgacagaagaagaaggggtcccttctccttggttgcgttgcgcctccctcctgtctgcgtgcgtgcaatcgacgcagaggcgcgggcgctcgcaccaccacgaccacgacccgatggctttcatgcgctcccgctcaaatgcatcttctggcatgggagttgctcctaacattagggagacattcgtcgagcttcaaatgaagaaggcattccgatatgttagcttcaaaatcgaacagaaacaaaagcaggtggttgtggagaagacaggggctactactgaaagctatgatgactttttggcctctctcccagagaatgactgccgatatgcgctgaatgattctgattttgctactggggagaatgtgcagaaaagcaagattttcttcattgcctggtccccatcgacatcccgcatacgtgctaagatgctgcactccacgccgaaggaccgcatcaagtacgagcttgacgggttccaccacctaaatccaggcgaccgaccccatcggaggtggacatc

SEQ ID NO: 12248 - protein, 137 aa, Zea mays
  misc_feature: Ceres CLONE 1369896-F
  misc_feature (18)..(133): Pfam Name: Cofilin_ADF Pfam Description: Cofilin/tropomyosin-type actin-binding protein
MAFMRSRSNASSGMGVAPNIRETFVELQMKKAFRYVSFKIEQKQKQVVVEKTGATTESYDDFLASLPENDCRYALNDSDFATGENVQKSKIFFIAWSPSTSRIRAKMLHSTPKDRIKYELDGFHHLNPGDRPHRRWT

SEQ ID NO: 12249 - DNA, 690 bp, Zea mays
  misc_feature: Ceres CLONE 1369898-F
  misc_feature: Encodes the peptide sequence at SEQ ID NO. 12250
  misc_feature (427)..(427): n is a, c, t, g, unknown, or other
  misc_feature (428)..(428): n is a, c, t, g, unknown, or other
  misc_feature (442)..(442): n is a, c, t, g, unknown, or other
  misc_feature (495)..(495): n is a, c, t, g, unknown, or other
aaagctggagctccccgcggtggcggccgctctagaactagtggatcccccgggctgcaggaattcgcacgagaccattacctagaacatcctaatcgaaaaatccaaccgttcctgggtcgcacagcccatcccgccgcgccgtctccctctcgccccaaacccctctcctcctctctttctctatccacctttccaccgtcaccatggccaccgccactacgtccgcctatcattgcaacgccgtcctccaccttcccagacctccgcagttccgccggctcctgccccctctcccctccctcgtcacccgcagagccgcgagcgtcgggctgggggtcgcccgtctcggttcgagggcgagggcaagggcaagttccgtaccgccaccgccaccattttttgaaaccgtggaggaggaaggagnngagagaggaggaancgtggtggtcggatgcggaggcgggattcagtgacgaggcagaggatgagcangagtggtcgggcggcaacggggccgcccgcggtgaggacctgggcgcggacccggcgaaggaccttagcgggtgggcgcggaaatggccgcgccccccggaacttgtcctgtgcaacctcccccgccgctgcaacgtccaagacctgctcaagttcttaaggccccagggaaccgttcttctcggcgaaaattcc

SEQ ID NO: 12250 - protein, 230 aa, Zea mays
  misc_feature: Ceres CLONE 1369898-F
  misc_feature (143)..(143): Xaa is any aa, unknown, or other
  misc_feature (148)..(148): Xaa is any aa, unknown, or other
  misc_feature (165)..(165): Xaa is any aa, unknown, or other
KAGAPRGGGRSRTSGSPGLQEFARDHYLEHPNRKIQPFLGRTAHPAAPSPSRPKPLSSSLSLSTFPPSPWPPPLRPPIIATPSSTFPDLRSSAGSCPLSPPSSPAEPRASGWGSPVSVRGRGQGQVPYRHRHHFLKPWRRKEXREEEXWWSDAEAGFSDEAEDEXEWSGGNGAARGEDLGADPAKDLSGWARKWPRPPELVLCNLPRRCNVQDLLKFLRPQGTVLLGENS

SEQ ID NO: 12251 - DNA, 683 bp, Zea mays
  misc_feature: Ceres CLONE 1369899-F
  misc_feature: Translation starting site: 186
aagctggagctccccgcggtggcggccgctctagtactagtggatcccccgggctgcaggaattcgcacgagaccattacctagaacatcctaatcgaaaaagactccagactcctctagccgtctcgtgcgcttcgccttccccaccccgccgccgccatcgcacggccgcagccgcatccgctatgagtgcgtacaatgacatctcggagctatgccggacgacaaattccgatgtgatgagatatcgtgcagcgtgtgcgctgctgggagtacaggcagcacccggccatcgaccgcctcacaaggaccactccccctgacaaggcgcgccgcctctcctacaagggcaagcaggtttatgttgcttaccctgaccgtgggaggggtgacggcaagaacacctctgtgcctaaaggtattgtctatggcaagacatagtaccagggcatcacccagctcaagttccacagtaacaacacgtctgttgctgagtatagggctggactaaagcttggaggactcataggttctcaactcctactgcgtgaatgaggatagcacctactgccactttgagatcattcttgttgatgaggcccacactaccatcctgaatgatccaaggatcaactgggtatgccatcctgagcacaagcacctggagctccgtgaactcacct

SEQ ID NO: 12252 - DNA, 699 bp, Zea mays
  misc_feature: Ceres CLONE 1370023-F
  misc_feature: Encodes the peptide sequence at SEQ ID NO. 12253
  misc_feature (447)..(447): n is a, c, t, g, unknown, or other
  misc_feature (463)..(463): n is a, c, t, g, unknown, or other
agagctggagctccccgcggtggcggccgctctagaactagtggatcccccgggctgcaggaattcgcacgagaccattacctagaacatcctaatcgaaaaaccggccaccgcgaatccagagccccacgccccgtccgaaccccagagcagagcaaagcctcctcgacctccctgtccccagccttccccgatggcccgcacgaagcagacggcgcgcaagtcgacgggcggcaaggcgccgcggaagcagctggcgacgaaggcggcgcgcaagtcggcgccggcgacgggcggcgtgaagaagccgcaccgcttccgcccgggcaccgtcgcgctgcgcgagatccgcaagtaccagaagagcacggagctgctgatcccgcagctcccgttcccagcgctggtccgcgagatcgcgcaggacttcaagacggacctcgcttncagtcctccgccgtcnccccgctgcaggaagccgccgaggcctacctggggggggctccttcgaggacaccaacttctgtggcatccacgccaggggggtcacattatggcccaggaaattccggttcgggggccaattccggggggaggggcctaaggggtttggttgggggcccggccccctatcggtggggggggttttatttaaccccccagggtggggataaaggggggggggttttcaaaagaagg

SEQ ID NO: 12253 - protein, 136 aa, Zea mays
  misc_feature: Ceres CLONE 1370023-F
  misc_feature (85)..(85): Xaa is any aa, unknown, or other
MARTKQTARKSTGGKAPRKQLATKAARKSAPATGGVKKPHRFRPGTVALREIRKYQKSTELLIPQLPFPALVREIAQDFKTDLAXSPPPSPRCRKPPRPTWGGLLRGHQLLWHPRQGGHIMAQEIPVRGPIPGGGA

SEQ ID NO: 12254 - DNA, 711 bp, Zea mays
  misc_feature: Ceres CLONE 1370025-F
  misc_feature: Encodes the peptide sequence at SEQ ID NO. 12255
agagctggagctccccgcggtggcggccgctctagaactagtggatcccccgggctgcaggaattcgcacgagaccattacctagaacatcctaatcgaaaatggaggcggccgtgtgcctctgcaccaccatcaagctcaggctcctgaacatcaacctctacctgcccctggcgctccagctcctcctcacctgcggcaagacgccgccgccgggctacacctgcaccgtctgatctggactagctggcagcccccggcccatgcgtccatttatccgacatgggttttggagtgagctagcatccagttcatcggtcgtttgaagagagatcgacatgagaggatgtcgtctgcttcgtcgttccaagctgaaaaaggcaccgccggaggaggaagaaaataacaacggcccgggccaatcagctaacgatggaccaatcattttttcccccaaattaattggggtggccgccgccggaaagttctaaaattttccaaaagggctttccggtttgggccggaccccccggccccttggttttgggtaaaattttttttaaaccaaagaaaaagggggggggggggaattggaaaaaaacccccgggaaatttttcccggggccccggggccttttgaaaaaaaagggggaaaaaaaaaaaaaaaaaaagtttatttaaccccccccccccgggggggggccccccccc

SEQ ID NO: 12255 - protein, 44 aa, Zea mays
  misc_feature: Ceres CLONE 1370025-F
MEAAVCLCTTIKLRLLNINLYLPLALQLLLTCGKTPPPGYTCTV

SEQ ID NO: 12256 - DNA, 669 bp, Zea mays
  misc_feature: Ceres CLONE 1370030-F
  misc_feature (384)..(384): n is a, c, t, g, unknown, or other
aagctggagctccccgcggtggcggccgctctagaactagtggatcccccgggctgcaggaattcgcacgagaccattacctagaacatcctaatcgaaaaaaaaaattaaaatcctcccggaaatcagagacgcgaatccctcgccccaggccccgaaacctccgagttctctcgccaattcgatccgcctcaccgccgccgcccgtccgccggtcggccttgactgctccgtcgcacgtggcggttcgcagcgcggaatctaccttgtgttgagagatccggggaaacccttgttcccggtcgttccggctcgaatcttctgcggactggcaatgtaagcgttctccatcggagggcgacgatctacggggcggttgttggncgggttgaggaaatggagcacgtgttcggagggaagtttaagcttgggaagaaagatcggagcgatctttcggcgagctctatctcggcgtcacatacagagcggcgaggaggtgctatcaagttgaatctgtaaaatcaagcatcctcagcttcttatgagtcgaacttatcatgcttctccagggggactggattcctcattgaaatgtttgggggggaggggagacaaggcagggccttgacttctgggcccagtttggagacgtttcaaccgggaaaaaaa

SEQ ID NO: 12257 - DNA, 707 bp, Zea mays
  misc_feature: Ceres CLONE 1370032-F
  misc_feature: Encodes the peptide sequence at SEQ ID NO. 12258
agagctggagctccccgcggtggcggccgctctagaactagtggatcccccgggctgcaggaattcgcacgagaccattacctagaacatcctaatcgaaaaatcttctccatctccaattgtgctactgcaggagctgctgcattcggcggagagacacgcgaccagtttgccggcaccaacacgggctgctgctccgcattttgatgactatttctgtctgaaaactgtctctgtcaggtgttcattcacgctgctgcagcaagcaactggatgatggcttccaggcagtcagggaacaatgcacaagaagcagcatcaccattggcgagtcctcctcactccaacatagtcagcatcatcccttcgatgcccctcgagaccaggtgcccaccgttccctctccgccgttacgataacttttgggtgcctgaggtaatattgaaggcagacgtccccggcattcattcctgcttcaagccgagacccaccgacgtgttcgtcgaaagcttccccaagtctggcaccacttggctcagggaccttgccttcgcgacgctagagcgttccacgcatccgccattggatggcgaccatccgctgcgtcgttgcaaccctcatgactgtgtcaggctccgcgatgctatcttcacccagcgaaagatgaggtggaggctctcccgtccccgcgcgtgctagccacgcac

SEQ ID NO: 12258 - protein, 141 aa, Zea mays
  misc_feature: Ceres CLONE 1370032-F
MMASRQSGNNAQEAASPLASPPHSNIVSIIPSMPLETRCPPFPLRRYDNFWVPEVILKADVPGIHSCFKPRPTDVFVESFPKSGTTWLRDLAFATLERSTHPPLDGDHPLRRCNPHDCVRLRDAIFTQRKMRWRLSRPRAC

SEQ ID NO: 12259 - DNA, 737 bp, Zea mays
  misc_feature: Ceres CLONE 1370033-F
  misc_feature: Encodes the peptide sequence at SEQ ID NO. 12260
  misc_feature (542)..(542): n is a, c, t, g, unknown, or other
  misc_feature (683)..(683): n is a, c, t, g, unknown, or other
tcagaactagtggatcccccgggctgcaggaattcgcacgagaccattacctagaacatcctaatcgaaaaatcagatcgcatctccctctccgaaatcaaggtagcgtacaccgctgcagtttccagagccctctctgccactcgtgatcacactagccccaatggcctgccctcgacaacgccgcatcccgatcgtccagcccgccgcgtctccaacccgaagtctggttcaccaagccgaaggggtcgaccgttgagggtaccacccgccttacttccagatgatcaaggaggcctatcatgccgcttcaggaaaagaacgttttcctgttccccaagcaatccccagggtatgtgggcgggacaagcaccgctgcgtttcctgacccctcaagtttcaagaaagaccctttcccctcacagcatacgctgaggtccggctgccccagctaacaacattccccgaagggccaagggctttccgtacaaatttcctcggggactcccccccaagaaaggcccatcccaccaaagaagccnatgtataaagccgttgaaaatggcctggccactcacccaaaaaacccccggcccaccaaacacagggacaaggtggcgtcctcccgattaagccccccacaaacggaacggatttcccaaagaaaaaaaaaaaacccttgntttctggttgggtacaccagccgaaaaagttgtccgaagaaaaatacgccccgc

SEQ ID NO: 12260 - protein, 65 aa, Zea mays
  misc_feature: Ceres CLONE 1370033-F
  misc_feature (47)..(47): Xaa is any aa, unknown, or other
MYKAVENGLATHPKNPRPTKHRDKVASSRLSPPQTERISQRKKKNPXFLVGYTSRKSCPKKNTPR

SEQ ID NO: 12261 - DNA, 680 bp, Zea mays
  misc_feature: Ceres CLONE 1370035-F
  misc_feature: Translation starting site: 168
  misc_feature: Pfam Name: GST_C Pfam Description: Glutathione S-transferase, C-terminal domain
  misc_feature: SWISSPROT Homolog: EC 2.5.1.18 Glutathione transferase
  misc_feature (450)..(450): n is a, c, t, g, unknown, or other
  misc_feature (515)..(515): n is a, c, t, g, unknown, or other
  misc_feature (516)..(516): n is a, c, t, g, unknown, or other
aaagctggagctccccgcggtggcggccgctctagaactagtggatcccccgggctgcaggaattcgcacgagaccattacctagaacatcctaatcgaaaaagcaagcaaagattgcgccggtgagggtgttcgggacggcggacttcgtgaacgctgcgagggttatggcttgcctggaggaagttggcgtggagtacgaggtcgtcgaggtcgactacgcggccatggagcacaagggcgcccagcacctcgcaagaaacccgttcggccaaatcccagcgtttcaggacggggacacgatgctctttgaatcccgagcaatcgccaagtacgtgctcccgcaatactccaagtcagctcaagtcgacctgctccgtgagggcaacccggaggaagccgccatggtagacgtgtggacggaggtcgaggcgcacacctacctacccngcatcgcgcccatcttctacgagtacgtggtgtaccccgccgagcatggcacccacgcccaccanngagtggtggacgagagtgtggagaggctcaggaaggtcctcgacgtctacgaggcgcacctggtacagaccagcagctctatctcgcccgggactacttcagcctcgccgatctcaaccacgtcccgtacaccttcccactcatgaggacaccgcacgcgtcgt

SEQ ID NO: 12262 - DNA, 696 bp, Zea mays
  misc_feature: Ceres CLONE 1370036-F
  misc_feature: Encodes the peptide sequence at SEQ ID NO. 12263
aaagctggagctccccgcggtggcggccgctctagaactagtggatcccccgggctgcaggaattcgcacgagaccattacctagaacatcctaatcgaaaaatcgcacaaattctccgtaacttcacagcgtatcatcgttttccatcgctcctactcctatcatccaaaaaatctgagcggcattgatggcgcccaaggcgtataataatccggcggcgaataaggtggcggaagaggagccctcggagaatgcggctccagcggagaaggcccccgcgctaaagaaggtcaatgcggacaagcctctacctgcacccaagtccgccgatcaaggagggcggccaccagaaggacaggaagaaagccaagaagagcgtggagacctacaatatctacatcttctaggcctctgaagcaggtgcaccccgacatcagtatcatcctccaaggtcatgtccatcatgaactccttcatctacgaactcttcaagaaactcgccgcggatgccgccaagctcgcccggtacaacaagaaacccaccatcacctcccgagagatccagacctccgtccgcctcgtcctccccggctagctctccaagcacgccgtgtcgtaggtgaccaagggcgtcaccaagctcacctcgtcttagccgccttgtaacaggcgtcattgctgtctgcttctcaaga

SEQ ID NO: 12263 - protein, 46 aa, Zea mays
  misc_feature: Ceres CLONE 1370036-F
MSIMNSFIYELFKKLAADAAKLARYNKKPTITSREIQTSVRLVLPG

SEQ ID NO: 12264 - DNA, 708 bp, Zea mays
  misc_feature: Ceres CLONE 1370038-F
  misc_feature: Encodes the peptide sequence at SEQ ID NO. 12265
  misc_feature (438)..(438): n is a, c, t, g, unknown, or other
aagctggagctccccgcggtggcggccgctctagaactagtggatcccccgggctgcaggaattcgcacgagaccattacctagaacatcctaatcgaaaaacacgcgaatcctcaaatctgcccttgccgccgccactgcccgatccaggtgtgcagactgctccctcctcctctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcacggagctgctcatccgcaagctccccttccagcgcctcgtccgcgagatcgcgcaggacttcaagacggacctgcggntccagtcctcggccgtggcggcgctgcaggagcccgcggaggcgaccctggtggggttcttcgaggacaccaacctctgcgccatccacgcccagagggtcaccatcatgcccaaagaaaatcaagctcgccccccccgcatcagggcgaaaagggtttgaactgtcccccctgctggctgttccgcccttgaaatgcctaaaagaaaaggggggggggggggctttcaatagccgggccaatattggcaatttccggagggggtgggtc

SEQ ID NO: 12265 - protein, 137 aa, Zea mays
  misc_feature: Ceres CLONE 1370038-F
  misc_feature (58)..(133): Pfam Name: Histone Pfam Description: Core histone H2A/H2B/H3/H4
  misc_feature (85)..(85): Xaa is any aa, unknown, or other
MARTKQTARKSTGGKAPRKQLATKAARKSAPATGGVKKPHRFRPGTVALREIRKYQKSTELLIRKLPFQRLVREIAQDFKTDLRXQSSAVAALQEPAEATLVGFFEDTNLCAIHAQRVTIMPKENQARPPRIRAKRV

SEQ ID NO: 12266 - DNA, 677 bp, Zea mays
  misc_feature: Ceres CLONE 1370040-F
  misc_feature: Encodes the peptide sequence at SEQ ID NO. 12267
  misc_feature (495)..(495): n is a, c, t, g, unknown, or other
  misc_feature (514)..(514): n is a, c, t, g, unknown, or other
  misc_feature (592)..(592): n is a, c, t, g, unknown, or other
aaagctggagctccccgcggtggcggccgctctagaactagtggatcccccgggctgcaggaattcgcacgagaccattacctagaacatcctaatcgaaaagtgctttctcagaggtgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggattacgtgtcgggcgccgtgatggangcgactacggcggtggcgntggaagcttactgcgtgatcgtggaggctacggcggcggtgggggatacggtggtgcaaccggcgcggtgttacgggnacaacacggaactggagaactgagcgtggggtccgtgaggcctaatatctggtcgcttctgtacggggtcaccctagcttaaggg

SEQ ID NO: 12267 - protein, 163 aa, Zea mays
  misc_feature: Ceres CLONE 1370040-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (105)..(105): Xaa is any aa, unknown, or other
  misc_feature (111)..(111): Xaa is any aa, unknown, or other
  misc_feature (137)..(137): Xaa is any aa, unknown, or other
MAASDVEYRCFVGGLAWATDDHSLNNAFSTYGEVLESKIILDRETQRSRGFGFVTFSTEDAMRSAIEGMNGKELDGRNITVNEAQSRGGRGGGGGGLRVGRRDGXDYGGGXGSLLRDRGGYGGGGGYGGATGAVLRXQHGTGELSVGSVRPNIWSLLYGVTLA

SEQ ID NO: 12268 - DNA, 719 bp, Zea mays
  misc_feature: Ceres CLONE 1370042-F
  misc_feature: Encodes the peptide sequence at SEQ ID NO. 12269
  misc_feature (367)..(367): n is a, c, t, g, unknown, or other
  misc_feature (388)..(388): n is a, c, t, g, unknown, or other
  misc_feature (393)..(393): n is a, c, t, g, unknown, or other
  misc_feature (405)..(405): n is a, c, t, g, unknown, or other
  misc_feature (492)..(492): n is a, c, t, g, unknown, or other
  misc_feature (508)..(508): n is a, c, t, g, unknown, or other
aaagctggagctccccgcggtggcggccgctctagaactagtggatcccccgggctgcaggaattcgcacgagaccattacctagaacatcctaatcgaaaaccgcgcccaagcccaagccctcgccgaaggcgaaggccaagaccgctgcgaagcccaaggcggcgtcgcccaagcccaaggccaaggccaaggccaaggccaagcctgtcgctccgccgcgtcgcccaagccccgcgggcgccctcccaaggtcgccaagacctccgccaaggcctcccccgccaaggcagccaagaaggcggctgctcctgcccagaagggaaaggcagcggcggctcctaagaaaggtggcacccccgaaaangctgctgctgctgccgctccngtcangaagggcgtggncaggaaggccaagaagtagtctgcccgccttgtcgctggcgagatcccccccctcaatccgccctatagatccccctctttcatggnatttgatcccatcggnataatggcccagaactctaaattcgtcggtaactccagaatgaggggccggggaaaattcttgggcctgtaaaaaacttggaagggttgaccgcggggggtaaaacgtaatggcccctccaggttctatgaaacaagctaagcttaaaaagatttttgcccaaaaaaaaaaaaaaaaaaagttttttttacccgccaccccggagggggga

SEQ ID NO: 12269 - protein, 30 aa, Zea mays
  misc_feature: Ceres CLONE 1370042-F
  misc_feature (2)..(2): Xaa is any aa, unknown, or other
MXFDPIGIMAQNSKFVGNSRMRGRGKFLGL

SEQ ID NO: 12270 - DNA, 693 bp, Zea mays
  misc_feature: Ceres CLONE 1370047-F
  misc_feature: Encodes the peptide sequence at SEQ ID NO. 12271
  misc_feature (437)..(437): n is a, c, t, g, unknown, or other
tggagctccccgcggtggcggccgctctagaactagtggatcccccgggctgcaggaattcgcacgagaccattacctagaacatcctaatcgaaaaagcagttcctcagacgcaaagaagatcgagtctgcagcccacaccatagtgcgagcagattgcgtccaataggcgcaaagggagatgggggtggccgctggacgagcggcggccatggtggctgcggcggcggcggcggcggcggtgctgctgctgctcgcgggcggcgcgcacgcggactgctacgacgactgcttcaaggactgcatggccaggttcaagtccatgagagactactgcagctacgcgtgcgagaaggtctgcgatccggacgccacgctccagcgccccctcgccgttgtggagccagcagcagcgttgtgcgaccaccacccgttgnacaagaaagcatgtgctgtctggccccgcgcgttgccccgacatcctttccacgagacgcacggcgacgtctagccggcagggaagcccggaccagcttagcccgtcgttcgtccggaacggtgcccccgccctccctgaaacccgcccgaaacgaaaaccccctatgctatcccgttccgcctgggccccctttttgttaacaccaaacaaaggggtgggttggtccaaccgaaaaacaggccttaaatttcccc

SEQ ID NO: 12271 - protein, 109 aa, Zea mays
  misc_feature: Ceres CLONE 1370047-F
  misc_feature (86)..(86): Xaa is any aa, unknown, or other
MGVAAGRAAAMVAAAAAAAAVLLLLAGGAHADCYDDCFKDCMARFKSMRDYCSYACEKVCDPDATLQRPLAVVEPAAALCDHHPLXKKACAVWPRALPRHPFHETHGDV

SEQ ID NO: 12272 - DNA, 513 bp, Zea mays
  misc_feature: Ceres CLONE 1370048-F
  misc_feature: Encodes the peptide sequence at SEQ ID NO. 12273
agagctggagctccccgcggtggcggccgctctagaactagtggatcccccgggctgcaggaattcgcacgagaccattacctagaacatcctaatcgaaaagattgggtccaacaccagccgccgccatgtcgaagcgaggcaggggaggttcggcggggaacaagttccgcatgtcgctgggtctgccagtggccgcgacggtggaactgcggcggaaaaacacggggcagacctcactcattcgtcagggatcagggcgctcatccctccgtcgctggttgcgactggctggcacgccaaaaggaaccccctcgaaaggggtgcccccttttccccagggagcggggcccaaggggggcttattgcttcaaaaaggggggggtgtgggcccccggggggaaaagggtccctctccgccccctcccgggggggggggttttttccccggtgtgtgcccccacccccccttttaagggggggggaatttcgccccttttttggcccttttta

SEQ ID NO: 12273 - protein, 115 aa, Zea mays
  misc_feature: Ceres CLONE 1370048-F
MSKRGRGGSAGNKFRMSLGLPVAATVELRRKNTGQTSLIRQGSGRSSLRRWLRLAGTPKGTPSKGVPPFPQGAGPKGGLLLQKGGGVGPRGEKGPSPPPPGGGGFFPGVCPHPPF

SEQ ID NO: 12274 - DNA, 613 bp, Zea mays
  misc_feature: Ceres CLONE 1370049-F
  misc_feature: Encodes the peptide sequence at SEQ ID NO. 12275
aagctggagctccccgcggtggcggccgctctagaactagtggatcccccgggctgcaggaattcgcacgagaccattacctagaacatcctaatcgaaaaactcggaaggctcaccaaatcgtcctacgcttctgcctcctcctccacgaggtgaggaaaccctagcgactgaccatggcgttgctcccgcgcaccgcacggttggccttcctctctaccccgcggtcgtactccgccgccgccgctgccgctgcgggcgcctccccgacctcaccagagccatacgggggcgcgcccccaccggcgatgtctaagaacgacgagttcgtggtctccaagggtgatgacctgatgaactgggcgcagtaagggctcgaattggggccatgacctttcgggctccgcctggttggcccgggtcaaaaattattccccccccggggcggtcccccgtaagaaaattcaaagggggggggggggattttttttgggccccccccccggggaaaatccaaattggatgtttattttgccccggggcccctccccccaaaaaaaaggggccccccccccccccccccgggggggttttataacccaaaacagccccg

SEQ ID NO: 12275 - protein, 64 aa, Zea mays
  misc_feature: Ceres CLONE 1370049-F
MALLPRTARLAFLSTPRSYSAAAAAAAGASPTSPEPYGGAPPPAMSKNDEFVVSKGDDLMNWAQ

SEQ ID NO: 12276 - DNA, 683 bp, Zea mays
  misc_feature: Ceres CLONE 1370050-F
  misc_feature: Encodes the peptide sequence at SEQ ID NO. 12277
  misc_feature (459)..(459): n is a, c, t, g, unknown, or other
  misc_feature (563)..(563): n is a, c, t, g, unknown, or other
aaagctggagctccccgcggtggcggccgctctagaactagtggatcccccgggctgcaggaattcgcacgagaccattacctagaacatcctaatcgaaaattctgaacatgtatacaatgatcaccggaaagactgtagaccttagtgtggatttgagtgctgctagtgctgccgaagaatactgatttcagtcatagtgtcatgtttatcaaagatcacatcgttggcgacagcacatgacccacattaatgaatggctggaatgcgtttattcggttccagattatatcatgccacatgtactgttctgcgtaatgtctactgggctggcagaactatgcacaatgttgatttcagttgatggatggtggtggttctgttatttactagttagtcgaatggtgcacaacattaaacagtgaccatcatggctgtgtgatgtatcataataactgntcagtaaatttgtgctctgcctggaatctgctcaatgctattgacggcgccctaagtgctggttccctgtgattgaacgaatcttgcccccatcatggtcttcnaagattttaaccaaaaacttttttggctgatgggccaaaccggttcaaaaaaaaaaaaaaaaagctattcataccgcccacccccaggggggggccccggaccaatttcccccataaggg

SEQ ID NO: 12277 - protein, 61 aa, Zea mays
  misc_feature: Ceres CLONE 1370050-F
MTHINEWLECVYSVPDYIMPHVLFCVMSTGLAELCTMLISVDGWWWFCYLLVSRMVHNIKQ

SEQ ID NO: 12278 - DNA, 670 bp, Zea mays
  misc_feature: Ceres CLONE 1370052-F
  misc_feature: Encodes the peptide sequence at SEQ ID NO. 12279
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (492)..(492): n is a, c, t, g, unknown, or other
  misc_feature (493)..(493): n is a, c, t, g, unknown, or other
  misc_feature (512)..(512): n is a, c, t, g, unknown, or other
  misc_feature (530)..(530): n is a, c, t, g, unknown, or other
  misc_feature (531)..(531): n is a, c, t, g, unknown, or other
  misc_feature (566)..(566): n is a, c, t, g, unknown, or other
  misc_feature (572)..(572): n is a, c, t, g, unknown, or other
tggagctccccgcggtggcggccgctctagaactagtggatcccccgggctgcaggaattcgcacgagaccattacctagaacatcctaatcgaaaaaaaggacaaaggagcggcggcgaggtctatggcgtcgacggcggggtacctggcgcggcgggcggcgcaaaaagagagggtgagcctgctctaccgcagggcgctcaaggacacgctcaactggggcgtccaccgccacctcttctaccaggacgcgtcggatctccgggacaagttcgaggccaaccgacacgtggataacctggacgtggtcgataggctcatcgacgatgcggaggctcagtacaggaacttccagcaccccgatccctacattgttccatgggccgcaggcggcactaaattcacaagaaacccccctccacctcaggggatcgagatcatctacaattatgggcagggaggaccagtannnacagagtccctgcaagcgnnggcagaacttccacaggtnccaatcacttcctttaanntcgagttggtgtacgagaaaataggatgggaattnactggnactccatccatggcttctcatttggcttggtccgataaccatatgcctcctccatctagggcaatattggaggggatgtttccctggcataaaaaggg

SEQ ID NO: 12279 - protein, 181 aa, Zea mays
  misc_feature: Ceres CLONE 1370052-F
  misc_feature (13)..(78): Pfam Name: Complex1_LYR Pfam Description: Complex 1 protein (LYR family)
  misc_feature (116)..(116): Xaa is any aa, unknown, or other
  misc_feature (123)..(123): Xaa is any aa, unknown, or other
  misc_feature (135)..(135): Xaa is any aa, unknown, or other
  misc_feature (136)..(136): Xaa is any aa, unknown, or other
  misc_feature (147)..(147): Xaa is any aa, unknown, or other
MASTAGYLARRAAQKERVSLLYRRALKDTLNWGVHRHLFYQDASDLRDKFEANRHVDNLDVVDRLIDDAEAQYRNFQHPDPYIVPWAAGGTKFTRNPPPPQGIEIIYNYGQGGPVXTESLQAXAELPQVPITSFXXELVYEKIGWEXTGTPSMASHLAWSDNHMPPPSRAILEGMFPWHKK

SEQ ID NO: 12280 - DNA, 700 bp, Zea mays
  misc_feature: Ceres CLONE 1370056-F
  misc_feature: Encodes the peptide sequence at SEQ ID NO. 12281
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (381)..(381): n is a, c, t, g, unknown, or other
  misc_feature (465)..(465): n is a, c, t, g, unknown, or other
  misc_feature (483)..(483): n is a, c, t, g, unknown, or other
tggagctccccgcggtggcggccgctctagaactagtggatcccccgggctgcaggaattcgcacgagaccattacctagaacatcctaatcgaaaacttgctaacgaggtgagagagtgttggggccgccgctcttgagggatagaagaagaggatacagcaagcgggggttgcgaggaggcggcggacgctatgggcaacgccgggagtgcgccggaccagcccaagaactcggcggatggggccggcgctgccgacgcggagtctcgccgcgggccgccgtctacggtgcgtttcttccccgatggggagcgccacaaggcacggcagccgccgccaataaagctcgaggagnnnagaggcgtccccgccgcgcccgncaccgaggaggagatggccccgcgcaacctctggcaggtgtatgcgcttggggcggtcattgtgttgagatgggcctgggctangagggagggagaacaggnacagaaaggactccacctgatggctggggatgggaatgcaccgggaacgaatcaacttattcctcgggttgctgctggggggaactaggctaccccgcaaaaatgaaggccgtttcccgataagccacggagggggggacctttccagccaagggctccaaataagggcctcgaggggggtgggggattatggtttttcccgaaaatttggaagtaa

SEQ ID NO: 12281 - protein, 125 aa, Zea mays
  misc_feature: Ceres CLONE 1370056-F
  misc_feature (55)..(55): Xaa is any aa, unknown, or other
  misc_feature (63)..(63): Xaa is any aa, unknown, or other
  misc_feature (91)..(91): Xaa is any aa, unknown, or other
  misc_feature (97)..(97): Xaa is any aa, unknown, or other
MGNAGSAPDQPKNSADGAGAADAESRRGPPSTVRFFPDGERHKARQPPPIKLEEXRGVPAAPXTEEEMAPRNLWQVYALGAVIVLRWAWAXREGEQXQKGLHLMAGDGNAPGTNQLIPRVAAGGN

SEQ ID NO: 12282 - DNA, 710 bp, Zea mays
  misc_feature: Ceres CLONE 1370057-F
  misc_feature: Encodes the peptide sequence at SEQ ID NO. 12283
  misc_feature (506)..(506): n is a, c, t, g, unknown, or other
  misc_feature (510)..(510): n is a, c, t, g, unknown, or other
  misc_feature (511)..(511): n is a, c, t, g, unknown, or other
aagctggagctccccgcggtggcggccgctctagaactagtggatcccccgggctgcaggaattcgcacgagaccattacctagaacatcctaatcgaaaaatcgccagacacactatagaccacagccagtcagccacatcactagctagctgtgcagaggcaatggcgtccaaggttgagctggtggtggaggtcaagtccccggctgacaagctgtgggcggcgctgcgcgactccacggagctgttccccaagatcttccccgagcagtacaagagcatcgagaccgtcgagggcgacggcaagtcggccggcaccgtccgcctccctcagtacaccgaggcggtgccgatgctgacgttcgccaaggagaagcttgagacggcggacgacgagacaaggttgtgtcctacagcgtggtggacggcgagcttggcggactctacaagaacttcaagatccccctgaaggtgactccggccaaaggggaccgggagggcgggncccnnctcagtttggccatgggggttcaaagggccaaggaccaggtgccaaaccccggaattattaaggaaaaccccaccaaaaagtttcccaaacctgaaaataaacctcctaaaaaataaagggggcccacccggggaaggggccccaaaaaaaaaattttcccgcctttttttcgggggggcaaattttaaaagggcggcg

SEQ ID NO: 12283 - protein, 101 aa, Zea mays
  misc_feature: Ceres CLONE 1370057-F
MASKVELVVEVKSPADKLWAALRDSTELFPKIFPEQYKSIETVEGDGKSAGTVRLPQYTEAVPMLTFAKEKLETADDETRLCPTAWWTASLADSTRTSRSP

SEQ ID NO: 12284 - DNA, 724 bp, Zea mays
  misc_feature: Ceres CLONE 1370062-F
  misc_feature: Translation starting site: 191
agagctggagctccccgcggtggcggccgctctagaactagtggatcccccgggctgcaggaattcgcacgagaccattacctagaacatcctaatcgaaaaaaggatccaccacaacagcgaaggagaaagcagaccaacctagccacccagggagaaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcgggcctccgcggctacaacaccggggctccgctccgacgctaccagggggcccagtcggaagaacataatctcccccaattataagggggggcaccggcggccgggaataacccttgggccccaccctggttctccaaaattttttcctggatcccccttaaagggggccccaccaacatttggccgccctgggttgaacctttgtgggaaccccctttggggggggggggcgctcacacctcttcgccgttaccccccccggggtttggaaaacccaaaaggaggacccccgaaggccctctctccccccgaggggggggacattttcatcccccttgggggaaaaagagaaccccttttttacaaaggtgttgtgcgcgtaaaaaaaaacacacccttggttgtatcaatgg

SEQ ID NO: 12285 - DNA, 707 bp, Zea mays
  misc_feature: Ceres CLONE 1370065-F
  misc_feature: Encodes the peptide sequence at SEQ ID NO. 12286
  misc_feature (475)..(475): n is a, c, t, g, unknown, or other
  misc_feature (606)..(606): n is a, c, t, g, unknown, or other
  misc_feature (676)..(676): n is a, c, t, g, unknown, or other
aaagctggagctccccgcggtggcggccgctctagaactagtggatcccccgggctgcaggaattcgcacgagaccattacctagaacatcctaatcgaaaaacaacacaacgcttatattacttacaacaaaagataagcccacgaatcagtagatcgaggtcccgcccagtccagcagaagcgcacacggagatgtcccagctgagccctgctggccacatggctgcgacgctcctcctcatcctcctggcctccgcagcagcagcagcggtgtcagctgaccaacaggtctctgcctgccagaatgacatagacgcactgtggcgcagctgcaagcagttcgtccagaaggaggggcccaagatgcctccgtccgaggactgctgcaaaaccatcaaggccttagacgcgcacgcgtcctgcatctgcgactacgtcggctccccggacgccaggaataagctagacctggnacagggtgtctttcgtaccaaacagtgcggcgtcaccgtccccaaggctgcggatcaaagcaggactgaagagcggctgaatctgaatggagcaagtgggcttacatacgcacggcagctacaaatacttnatagaataaataaaggtgggtcactgttggtttcatggtggttggagtacaccactggactggtcctatnctcatatatgataaaggaactctagtccatc

SEQ ID NO: 12286 - protein, 168 aa, Zea mays
  misc_feature: Ceres CLONE 1370065-F
  misc_feature (94)..(94): Xaa is any aa, unknown, or other
  misc_feature (138)..(138): Xaa is any aa, unknown, or other
  misc_feature (161)..(161): Xaa is any aa, unknown, or other
MSQLSPAGHMAATLLLILLASAAAAAVSADQQVSACQNDIDALWRSCKQFVQKEGPKMPPSEDCCKTIKALDAHASCICDYVGSPDARNKLDLXQGVFRTKQCGVTVPKAADQSRTEERLNLNGASGLTYARQLQILXRINKGGSLLVSWWLEYTTGLVLXSYMIKEL

SEQ ID NO: 12287 - DNA, 679 bp, Zea mays
  misc_feature: Ceres CLONE 1370073-F
  misc_feature: Encodes the peptide sequence at SEQ ID NO. 12288
  misc_feature (534)..(534): n is a, c, t, g, unknown, or other
  misc_feature (591)..(591): n is a, c, t, g, unknown, or other
aaagctggagctccccgcggtggcggccgctctagaactagtggatcccccgggctgcaggaattcgcacgagaccattacctagaacatcctaatcgaaaaattcttaaaaacctctgctcgggcctagggtttcctcccagtcgtcatcgcttggcgtccgcctcagcccgccgccaggagagttcaggagagtttcgagaagctgaaatggctcctaaagctgctcctgccaagaagggtgatgccaagacccaggccttgaaggttgccaaggctgtgaagtctgggtcagtaaagaagaccaagaagatccgcacgtccgtgacatttcaccgccccaagaccctgaagaaggctagggaccccaagtacccaagaatcagcactaccggaaggaacaagcttgatcagtaccaaattctcaagtatcccctcaccacagaatcggcgatgaagaagattgaagataacaacactcttgtcttcattgtcgacctcaaggcagacaagaagaagatcaaggctgctgtncagaagatgtatgacattcaggccgagaaggtcaacaccctgatcaggcctgatggnaagaagaaggcttacgtgaagcttatgcctgactatgatgctctttgatgtggcaacaaatcggcatcatctaaagtaccgcgtcagc

SEQ ID NO: 12288 - protein, 142 aa, Zea mays
  misc_feature: Ceres CLONE 1370073-F
  misc_feature (69)..(143): Pfam Name: Ribosomal_L23 Pfam Description: Ribosomal protein L23
  misc_feature (11)..(63): Pfam Name: Ribosomal_L23eN Pfam Description: Ribosomal protein L23, N-terminal domain
MAPKAAPAKKGDAKTQALKVAKAVKSGSVKKTKKIRTSVTFHRPKTLKKARDPKYPRISTTGRNKLDQYQILKYPLTTESAMKKIEDNNTLVFIVDLKADKKKIKAAVQKMYDIQAEKVNTLIRPDGKKKAYVKLMPDYDAL

SEQ ID NO: 12289 - DNA, 698 bp, Zea mays
  misc_feature: Ceres CLONE 1370075-F
  misc_feature: Encodes the peptide sequence at SEQ ID NO. 12290
  misc_feature (587)..(587): n is a, c, t, g, unknown, or other
  misc_feature (631)..(631): n is a, c, t, g, unknown, or other
aaagctggagctccccgcggtggcggccgctctagaactagtggatcccccgggctgcaggaattccttcgagaccgttacctacatcatcgtaatcaagagatcgtcacaatgaaccccactgacttggtcgaacctgattgagatcctgaacccttcaaacaaacctggacggatcaccataattacaagtatgggggcagagaacatgagagtgaagttgcctcatctcatccgtgctgcccccaatgctggattaattgtcacatgcattactgatcctatgcatggaaacaccatcaaggtcccttgtgcgctgaagactcgtccattcgactcatttctgagtgacccgcgcgcattcttcgacgtgcatgatcaagaaggtagtcacccacgaggcctccaccttgaaatgactgcgcaaaacgtgaccgagcgcattggtggatcacggactgtgaccttcgatgagcttagtgaccgctaccacacccactgtgactctacgcatgacgcctcccattccctggagcctcgcttcatcattgcagagaggctcaggaagagcaggatgcgatcgaagnctcaacaacagtctgccctctgccaccaactggctttctaagtnccctgaagcttgaacacaagagggaagatgggtatatttgcgggcacctccaaagaattacgccctg

SEQ ID NO: 12290 - protein, 144 aa, Zea mays
  misc_feature: Ceres CLONE 1370075-F
  misc_feature (1)..(120): Pfam Name: DAHP_synth_2 Pfam Description: Class-II DAHP synthetase family
  misc_feature: SWISSPROT Homolog: EC 2.5.1.54 3-deoxy-7-phosphoheptulonate synthase
  misc_feature (132)..(132): Xaa is any aa, unknown, or other
MGAENMRVKLPHLIRAAPNAGLIVTCITDPMHGNTIKVPCALKTRPFDSFLSDPRAFFDVHDQEGSHPRGLHLEMTAQNVTERIGGSRTVTFDELSDRYHTHCDSTHDASHSLEPRFIIAERLRKSRMRSKXQQQSALCHQLAF

SEQ ID NO: 12291 - DNA, 689 bp, Zea mays
  misc_feature: Ceres CLONE 1370081-F
  misc_feature: Encodes the peptide sequence at SEQ ID NO. 12292
aaagctggagctccccgcggtggcggccgctctagaactagtggatcccccgggctgcaggaattcgcacgagaccattacctagaacatcctaatcaaaatccccagtcgccactaaatccgctgccgtttcttctcgagtgtgaccctggcggatcaggaatcccacgtcatgcggagggcggtcttcgcagcgctgggattgctcatggtggccacgctggtgtacaccttgaacaccgaccggtcgccgttccgacttgagctgtttacgacctgaatggtggcaacactggatgatttttatgttaatgctattgcaatctccgcttgcgttatctacaaggaagccaactgagttatatctgctgtgcgcgaggatctgttcttttagctatggcaccgctgtcacttgcgcttatattgttaagaaacttcttgaagtaccatctgtcgggcccacccaacatcgctcttgaccttctatttatcaggagcatgtaatctatccccacagaaagtgctcttatgttgaaattggacaggttatttacagcattctagggatattcagtgctgctgtatgacacatatactgtcatcactgatggactaccttttagaatcgacttgttgacacagtgcatggagacaaccttaattgatttctacatacacgtctttgccat

SEQ ID NO: 12292 - protein, 35 aa, Zea mays
  misc_feature: Ceres CLONE 1370081-F
MRRAVFAALGLLMVATLVYTLNTDRSPFRLELFTT

SEQ ID NO: 12293 - DNA, 687 bp, Zea mays
  misc_feature: Ceres CLONE 1370082-F
  misc_feature: Pfam Name: UbiA Pfam Description: UbiA prenyltransferase family
aaagctggagctccccgcggtggcggccgctctagaactagtggatcccccgggctgcaggaattcgcacgagaccattacctagaacatcctaatcgaaaaagaagggttccctcatgtcatttccttgaagcgttccgctggcattcgaccaccaccgccacggtggggccgacgccgactacaaccactcggacagactaccgcctccacccccgctgcttctcatctccacgcaacctccccatgatcaagcggctcgacggcgacgacaaaaaggtgctcgtcgaggagccgaggctcacgcataacatcgtgactgaggcgctgtgactgcggctggaaggatttcctgccccacaactacaggaagcctggggcgtcggggacctacccgaggaagcgctccagagacgagctgatcgccttcctgcagaccttccccaaggatttccagaaaatacacttgctgccactagtctgacgagagccaccgcacgattttaatgcttcaagtgcataggctctgcattaatattctcatgacagtatacgcaagcgcaattttgtgacgagcgacatctacgaacctgtatcagaatattggcattgaagctgggcatgactggcttgactccacactctgttacagagcacaacaatttgacattgagaatatggattgta

SEQ ID NO: 12294 - DNA, 710 bp, Zea mays
  misc_feature: Ceres CLONE 1370085-F
  misc_feature: Encodes the peptide sequence at SEQ ID NO. 12295
  misc_feature (445)..(445): n is a, c, t, g, unknown, or other
  misc_feature (477)..(477): n is a, c, t, g, unknown, or other
  misc_feature (478)..(478): n is a, c, t, g, unknown, or other
agagctggagctccccgcggtggcggccgctctagaactagtggatcccccgggctgcaggaattcgcacgagaccattacctagaacatcctaatcgaaaatcctcttgctcataccgcaacgctctatctctttcgccgagctcctcgaaaccctaggagcgtgcttgaccggcggcggcgaggtgatgccgatggaccctgacgcggtagcgaaggccttcgtggagcattactaccgaacgttcgacaccaaccgcgcggcgctggttgggctgtaccaggagacctccatgctcaccttcgagggccagaagttccagggcccctccgccattgccggcaagctcggatctctccctttccagcctgcgagcatcagatcgtcaccgtagactgccagccatcgggtccccagggaggcatgctcgtcttcgtctccggntccatacgcaccggccccgaggagcacccatnncagtctccccagcatccatttgctgcccgccgctgggtccttctcgtgcagaatgacatggtccgcctgaactatgcttaagacacccgatactcttgtgatgaaggattgattagggtttccatgttgaacgatgaaaactaaggttgccgcaaccccgggcccctttggaaccccttggggggcgggttcccggataacaaaaatgggcaaacttgggatttttcggggt

SEQ ID NO: 12295 - protein, 66 aa, Zea mays
  misc_feature: Ceres CLONE 1370085-F
MDPDAVAKAFVEHYYRTFDTNRAALVGLYQETSMLTFEGQKFQGPSAIAGKLGSLPFQPASIRSSP

SEQ ID NO: 12296 - DNA, 700 bp, Zea mays
  misc_feature: Ceres CLONE 1370088-F
  misc_feature: Encodes the peptide sequence at SEQ ID NO. 12297
aagctggagctccccgcggtggcggccgctctagaactagtggatcccccgggctgcaggaattcgcacgagaccattacctagaacatcctaatcaaaaaacgatcacacaccactccacagcagtagcaagagggatagagcaaggccacacacacacacacacgagtagggtaggttagccttttaatcgtcgtcgagaagcaagaagggcgcgcacgcaagcagggaagcaagaagagagccgatcgaccgacagctagcacgcgatggcgaggtcttccaagatgatggtggcggcagctctgctggtcttgcgcctggccgtgtcgaccgccgaggcgaggaacatcaagaccacgacgacggacaataatgacgacgcggtgttgcagccgcaaaccttcccgcccttctaccgcctcggcggcggagcgatcccggagttcagcggactccccggtggtagtattcctgacagcagcattccaggcctcagcatgccctgaagcgccagcagcctacccgggttcagcttgccaggcagcgggagcatgcacctcttcggggaagactccctgggcttcatcggcttcggcggcatggtctggtcccccaccgtctggttccgtcccggagaacgccaacaagcccctgaacgtcaacaagcgtggtaagaacagtgtcgctactggtaccg

SEQ ID NO: 12297 - protein, 79 aa, Zea mays
  misc_feature: Ceres CLONE 1370088-F
MARSSKMMVAAALLVLRLAVSTAEARNIKTTTTDNNDDAVLQPQTFPPFYRLGGGAIPEFSGLPGGSIPDSSIPGLSMP

SEQ ID NO: 12298 - DNA, 697 bp, Zea mays
  misc_feature: Ceres CLONE 1370089-F
aaagctggagctccccgcggtggcggccgctctagaactagtggatcccccgggctgcaggaattcgcacgagaccattacctagaacatcctaatcgaaaaacccggtctccagaacagacaacccgtccttctccttcccatcgggtccacacaaccagaaggttcttcgcttcactctgccctgcgccgccgccaacgcatgcaccgcagctgccgcacgaggaaacttggacgtgctactcgcgactgctctcatctgttcccgcgtaggattcgttcacaatgcaccgtgtgtatgtcgacaacttggatgcacacgtgacttacggtgaaactctacatgagtgcaatgtgtgtggagtactgcgaactgtatgagtcgacgcatactcacctgattttgcatttatggattctgacgaccgtagggatgcaaaggatgcctattcgtgatctaaatggtaagaatggatgcaaattcaactatttcgaaccaccaatggcgtggttgcccggtacggactgggggatttggacaaaaggcttggaggtgggaaaaatggcccacttggcccgaaaaagccccccgcttttgccccgaaaaaaaaaaagggaaaatattcccccggaacggggggggggcccccccccaaaaaccccggggggggggtttaaaaaaggggaaaaacccccc

SEQ ID NO: 12299 - DNA, 690 bp, Zea mays
  misc_feature: Ceres CLONE 1370095-F
  misc_feature: Encodes the peptide sequence at SEQ ID NO. 12300
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (564)..(564): n is a, c, t, g, unknown, or other
  misc_feature (565)..(565): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (596)..(596): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
aaagctggagctccccgcggtggcggccgctctagaactagtggatcccccgggctgcaggaattcgcacgagaccattacctagaacatcctaatcaaaaacgcacctagggttttcgcgccgccgccgccgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttccttctgttttatcagtgtgtcagtttttctgtaagctagcaagtgttgctatgacgcttttattaaggatctggtgagcgggtgatgtaagagaaaatggcactactgtggtgtaccccagattcctgcaactttgctatgctagaaaaaccctttatcttataaaaatggaggggtgctttnnnnnnnnnnnnnnnnannaaaaaaaaaaaaaaaaaaannnnnnnnnnanaaaaaaaannnnnaaaaaaatttttttctcccccccccccccggggggggcccggaccacattcccccaagggggggtatacccccgccctccg

SEQ ID NO: 12300 - protein, 51 aa, Zea mays; identical to SEQ ID NO: 2355
  misc_feature: Ceres CLONE 1370095-F
  misc_feature (9)..(51): Pfam Name: Ribosomal_L39 Pfam Description: Ribosomal L39 protein

SEQ ID NO: 12301 - DNA, 687 bp, Zea mays
  misc_feature: Ceres CLONE 1370096-F
  misc_feature: Encodes the peptide sequence at SEQ ID NO. 12302
  misc_feature (526)..(526): n is a, c, t, g, unknown, or other
  misc_feature (546)..(546): n is a, c, t, g, unknown, or other
  misc_feature (658)..(658): n is a, c, t, g, unknown, or other
  misc_feature (661)..(661): n is a, c, t, g, unknown, or other
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcgaaaaaacaacaacaacaacccgcacaacggcacgattctcctcctccgtccgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctacgaggagacccgcggcgtgctcaagatcttcctcgagaacgtcatccgcgacgccgtcacctacaccgagcacgccccgccgcaagaccgtcaccgccatggatgtcgtctacgcgctcaagcggcagggccgcacgctctacggcttcggcggctaggccgcctccccttctgatgctttgatgggacggccgtggccgnttggggggctagttggcccnccaactgaagttgggtccggaacttcgttccgaagggttccagttcctaccccattgggggaaaaatttccctggaattatcaaaggaaagcccccgggtctatccccaaanaanaaanagaaacaaaaaagagcgcccga

SEQ ID NO: 12302 - protein, 109 aa, Zea mays
  misc_feature: Ceres CLONE 1370096-F
MSGRGKGGKGLGKGGAKRHRKVLRDNIQGITKPAIRRLARRGGVKRISGLIYEETRGVLKIFLENVIRDAVTYTEHAPPQDRHRHGCRLRAQAAGPHALRLRRLGRLPF

SEQ ID NO: 12303 - DNA, 689 bp, Zea mays
  misc_feature: Ceres CLONE 1370097-F
  misc_feature: Encodes the peptide sequence at SEQ ID NO. 12304
  misc_feature (675)..(675): n is a, c, t, g, unknown, or other
agagctggagctccccgcggtggcggccgctctagaactagtggatcccccgggctgcaggaattcgcacgagaccattacctagaacatcctaatcgaaaaacaacaccagaatccgcgaatcacagacgcgtctatctcagcttgctgcactgcactaccctgccctggcatcatatcgtacgtgagcccggccgagcgagagcgagggagaggtatggctgctcctaagctcgcgacgctggcgctgctcgcgctcctggcggcgaccggggtggctcccccagccgcgctgcgcgcggagatgtcgtgctccaccgtgtacagcacgctgatgccgtgcctgccgctcgtccatatggtcggagccatgccgccccagccgtgctgcggcgccacccgcagcctgctgcagcaggccaacaacacccccgaccgccgcaccatatgcggctgcctcaagaacgtcacctacggcgccaacgatagcggcacctacatcagccgcggcgccgcgctgcccaacaagtgagatgtccccctgacgtacagatcagcaccaacgttaactcgcacacgattaactaagtgatgaggtcgcctgagcgcgtcagagagagcaatgcatgcatggcgctgccagagaccaatagagaaatgctactggtatattanaggatatcgagggc

SEQ ID NO: 12304 - protein, 104 aa, Zea mays
  misc_feature: Ceres CLONE 1370097-F
MAAPKLATLALLALLAATGVAPPAALRAEMSCSTVYSTLMPCLPLVHMVGAMPPQPCCGATRSLLQQANNTPDRRTICGCLKNVTYGANDSGTYISRGAALPNK

SEQ ID NO: 12305 - DNA, 658 bp, Zea mays
  misc_feature: Ceres CLONE 1370099-F
  misc_feature: Translation starting site: 169
aagctggagctccccgcggtggcggccgctctagaactagtggatcccccgggctgcaggaattcgcacgagaccattacctagaacatcctaatcgaaaaaccctagcccagagcagccgcatctaactctacctgcctttctctcgtccctggcggcggcggcaggatggcggcttctactgcgaggacggtgaaggatgtgaacccccacgagtttgacaaggcctactccgcccatctcaaacgctccggcaagatggagcttcctgagtgggatgacattgagaagactgcgaggttcaaggagctccctccttatgaccctgactggtactacatcatggctgcatctgtagcaaggaacatctacttgagacgaggcattggtttggtggcttccagaagatttatggtggccgccagaggaatggctcacgcccacctcacttctgcaagagcagcggtgccatttcacgcaacatcctccagcagctgcaggagatgggcatcattgatgtctatcccaagggtggacggcgcatcacctcccagggaaggcgtgatctgcaccaggtgcctggaaggtctgctgatgaagcttgagcaatctcatatctggtttctatgatgtcatgtttgattgctgagatggctaa

SEQ ID NO: 12306 - DNA, 704 bp, Zea mays
  misc_feature: Ceres CLONE 1370102-F
  misc_feature: Encodes the peptide sequence at SEQ ID NO. 12307
  misc_feature (440)..(440): n is a, c, t, g, unknown, or other
agagctggagctccccgcggtggcggccgctctagaactagtggatcccccgggctgcaggaattcgcacgagaccattacctagaacatcctaatcgaaaaatccggcagtgacccctctaaagcaacagtgaggccgcaacctacctagctagagctatgactatatcactatcagggacctagacctagcaggagccacacccacgccgtacgtcggcatggctaggtggtcgtctccagctctggacgacggcctcgtgggcctggtcgcgcaggaggagtgatcagagatgcgccccgacaccgcgcaggactggcaggcgctacacgacgtgaagaggccggacacgctgaaccaggagacgaagctgatcccggtgatgtcccgctacgagatcggcatccactacatcccggacatcgagggggtgcgccanagggtcaccaccgtcacgcacggccagttcctcaccgtcgacgacgacatctagagtgccagccccggatgcgagggccccagccccatgatgtcgggcgcggccgctaccgtgacacttacccccgctggcgaagggggttgctccgtccatctgaatggacacgggcggccgccggccgggaatgaataaacctactagggaactttccggccggctacggaaagataggttgaccctaactgaggccggcttgcctgccgg

SEQ ID NO: 12307 - protein, 66 aa, Zea mays
  misc_feature: Ceres CLONE 1370102-F
  misc_feature (49)..(49): Xaa is any aa, unknown, or other
MRPDTAQDWQALHDVKRPDTLNQETKLIPVMSRYEIGIHYIPDIEGVRXRVTTVTHGQFLTVDDDI

SEQ ID NO: 12308 - DNA, 686 bp, Zea mays
  misc_feature: Ceres CLONE 1370103-F
  misc_feature: Encodes the peptide sequence at SEQ ID NO. 12309
aagctggagctccccgcggtggcggccgctctagaactagtggatcccccgggctgcaggaattcgcacgagaccattacctagaacatcctaatctaaaaaaacgagcaccgttgtttgcattgaaatggacgctgcaagatgaaggacggggcaccaactccctcgccgtcccgcgccgagctccaagcacaaccggaccaccagcaatagcaagccgccgatggggatcgcggactagtgccccagcgcgatgcgagcccacatggtggaggtgcccacggtgcgcgacgtgctgtcgtgcatatcggcgttcacacgacgagaacggcgcggagcgctgctgctgaacgtgaccggacaaatcacgtacgaggtgctccgggagccagcagcgatgccgctccgcgacaccagggagatactgagcctggacggatgcttcttcccgttcccggctccatccacgaagacgacgatgttcctgtcgagaccgcaacgcacagtactggccgctgacgtctcgctgagaggcctgatggccgcatgaccggtgctagtgatggaagccacgatatgatgagacggagctggacaggctgccgtcgagcaataatgctcgtgacaacgtgcatgccatggacaccaccgagcctactcctgttcctgagaaggatgttactaaa

SEQ ID NO: 12309 - protein, 98 aa, Zea mays
  misc_feature: Ceres CLONE 1370103-F
  misc_feature (1)..(99): Pfam Name: DUF296 Pfam Description: Domain of unknown function (DUF296)
MRAHMVEVPTVRDVLSCISAFTRRERRGALLLNVTGQITYEVLREPAAMPLRDTREILSLDGCFFPFPAPSTKTTMFLSRPQRTVLAADVSLRGLMAA

SEQ ID NO: 12310 - DNA, 689 bp, Zea mays
  misc_feature: Ceres CLONE 1370104-F
  misc_feature: Encodes the peptide sequence at SEQ ID NO. 12311
  misc_feature (415)..(415): n is a, c, t, g, unknown, or other
  misc_feature (421)..(421): n is a, c, t, g, unknown, or other
  misc_feature (444)..(444): n is a, c, t, g, unknown, or other
  misc_feature (503)..(503): n is a, c, t, g, unknown, or other
aagctggagctccccgcggtggcggccgctctagaactagtggatcccccgggctgcaggaattcgcacgagaccattacctagaacatcctaatcgaaaaaacagcgccactgatgagcctctgtcgtcgtcgtcatcagtgaaccaggcgaggcgacgatcggacccgggtcgtaagcggtaagcccaccggctcaacagcaggctgcagatccccccaccccccacgcaactccatctcctctccgcctccacctgcacccatcgagcaccgaacggcggcggcatggaggctggcggcgaggagttcgcgatcggcgtggtgatctccgcgaagaccaccctgggggaggagttcgagggccagatcgtcgccttcgaccgcccctccaacctcctcgttatccaggaggncgtggntaggggcggaaaggggggagcgnaggaacgtgagggtcctcaaagcgaactacatccggaagttctcggtggtcagaaagtngacgaccctctcgattctggcagttgcatgctggacctccactccattattgcccggaaggatgttgcctcgggcagcaaaaattgacctgaaaaattggggttggggtacccccgaattcaaagttttttatggcctgccaaaactttccggttaggggaaaaaattgactttccaaatgaaggg

SEQ ID NO: 12311 - protein, 100 aa, Zea mays
  misc_feature: Ceres CLONE 1370104-F
  misc_feature (43)..(43): Xaa is any aa, unknown, or other
  misc_feature (45)..(45): Xaa is any aa, unknown, or other
  misc_feature (53)..(53): Xaa is any aa, unknown, or other
MEAGGEEFAIGVVISAKTTLGEEFEGQIVAFDRPSNLLVIQEXVXRGGKGGAXEREGPQSELHPEVLGGQKVDDPLDSGSCMLDLHSIIARKDVASGSKN

SEQ ID NO: 12312 - DNA, 690 bp, Zea mays
  misc_feature: Ceres CLONE 1370105-F
  misc_feature: Encodes the peptide sequence at SEQ ID NO. 12313
cagagctggagctccccgcggtggcggccgctctagaactagtggatcccccgggctgcaggaattcgcacgagaccattacctagaacatcctaatcgaaaaaaaaggtacacatcatctcttccaaataccaccagcaaatccccaattcctccgagttcgagcgaccatgtcgggtcgcggcaagggcggcaaggatctggtcaaaggcggcgcctagcgtcaccgcaaggttctccgcgacaacatccagggcatcactaagccggatatcctgagcctggccatgaggggcggcgtgaagcgcatctcgcgcctcatctacgaggagacccgcgacgtgctcaagatcttcctcgagaacgtcatccgcgacggcggaacctacacggagcacgcccggcgcaagaccggcaccgccatggatggcgtctacgccctccggcgacagggtcccaccctctaacgattcgaggaatgaaaggctctaccccccgcggggggaacatgcaaaaagacttgcgcccgcgacaaggaatcccaaaatattcctgcaatgacggggcttaacttcccaatagttataacccctaagcgctttataggtaacccggaaggttcctgtcccaaccacctttaaagcccagtggccaaaccgagcaaaaatgagaataccccgcgcttttccc

SEQ ID NO: 12313 - protein, 59 aa, Zea mays
  misc_feature: Ceres CLONE 1370105-F
MRGGVKRISRLIYEETRDVLKIFLENVIRDGGTYTEHARRKTGTAMDGVYALRRQGPTL

SEQ ID NO: 12314 - DNA, 690 bp, Zea mays
  misc_feature: Ceres CLONE 1370109-F
  misc_feature: Encodes the peptide sequence at SEQ ID NO. 12315
  misc_feature (386)..(386): n is a, c, t, g, unknown, or other
  misc_feature (390)..(390): n is a, c, t, g, unknown, or other
  misc_feature (632)..(632): n is a, c, t, g, unknown, or other
  misc_feature (640)..(640): n is a, c, t, g, unknown, or other
  misc_feature (642)..(642): n is a, c, t, g, unknown, or other
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaaatccctacggagggccagtcgacctctctgctcgcgaaaaatggcggcggcagcggaaggtttggctgcctacagggcggtgctgcgggcggcgcggcggacgttcgcgggcgaccagctgatgctgaaggagtctgcggtggagatccggcgccgctttgaggaccaccgtggtctaaccccgggctccgacgatgcagcgcgtgccctcgccgacgcccgcgaggcggcgcacttcatcacccatatgatagtcccaggcacacgcgcaccctccggatccntcgntgtgaaagccctgagagtgtcatgctggagctacactggaagttccttccggaggagaccttttcaaaagtgaagtagggcactagcattgctgaagtaggtcacaatctgcatgctaataaaatagacccatttgcaacgggtgattctggggtggcaacgggttcactaagaacctcccccctttggcctttattatataataataataataataataataataataataataattatantattattntnntttttaaaaaaaaaaaaaaagttttcccacccgccccccccgagggg

SEQ ID NO: 12315 - protein, 106 aa, Zea mays
  misc_feature: Ceres CLONE 1370109-F
  misc_feature (2)..(69): Pfam Name: Complex1_LYR Pfam Description: Complex 1 protein (LYR family)
  misc_feature (82)..(82): Xaa is any aa, unknown, or other
  misc_feature (83)..(83): Xaa is any aa, unknown, or other
MAAAAEGLAAYRAVLRAARRTFAGDQLMLKESAVEIRRRFEDHRGLTPGSDDAARALADAREAAHFITHMIVPGTRAPSGSXXVKALRVSCWSYTGSSFRRRPFQK

SEQ ID NO: 12316 - DNA, 687 bp, Zea mays
  misc_feature: Ceres CLONE 1370113-F
  misc_feature: Encodes the peptide sequence at SEQ ID NO. 12317
  misc_feature (456)..(456): n is a, c, t, g, unknown, or other
  misc_feature (474)..(474): n is a, c, t, g, unknown, or other
  misc_feature (576)..(576): n is a, c, t, g, unknown, or other
agagctggagctccccgcggtggcggccgctctagaactagtggatcccccgggctgcaggaattcgcacgagaccattacctagaacatcctaatcaaaaagactcgatacggcaagatcgacagagagaccgacgcgccggcagatcccaagctcaccggagagggggaagagggcgaccgaaggcggcgatgggtttcatcatggacttcgcggagaatctgatcctccgtctgatggaggacccggacaagcgcgaccaggttcggcgggagcatgtctacaagatgaaggagcggtgcgagcgcactaaggcggcgtggagcctccctctgcgcccctacggcttctggaccttcgaccgcttcaactcgcagctctcctgggatccccagatcagccaggccgccggccgtcgggacccctacgacgacctcatcgccccgcactctggntcgccgccgtcttcctgnaacaccgtccgatctttgcccagaagtctactggggcatcaataagaaactcttcccccctcaactgatgggggtcccatccttctctggctgaaaaatggngtcaccaaactaccctatttccttgttcagtttggcatggaagaaaaattggggacttccattcccaaggggggcctttgaataaggaaagttcccaaaatccgcagtttt

SEQ ID NO: 12317 - protein, 108 aa, Zea mays
  misc_feature: Ceres CLONE 1370113-F
  misc_feature (94)..(94): Xaa is any aa, unknown, or other
MGFIMDFAENLILRLMEDPDKRDQVRREHVYKMKERCERTKAAWSLPLRPYGFWTFDRFNSQLSWDPQISQAAGRRDPYDDLIAPHSGSPPSSXNTVRSLPRSLLGHQ

SEQ ID NO: 12318 - DNA, 703 bp, Zea mays
  misc_feature: Ceres CLONE 1370114-F
  misc_feature: Translation starting site: 157
  misc_feature (460)..(460): n is a, c, t, g, unknown, or other
agagctggagctccccgcggtggcggccgctctagaactagtggatcccccgggctgcaggaattcgcacgagaccattacctagaacatcctaatcgaaaatagcctctatctcattccactccgacattcacgtgcagctgtcgggagcaggcaatggcgccggatctaagcgaactcgccgccgccgctccagcccgtggcgcctacctcgccggcgtcggtgtcgcggtcctcctcgctgcctccttcctccagtagccgagtcgtcctgcgtgcgagataactcattggtgagagacataagccaaatgccgcaaagcagctatgggattgaagggatgtcacatataacagttgctggtgcgctcaatcatgggatgaaggaggtggaagtgtgccttcagacaataagtccaggtcaaaggacgccaatcaacaggcattcctgtgaaggaangtttccctgtccctcaaggggagggcaccctcttgatgggatcaagttccctaaagaaccgaggggatccccgggaattccctttctttcaaaaaccccattttcaatcccccggaaagggcccccccccggtttggaattttgacccaccccaaaatttggaaagtttttgggataattaggaaacccccgcgggaaaaaatttttaaagaggggggggggaccgccctcaaccccccgggg

SEQ ID NO: 12319 - DNA, 694 bp, Zea mays
  misc_feature: Ceres CLONE 1370116-F
  misc_feature: Encodes the peptide sequence at SEQ ID NO. 12320
  misc_feature (654)..(654): n is a, c, t, g, unknown, or other
aaagctggagctccccgcggtggcggccgctctagaactagtggatcccccgggctgcaggaattcgcacgagaccattacctagaacatcctaatcgaaaaattttcatcagcagcattacccatcgctcgccaacgtgcagactaaggaagcactgaccggccggtcatggcgaggatccacctctacgtcgtcgccgcggcctgcgccgtcgccctcgcgctcgccggcgacccggacatgctccaggacgtctgcgtggctgactacgcttccccggtcaagctgaacgggttcccgtgcaaggcgaacatctcggcggacgacttcttcttcgacgggctgaggagcccgggcaacaccaacaacccggcgggctccgcggtgacggcggccaacgtggacaagttcccgggggtgaacacgctgggcgtctccatggcgcgcatcgactacgcgccgggcggccagaacccgccgcacacgcacccgcgcgccaccgagatcatcttcgtcctcgagggcacgctcgaggtcggcttcctcaccaccgccaacaggctcctcagcaagaccgtcgccacgggggacgtcttcgtcttcccccgcggcctcgtccacttccagcagaacagggggcacggccccgccgncgtcgtcgccgcctttcacagccagctccagggcacgcag

SEQ ID NO: 12320 - protein, 175 aa, Zea mays
  misc_feature: Ceres CLONE 1370116-F
  misc_feature (57)..(175): Pfam Name: Cupin_1 Pfam Description: Cupin
  misc_feature (92)..(167): Pfam Name: Cupin_2 Pfam Description: Cupin domain
  misc_feature: SWISSPROT Homolog: EC 1.15.1.1 Superoxide dismutase
  misc_feature (162)..(162): Xaa is any aa, unknown, or other
MARIHLYVVAAACAVALALAGDPDMLQDVCVADYASPVKLNGFPCKANISADDFFFDGLRSPGNTNNPAGSAVTAANVDKFPGVNTLGVSMARIDYAPGGQNPPHTHPRATEIIFVLEGTLEVGFLTTANRLLSKTVATGDVFVFPRGLVHFQQNRGHGPAXVVAAFHSQLQGTQ

SEQ ID NO: 12321 - DNA, 712 bp, Zea mays
  misc_feature: Ceres CLONE 1370119-F
  misc_feature: Encodes the peptide sequence at SEQ ID NO. 12322
aagctggagctccccgcggtggcggccgctctagaactagtggatcccccgggctgcaggaattcgcacgagaccattacctagaacatcctaatcgaaaaattcgtcttgctccagccgccgtcggatcggatccgatccaaagcaagcagaagcagccggctcctcctccgcctcccgcagcagccacaccccgtccgtcaccagaggaagaggaggaggatgtcggcatcgaaggtgcacacccttgaggaggtggccaagcacaacaccagagacgactgctggctcgtcatcggcggcaaggcgtacaatgtgaccaagtttctggaggaccaccctgggaggtgatgatgtcctgctgtcttccactgccaaggatgctaccgatgatttcaaagatgtggcggacagcaccccccccccgtgcaatggatggaccaataccctcgcggcgaaattgatgcggccaccataccccagtaaaggggaagtacaccgcccccaagcaagccgcactacaaccccggataaaaaccccggagttcgccatccaaagacctcccatgtttttggcccccccctggccaaaactgggcccctggcctgttgcctggtagggacctacacccaagccgggaaactcgcctaaaaaatctgaaccccagtgaggcggggggtggccaccttgggcccccaagaaccaagggcc

SEQ ID NO: 12322 - protein, 42 aa, Zea mays
  misc_feature: Ceres CLONE 1370119-F
  misc_feature: SWISSPROT Homolog: EC 1.7.1.1 Nitrate reductase (NADH)
MSASKVHTLEEVAKHNTRDDCWLVIGGKAYNVTKFLEDHPGR

SEQ ID NO: 12323 - DNA, 729 bp, Zea mays
  misc_feature: Ceres CLONE 1370124-F
  misc_feature: Encodes the peptide sequence at SEQ ID NO. 12324
  misc_feature (441)..(441): n is a, c, t, g, unknown, or other
aaagctggagctccccgcggtggcggccgctctagaactagtggatcccccgggctgcaggaattcgcacgagaccattacctagaacatcctaatcgaaaaattcgcggtttgcctctctgccttccctacctcagatcctccctcagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagtttctcaacctgatggcacgcaagatgaaggacacagactctgaggaggagctcaaggaggccttccgcgtgttcgacaggnaccagaacggcttcatctctgctgctgaacttcgacatgtcatgaccaacctagggtgaaaaactgaccgacgaggaggtggatgagatgatcccggaaagccgacgtgggacgtggatggccaaatccactaccaaggagttccctgaaagtcgatgatggccaaaggaaaatgatgggccttggttttaaaactaacgtccctctcctggagggaagaacctagccccaagggttgaaaaactgactggattttggtccccgccttgggtccctcccccggggaaa

SEQ ID NO: 12324 - protein, 114 aa, Zea mays
  misc_feature: Ceres CLONE 1370124-F
  misc_feature (12)..(40): Pfam Name: efhand Pfam Description: EF hand
  misc_feature (48)..(76): Pfam Name: efhand Pfam Description: EF hand
  misc_feature (85)..(113): Pfam Name: efhand Pfam Description: EF hand
  misc_feature: SWISSPROT Homolog: EC 2.7.11.1 Non-specific serine/threonine protein kinase
  misc_feature (96)..(96): Xaa is any aa, unknown, or other
MADQLTDDQIAEFKEAFSLFDKDGDGCITTKELGTVMRSLGQNPTEAELQDMINEVDADGNGTIDFPEFLNLMARKMKDTDSEEELKEAFRVFDRXQNGFISAAELRHVMTNLG

SEQ ID NO: 12325 - DNA, 724 bp, Zea mays
  misc_feature: Ceres CLONE 1370127-F
  misc_feature: Encodes the peptide sequence at SEQ ID NO. 12326
  misc_feature (310)..(310): n is a, c, t, g, unknown, or other
  misc_feature (414)..(414): n is a, c, t, g, unknown, or other
  misc_feature (425)..(425): n is a, c, t, g, unknown, or other
cagagctggagctccccgcggtggcggccgctctagaactagtggatcccccgggctgcaggaattcgcacgagaccattacctagaacatcctaatcaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagntccagatcatcctcgatcgggagacgcagaggtcccgcggcttcggcttcgtcaccttctccacggaggaggcgatgcggaacgccatcgagggcatgaacggncaggagctggnacggcgcaacatcaccgtcaacgaggcccagtccccgcggcggccgtggaggggcgcgccgtgggtacggtgttggccggtggaggcggcgggctacggcggtggccgggcccccttgattgccggtggcggttacggggggggggggggggttaggggggggggggggggttacgggggggggggggggggggtaaggggggggggaaaccgggggggggggttaacgtcaatttccacaggggaattgggggaaattgggcggggggggcccccgcggggcaaatttttcttggttt

SEQ ID NO: 12326 - protein, 174 aa, Zea mays
  misc_feature: Ceres CLONE 1370127-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (37)..(37): Xaa is any aa, unknown, or other
  misc_feature (75)..(75): Xaa is any aa, unknown, or other
MAASDVEYRCFVGGLAWATDDHSLHNAFSTYGEVLEXQIILDRETQRSRGFGFVTFSTEEAMRNAIEGMNGQELXRRNITVNEAQSPRRPWRGAPWVRCWPVEAAGYGGGRAPLIAGGGYGGGGGVRGGGGGYGGGGGGVRGGGNRGGGLTSISTGELGEIGRGGPPRGKFFLV

SEQ ID NO: 12327 - DNA, 717 bp, Zea mays
  misc_feature: Ceres CLONE 1370133-F
  misc_feature: Translation starting site: 411
  misc_feature: Pfam Name: dCMP_cyt_deam_1 Pfam Description: Cytidine and deoxycytidylate deaminase zinc-binding region
  misc_feature: SWISSPROT Homolog: EC 3.5.4.3 Guanine deaminase
  misc_feature (546)..(546): n is a, c, t, g, unknown, or other
agagctggagctccccgcggtggcggccgctctagaactagtggatcccccgggctgcaggaattcgcacgagaccattacctagaacatcctaatcgaaaagatcggcgggagagcacgagacgcccctctgcttccttttctctgtcgctcaaaagttgctggagccctcttctctctctcctctccgagccccaaccattgatgaggcgcaagttgtggagtcaaaggatggaaccatctcagttgcttctgcatttgttgctcatcaggaagctgtacaagacagggatcacaaattcttgacaaaagcagtggaagaagcataccgaggagtcgattgcggcgatggaggtccatttggagcagttgtcgtccgtaatgatgaagtggttgttagctgccataacatggttctgaagcacactgaccctactgcgcatgctgaagtaactgcaattagagagcttgcaaaaggctcgggaaaatcgagctctctgactgcgaaatttacgcgtcctggaaagcatgcccaatgtgctttgnagcagttcatctctcccgaatcaaaaggctggtttattggggcaagggggaggcctgcatcccccttggggttggaaaacttatttgaaaatgctctgaaaaggactgggttcaaccaaaaagccccacttggatatcaaaaagcccacccgtatgggccctttaacccca

SEQ ID NO: 12328 - DNA, 703 bp, Zea mays
  misc_feature: Ceres CLONE 1370134-F
  misc_feature: Encodes the peptide sequence at SEQ ID NO. 12329
  misc_feature (1)..(1): n is a, c, t, g, unknown, or other
  misc_feature (305)..(305): n is a, c, t, g, unknown, or other
  misc_feature (400)..(400): n is a, c, t, g, unknown, or other
  misc_feature (411)..(411): n is a, c, t, g, unknown, or other
naaagctggagctccccgcggtggcggccgctctagaactagtggatcccccgggctgcaggaattcgcacgagaccattacctagaacatcctaatcgaaaaatcacaattcacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggncggatcgggcgctacctcaagaaggggcggtacgcgcagcgcgtgggcaccggcgcccccgtctatctcgcccgcgtgcttgagtacctcgccgnccgagtgctgnagctggcccggaaacgcggcgaaggacacaagaagacgcgcatcgtcccgcgacacttgctcctggcgattcgtaacgaacgtgacctcggaaagctgttgcctggggcaccatcgcgcaggggggtgtcctccccaaattaacccggtttccctggccaaaaagggggggaaaaaggcccaagggcggcaaaaggaaaacaaaccccccaaaaaaggcccccaagcccccaagaaagggccccaaccccccaaaaaaggttaaaaaaatgccccttcccaaggccccgggg

SEQ ID NO: 12329 - protein, 122 aa, Zea mays
  misc_feature: Ceres CLONE 1370134-F
  misc_feature (29)..(102): Pfam Name: Histone Pfam Description: Core histone H2A/H2B/H3/H4
  misc_feature (72)..(72): Xaa is any aa, unknown, or other
  misc_feature (76)..(76): Xaa is any aa, unknown, or other
MDASGAGSKAKKGAAGRKAGGPRKKSVSRSVKAGLQFPVGRIGRYLKKGRYAQRVGTGAPVYLARVLEYLAXRVLXLARKRGEGHKKTRIVPRHLLLAIRNERDLGKLLPGAPSRRGVSSPN

SEQ ID NO: 12330 - DNA, 690 bp, Zea mays
  misc_feature: Ceres CLONE 1370135-F
  misc_feature: Encodes the peptide sequence at SEQ ID NO. 12331
  misc_feature (365)..(365): n is a, c, t, g, unknown, or other
  misc_feature (376)..(376): n is a, c, t, g, unknown, or other
  misc_feature (377)..(377): n is a, c, t, g, unknown, or other
  misc_feature (411)..(411): n is a, c, t, g, unknown, or other
  misc_feature (511)..(511): n is a, c, t, g, unknown, or other
aaagctggagctccccgcggtggcggccgctctagaactagtggatcccccgggctgcaggaattcgcacgagaccattacctagaacatcctaatcaaaaaaatttatctctcgtgcctcgttgcgtttttgtcgagtctaaccctagcgcgcgccgccacacctgccgttgctaccgccccgtacctcgcttgctttcccgtcgccgaaatgacgaagcgcaccaagaaggctggaattgttggcaaatatggaaccaggtatggcgctagcttgcgtaagcaaatcaagaagatggaggtatctcagcactccaagtacttctgcgagttttgtgggaagtttgctgtgaagaagaaagcangtggaatttgnnggatgcaggactgtgggaaaggtcaggctggcgntgcttacaccatgaacactgctagtgcagtcactgtcaggagcacgattcgtcgcttgagagagcagactgaagcatgatttagcttgctacatcagggntcctctaattgctgttgtccggaaatgtgagctcctctaagtggatcacaaactccgctaaaagtgggggctaaaatttgaaattggttaccgtttgcgattttcccaaggaaattaccctaggcttgcccccaaaaaaaaaaaaaaaaaggttttcaaaacgcccaacctccgagggg

SEQ ID NO: 12331 - protein, 92 aa, Zea mays
  misc_feature: Ceres CLONE 1370135-F
  misc_feature (2)..(91): Pfam Name: Ribosomal_L37ae Pfam Description: Ribosomal L37ae protein family
  misc_feature (52)..(52): Xaa is any aa, unknown, or other
  misc_feature (55)..(55): Xaa is any aa, unknown, or other
  misc_feature (56)..(56): Xaa is any aa, unknown, or other
  misc_feature (67)..(67): Xaa is any aa, unknown, or other
MTKRTKKAGIVGKYGTRYGASLRKQIKKMEVSQHSKYFCEFCGKFAVKKKAXGIXXMQDCGKGQAGXAYTMNTASAVTVRSTIRRLREQTEA

SEQ ID NO: 12332 - DNA, 675 bp, Zea mays
  misc_feature: Ceres CLONE 1370137-F
  misc_feature: Encodes the peptide sequence at SEQ ID NO. 12333
  misc_feature (479)..(479): n is a, c, t, g, unknown, or other
  misc_feature (497)..(497): n is a, c, t, g, unknown, or other
  misc_feature (527)..(527): n is a, c, t, g, unknown, or other
aagctggagctccccgcggtggcggccgctctagaactagtggatcccccgggctgcaggaattcgcacgagaccattacctagaacatcctaatcgaaaaatagctctagggctgaaaccagcaaagccaacagaactgcacagtgtagtagttgcacataggcgtccgcgcgtcgtcctagctatggatccatatcactaccaaaccatgtatgacccacgcggcttccccatcatccacccgcagccttacctccagcacccggtggccggcgccctcggtgacagcagggtgcgcggcggcggcagtggcgcgcggcggcgtcctggcgccaagctctccacggacccgcagagcgttgcggcgcgcgagcggcggcaccgcatcagcgaccgcttccgcgtgctccgcagcctcgtccccggcggcagcaagatggacactgtgtccatgctcgagcaggccatccactacgtncagttcctcaagacgcanatcagcctgcatcaggccgcgctgatgcancacgaggaaagatgccatgctgagctcgccgcctattccgcggtggcggtggtggtgaacaccaagtgacactcccgtcccatggtcgaaccgcgcatgcaacgaaatgatgcacctcccggtgccggcgaagaaactttgagttttg

SEQ ID NO: 12333 - protein, 136 aa, Zea mays
  misc_feature: Ceres CLONE 1370137-F
  misc_feature (55)..(102): Pfam Name: HLH Pfam Description: Helix-loop-helix DNA-binding domain
  misc_feature (104)..(104): Xaa is any aa, unknown, or other
  misc_feature (114)..(114): Xaa is any aa, unknown, or other
MDPYHYQTMYDPRGFPIIHPQPYLQHPVAGALGDSRVRGGGSGARRRPGAKLSTDPQSVAARERRHRISDRFRVLRSLVPGGSKMDTVSMLEQAIHYVQFLKTXISLHQAALMXHEERCHAELAAYSAVAVVVNTK

SEQ ID NO: 12334 - DNA, 462 bp, Zea mays
  misc_feature: Ceres CLONE 1370138-F
aaagctggagctccccgcggtggcggccgctctagaactagtggatcccccgggctgcaggaattcgcacgagaccattacctagaacatcctaatcgaaaactgattacgaacccgtcctctgtccgtcctaccaccacagctcaccgcggtttggctttctcccctcttccgcaccgcttctcgctccggattccggattccctctgctctttccctaacgaagggtagccatggcgggggagaggtaaagggaatcggttcaggggccccccaaaaaagccccccccggggggccccagggggggccccccacccccccggggaaaaaaacccaggttccccccagggggggaaaaaatttttcaaaaaaaaccccgcggcggccccccccttaataaaacccggggggggggggggagaaaaaatttttgtgggggggggggggtattttaataacca

SEQ ID NO: 12335 - DNA, 695 bp, Zea mays
  misc_feature: Ceres CLONE 1370139-F
  misc_feature: Encodes the peptide sequence at SEQ ID NO. 12336
aaagctggagctccccgcggtggcggccgctctagaactagtggatcccccgggctgcaggaattcgcacgagaccattacctagaacatcctaatcgaaaaaatccaacaagcaaacctgcagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagccccttgaaatgaatgaaccatgcaggcgctgagcgagtctatacgtacgtcgtcaccggctggccacg

SEQ ID NO: 12336 - protein, 149 aa, Zea mays
  misc_feature: Ceres CLONE 1370139-F
MKSRSMASSAALLVLALALVAATAPQVAEAKKKRAAESGEAAEAKKIQDDFCSTLCEGKKGTDLVVCKESCALSQQSNLVLYGRIQCKGKCTEQKGITAPAMKVCQEECDKAYVVKAAEVTKACSVTCAKEKNPRLSENCKRSCTPPPS

SEQ ID NO: 12337 - DNA, 732 bp, Zea mays
  misc_feature: Ceres CLONE 1370140-F
  misc_feature: Encodes the peptide sequence at SEQ ID NO. 12338
  misc_feature (483)..(483): n is a, c, t, g, unknown, or other
agagctggagctccccgcggtggcggccgctctagaactagtggatcccccgggctgcaggaattcgcacgagaccattacctagaacatcctaatcgaaaaaacccttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcattttgtgtctttacttcaaaaatacattcagaatctcactgctgggtnggagccagagaaagcggaatgagttccaaaagggtggtcaaggggtgcacccaagtttcctccttaacaaagttgaaggaccctccaatttttttgtgggggagaccctgaaaggaggaagcgctctgggggattccccctattcaagagggggggcgccaataaccgaatttcccccttttctccccagggccttaaggaaaaaagggggtagggggcggggaaaaatattaccccccggtggggacc

SEQ ID NO: 12338 - protein, 137 aa, Zea mays
  misc_feature: Ceres CLONE 1370140-F
  misc_feature (1)..(138): Pfam Name: TCTP Pfam Description: Translationally controlled tumour protein
MLVYQDLLSGDELLSDSFTYKELENGVLWEVEGKWVTQGPVDVDIGANPSAEGGEDESVDDTAVKVVDIVDTFRLQEQPPFDKKSFCVFTSKIHSESHCWVGARESGMSSKRVVKGCTQVSSLTKLKDPPIFLWGRP

SEQ ID NO: 12339 - DNA, 690 bp, Zea mays
  misc_feature: Ceres CLONE 1370142-F
aagctggagctccccgcggtggcggccgctctagaactagtggatcccccgggctgcaggaattcgcacgagaccattacctagaacatcctaatcgaaaaaactatatgagtctgagatcacccaccgaggcccgtcaatcagggttcttgtgcttgtgatctgctactgcagtggcgagcacctcaccttcttctccaactctctgccatcgtccacgcaggaagcaggaactggatgctccttccatctcttcgtgccatcctgcagcttattacacctccgacctgctagagagtagcactcagccgagtcggtcacgcccatcaacgcttgcctacccacccggtgtaggagatcccgatccacggtaccagctccccgccgatgcgtgatctagattttctacgctggcccggtccgaggagttccacctggacacgaaggctgaagacacgtgacacgaggcgatcggatcgcgtacgatctgcgcatacgattcggtagccggacagttcacctgctgcacttgcaactgcggcacggtaggacacatctgccgatgctgcgagaactgcgtgcgcgttgctcattgatcaagagtactatcgctacggcgggaaacgtcttcaaagaagttctacgatgctaaacttcgacgagagtttcactatgccagagtgtctaggc

SEQ ID NO: 12340 - DNA, 676 bp, Zea mays
  misc_feature: Ceres CLONE 1370146-F
  misc_feature: Encodes the peptide sequence at SEQ ID NO. 12341
aaagctggagctccccgcggtggcggccgctctagaactagtggatcccccgggctgcaggaattcgcacgagaccattacctagaacatcctaatcaaaaaatccatcacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcagcgacggtgagctgcggcgaggtgacgtcatcggtggcgccgtgcctcgggtacgcgatgggcagcgcggcgtcaccctccgcggcgtgctgcagcggggtgcgctcgctcaacagccgcgcgtcgtcgacggcggaccggcaggccacctgcaactgcctcaagagcatgacgggccgactcggcggcggcgtcagcatggccaacgccgccaacatccccggcaagtgcggcgtctccgtcggcgtgcccatcagccccaccgtcgactgcaccaagatcaactgatcgatgtaaccatagtgcaggtagctcgctcgatggatgacagcgtacgtgtccatcagcagcatgcagtcgtcgacgtagcagagatgtcctagcta

SEQ ID NO: 12341 - protein, 129 aa, Zea mays
  misc_feature: Ceres CLONE 1370146-F
  misc_feature (39)..(125): Pfam Name: Tryp_alpha_amyl Pfam Description: Protease inhibitor/seed storage/LTP family
MAARSSSSQPQLVAAAAVLAAALLLLAAGAGTASATVSCGEVTSSVAPCLGYAMGSAASPSAACCSGVRSLNSRASSTADRQATCNCLKSMTGRLGGGVSMANAANIPGKCGVSVGVPISPTVDCTKIN

SEQ ID NO: 12342 - DNA, 776 bp, Zea mays
  misc_feature: Ceres CLONE 1370147-F
  misc_feature: SWISSPROT Homolog: EC 5.2.1.8 Peptidylprolyl isomerase
agagctggagctccccgcggtggcggccgctctataactagtggatcccccgggctgcaggaattcgcacgagaccattacctagaacatcctaatcgaaaagctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgagccacggacgaccactccctccacaacgccttcagcacctacggcgaggtcctcgagtccaagatcatcctcgatcgggagacgcagaggccccggggcttcgggtttcgtcacctttctccacggaggaggggatggcggaacgccatcgaagggcatggaccggcaagggaattgggacgggccggaaaattccccgttaaacgaaggcccagtctccccgggcgccccgtggaaaggccgcgggccgggggggtaacccgtggggggggcccgtgggagtggggcggggctatcgggggggggggggggcaccctttgatggggggggggggggttttccaagggtgggggggggggggttttaagggggcggcgcgcgccacaaccgagtggggggggagggggccataagggggggggaacaccgggggggggggttagggactcccacaaagaaattgtgggaaactgttggcgtggggccccccgaggaaaaaaaaccttgggcaaccacgcgtttatt

SEQ ID NO: 12343 - DNA, 729 bp, Zea mays
  misc_feature: Ceres CLONE 1370148-F
  misc_feature: Encodes the peptide sequence at SEQ ID NO. 12344
agagctggagctccccgcggtggcggccgctctagaactagtggatcccccgggctgcaggaattcgcacgagaccattacctagaacatcctaatcgaaaaaacccgcatcccacatcacttattcacagctcgaagccgtattcctgtctcgaatcctctctcgccgctccgatggaccgcacgaagcaaacagcaaggaagtcgaccggcggcaaggccccccggaagcagctggacactatggctgcgcgcaagtcggccccggacaccggaggagtgaagaagccacaccgcttccgccccggtaccgacgcgctccgcgagatccgaagtaccagaagaggactgacctgctcatgcggaagttccccataccagcgcctcgtccgcgagatctggcagggctttcaaaatggatctgaggttcccagcccttcgcccgcaaagttgctgcaagaggccccccaaggcgtacctgggggggagtctttcgaggaacccaacttttgggccaatccggccaaggcctttcgttttcctgcccaagaaattcaatttggcccggctcatccggggccaatggcttttgagcccccaaggggtcccccggctcgaaagggccccaaaagaagaggggggaattccctttcggcgcttcttatcccgggcaaggaaaaggcttaaagggaatggtttcaaggcgaggcccgggaaaagcacccttcc

SEQ ID NO: 12344 - protein, 170 aa, Zea mays
  misc_feature: Ceres CLONE 1370148-F
MDRTKQTARKSTGGKAPRKQLDTMAARKSAPDTGGVKKPHRFRPGTDALREIRSTRRGLTCSCGSSPYQRLVREIWQGFQNGSEVPSPSPAKLLQEAPQGVPGGESFEEPNFWANPAKAFRFPAQEIQFGPAHPGPMAFEPPRGPPARKGPKRRGGNSLSALLIPGKEKA

SEQ ID NO: 12345 - DNA, 697 bp, Zea mays
  misc_feature: Ceres CLONE 1370149-F
  misc_feature: Translation starting site: 166
  misc_feature (412)..(412): n is a, c, t, g, unknown, or other
  misc_feature (413)..(413): n is a, c, t, g, unknown, or other
  misc_feature (419)..(419): n is a, c, t, g, unknown, or other
  misc_feature (431)..(431): n is a, c, t, g, unknown, or other
caaagctggagctccccgcggtggcggccgctctagaactagtggatcccccgggctgcaggaattcgcacgagaccattacctagaacatcctaatcgaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacgacggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcgnngctgtncgcggaccccgnagacgtcgccaagaaccgggagctggaggtcatccactccccgctggccatgctgggcgcgttgggctgcgtggtccccggagctgctcgcccgcaacggggtcaagttcggggaggccgggggggtccaagcccggtccgaaaaactccagcgaagggggggttggaactacctcggaaacccgagcctgaatccacgggaaaaaaccctctccatctggccctgcccgggtcgggcctcaggggcccccttcagggggacccgc

SEQ ID NO: 12346 - DNA, 685 bp, Zea mays
  misc_feature: Ceres CLONE 1370150-F
  misc_feature: Encodes the peptide sequence at SEQ ID NO. 12347
aaagctggagctccccgcggtggcggccgctctagaactagtggatcccccgggctgcaggaattcgcacgagaccattacctagaacatcctaatcaaaaaaactacggtaactcgtctgctcgcattgcctcccaatccatcccgactgcaaagccgaactccaagtcctcccggatcgatggcgcccaagggcgaaaaaaagcccgcagcgaacaagccgccggaggaggagcccgcggccgagaaggccccggccggaaagaagcccaaggcggagacaggtgccccagcgaactagtccgccgacaagcaggacggtgagggaaagacgggccgaaagaagggcaagaagagcgtggagacttacaagatctacattttcaaggtgctgaagcaagtgcacccggacatcgggattccctccaaggacatgtccatcatgaactccttcatcaacgacatcttctagaagctcgctgccgaggccgccaagctcgcgcggtactactaggaaaccaccatcacctcccgcgagatccagacttccgtgcgcctcgtcctccccggggagctcgccaagcaccccgtctccgagggcaccaaggccggcaccaagttcacctcgtcctaggctgggcagcctccaggtgcaggcttctcccataatgtcccgccgtcttgc

SEQ ID NO: 12347 - protein, 39 aa, Zea mays
  misc_feature: Ceres CLONE 1370150-F
MAPKGEKKPAANKPPEEEPAAEKAPAGKKPKAETGAPAN

SEQ ID NO: 12348 - DNA, 672 bp, Zea mays
  misc_feature: Ceres CLONE 1370185-F
  misc_feature: Encodes the peptide sequence at SEQ ID NO. 12349
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (535)..(535): n is a, c, t, g, unknown, or other
  misc_feature (540)..(540): n is a, c, t, g, unknown, or other
  misc_feature (609)..(609): n is a, c, t, g, unknown, or other
  misc_feature (651)..(651): n is a, c, t, g, unknown, or other
caaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactacccccggcgtggcccggcaacggcgcgacgttctaacttcctggtgttcccatcctggcccnnncttgntgggncgcggcgtcccagcttggcgggcgtgcaccacgtgcgcgcctggcgccacgacagcctggccaccaaancgccgcgtcgtcgctcatcgcctgggccatcacggcgctcgncctttcggctgcccttggcaa

SEQ ID NO: 12349 - protein, 109 aa, Zea mays
  misc_feature: Ceres CLONE 1370185-F
  misc_feature (14)..(99): Pfam Name: AWPM-19 Pfam Description: AWPM-19-like family
  misc_feature (62)..(62): Xaa is any aa, unknown, or other
  misc_feature (64)..(64): Xaa is any aa, unknown, or other
  misc_feature (66)..(66): Xaa is any aa, unknown, or other
  misc_feature (89)..(89): Xaa is any aa, unknown, or other
  misc_feature (103)..(103): Xaa is any aa, unknown, or other
MAGIGRNMVAPLLVLNLIMYIIVIGFASWNLNHFINGQTNYPRRGPATARRSNFLVFPSWPXLXGXRRPSLAGVHHVRAWRHDSLATKXPRRRSSPGPSRRSXFRLPLA

SEQ ID NO: 12350 - DNA, 601 bp, Zea mays
  misc_feature: Ceres CLONE 1370191-F
tggagctccccgcggtggcggccgctctagaactagtggatcccccgggctgcaggaattcgcacgagaccattacctagaacatcctaatcgaaaagacgacacacctgacacgtgggtctatcagtcatcctggtccttttattttctttcttctctcacccggttcttcctcctcccgagtcccgaactctcgatccactcatccgctgagggcgtcggccttctggcccttctccccccggccgacctcgcccctccggcgctccgtccgcttcctgaactcgtctccctcacggacgttctcctccctccgctcgccgcgccgcaacccggagaggagaccgccgctcggtcgagcaccacctggggcccagcgtcctcgcgaccagctctagcgcggcgtccgccctctgcagccctggtgtccccgcgactggcttcggccggcacacaactccacagttaggtctccgtctgcacagcgcggcgatcttctctctccttcccgccctctgcagtccctctcagtccctctccgtctgcttgattctgctccaacctcagactaccctcgctctgaaaatgtcattacgcaccc

SEQ ID NO: 12351 - DNA, 642 bp, Zea mays
  misc_feature: Ceres CLONE 1370199-F
  misc_feature: Encodes the peptide sequence at SEQ ID NO. 12352
  misc_feature (477)..(477): n is a, c, t, g, unknown, or other
  misc_feature (484)..(484): n is a, c, t, g, unknown, or other
  misc_feature (485)..(485): n is a, c, t, g, unknown, or other
  misc_feature (516)..(516): n is a, c, t, g, unknown, or other
  misc_feature (523)..(523): n is a, c, t, g, unknown, or other
  misc_feature (534)..(534): n is a, c, t, g, unknown, or other
aaagctggagctccccgcggtggcggccgctctagaactagtggatcccccgggctgcaggaattcgcacgagaccattacctagaacatcctaatcgaaaaaggcaactactccgtctcacgcctctcctgtcccctctcgccgctctcgccccgcctctgcctccgcctccgcctcctccatcgcacccagctttcctccccaccccaccgccactcctaccccgccacgtcgtgtagtcgcggcggcggatatgcaagccgccgccgccttcaaccaggcagccttcaccgtccgctcgctgcatcgccccccgaggcccctccatctagctgttgcggaggatgcttttgcggggataagaggcgcgccccttacacggccccggtgctgcgggagcctctctgtcggcgtcggcagctacgacagcgagcacactccagtatttccaagacaacaatcatgggatccctacnagcttcnnttggtgtgatcaagatgcatctggaagaagnaggtccngagtggcacgnaattttctcctaaaaacataacgcggatatgaagaaaagggaaagggccatggagggtggcttatgaacagaataaaatggaatagcttccccagaaccgtaagaaaa

SEQ ID NO: 12352 - protein, 79 aa, Zea mays
  misc_feature: Ceres CLONE 1370199-F
  misc_feature (75)..(75): Xaa is any aa, unknown, or other
  misc_feature (77)..(77): Xaa is any aa, unknown, or other
MQAAAAFNQAAFTVRSLHRPPRPLHLAVAEDAFAGIRGAPLTRPRCCGSLSVGVGSYDSEHTPVFPRQQSWDPYXLXLV

SEQ ID NO: 12353 - DNA, 622 bp, Zea mays
  misc_feature: Ceres CLONE 1370202-F
  misc_feature: Encodes the peptide sequence at SEQ ID NO. 12354
  misc_feature (474)..(474): n is a, c, t, g, unknown, or other
  misc_feature (475)..(475): n is a, c, t, g, unknown, or other
aaagctggagctccccgcggtggcggccgctctagaactagtggatcccccgggctgcaggaattcgcacgagaccattacctagaacatcctaatcgaaaagactattcttcttcgctcctgatgtttatccccaaactcaccgccggggcacaacaatccagttctcctttcgccggaatctgtgactcatccccgtcctccccggctctgcgggtactggaccaccgtggagcggacattcatccaggctaggcccattccttcctttgctcgctctcttctccatcgcggaagctccagccgagttgacgccagaagagaatcggtgccctagggtgttctcgcagaattattttccagaagatttgaagatcgaggcgaaccctatgccccacgttaagcctgccgccggtctgcccccttaccaccaccggacgctccctggccccgggcagggtccagttcccaggnnaccatgggatgatgcaccgggaggtccgtgatcagtacgggccgctggggccgaggatgcacctaccaccgctggggcacgggcccgctccgttcccctacgacatgctgcctccgctgcccccaccggaggtcctggagcagaagt

SEQ ID NO: 12354 - protein, 46 aa, Zea mays
  misc_feature: Ceres CLONE 1370202-F
MMHREVRDQYGPLGPRMHLPPLGHGPAPFPYDMLPPLPPPEVLEQK

SEQ ID NO: 12355 - DNA, 618 bp, Zea mays
  misc_feature: Ceres CLONE 1370203-F
  misc_feature (175)..(175): n is a, c, t, g, unknown, or other
  misc_feature (183)..(183): n is a, c, t, g, unknown, or other
  misc_feature (195)..(195): n is a, c, t, g, unknown, or other
  misc_feature (230)..(230): n is a, c, t, g, unknown, or other
tggagctcaccgcggtggcggccgctctagaactagtggatcccccgggctgcaggaattcgcacgagaccattacctagaacatcctaatcgaaaaaccaacaaatcgacctagctaggcacaagagcgctagacgccgcagcgcagcacgcaccacccaccgagcggcggcgnaggcaggncaatccgcaggnagcaaaaggcgcgcgcgcaagcatgggcgcgccgntgcacggcgcccctcgccttggtctcctgctcctggggggggcaagaaagggcccccagagaaaggggcccccaggaaccccacatggcagcacccggggtccgggggtacaggggaaaaggggggggggggagggaaatcccaatccgcggttggtgggggctttttggaatttccacaaaacggagctgtgggaatatggggggaaaaaaaaatcctttccctcataaaatttggaggaaaccccccccggaaaaaaaaaaaaattccctcttttttccccgcgggaaaaaagggggggggtagggggactggggccccccccggtttataagcgttctttttgggggggcggcaaaaccaaggggggtggggggggggggggggg

SEQ ID NO: 12356 - DNA, 588 bp, Zea mays
  misc_feature: Ceres CLONE 1370206-F
  misc_feature: Encodes the peptide sequence at SEQ ID NO. 12357
  misc_feature (250)..(250): n is a, c, t, g, unknown, or other
  misc_feature (492)..(492): n is a, c, t, g, unknown, or other
  misc_feature (537)..(537): n is a, c, t, g, unknown, or other
tggagctccccgcggtggcggccgctctagaactagtggatcccccgggctgcaggaattcgcacgagaccattacctagaacatcctaatcgaaaactcgtctccctcccgtatctgcaagccttgatcccgccgccagccatccatccaagggagccatgtctccatccggcgagctgctggcttccatctcctccgtcttcactgtcgccttcgtcctcctcgcctgcgtcgagctcggcgacccgncgccgccgccgtcggcgtctaccgcctcatccagacggacctcgccggcgctccgctcggtcccggcgccgcggtcctcaaccaccacgctgccgcgctcccgctccccgccggcgcagacctctcccgctccgccctcgtcgcgccgctcctcgacctcccgctctctttcctcagagagtacctggtggagaaaaacatcttggggggattactcattctgctcccgacaaataatgacnagtgtggatgacaaggggcaaattcaaaggtgtactggatgaaanttggaaaaagttgcttctggaatgaaaaagttcccataatcccagggaaat

SEQ ID NO: 12357 - protein, 124 aa, Zea mays
  misc_feature: Ceres CLONE 1370206-F
  misc_feature (31)..(31): Xaa is any aa, unknown, or other
MSPSGELLASISSVFTVAFVLLACVELGDPXPPPSASTASSRRTSPALRSVPAPRSSTTTLPRSRSPPAQTSPAPPSSRRSSTSRSLSSESTWWRKTSWGDYSFCSRQIMTSVDDKGQIQRCTG

SEQ ID NO: 12358 - DNA, 633 bp, Zea mays
  misc_feature: Ceres CLONE 1370213-F
  misc_feature: Encodes the peptide sequence at SEQ ID NO. 12359
  misc_feature (502)..(502): n is a, c, t, g, unknown, or other
aaagctggagctccccgcggtggcggccgctctagaactagtggatcccccgggctgcaggaattcgcacgagaccattacctagaacatcctaatcaaaaacatcactcccagactgcttccacctacgttcattatttccgcaatgtacaaccgagtatgatatgcagtcgtagtatcatggataaccaccttatgtcgtccttcgccatcctactgctttcttcttttgctgcaatggttgcatatcctgctcgcagtgaattacagcctaaccagatgaaaaaccaccattctgtatcatcatacagcccacaaccgaaggattttccaactgagcaactctacagcgcctacctagtaatccagcgattcaagagcaccatcactagcgaccccaagaacgtcaccgccacctggattggtcatgatatctgcggagaaaacgacctacgtggggttctactgcggatcgccggccgaggaagataagaagttgaangtcacgggggtttattttgaatggctatagtctacatgcccaacgggttgggaaggtttcgtcaatcagctccctgatctagctcttttccatgctgttccaaccaatttttggtggcgatataccccagc

SEQ ID NO: 12359 - protein, 103 aa, Zea mays
  misc_feature: Ceres CLONE 1370213-F
MDNHLMSSFAILLLSSFAAMVAYPARSELQPNQMKNHHSVSSYSPQPKDFPTEQLYSAYLVIQRFKSTITSDPKNVTATWIGHDICGENDLRGVLLRIAGRGR

SEQ ID NO: 12360 - DNA, 635 bp, Zea mays
  misc_feature: Ceres CLONE 1370214-F
  misc_feature (281)..(281): n is a, c, t, g, unknown, or other
  misc_feature (307)..(307): n is a, c, t, g, unknown, or other
  misc_feature (310)..(310): n is a, c, t, g, unknown, or other
  misc_feature (347)..(347): n is a, c, t, g, unknown, or other
  misc_feature (393)..(393): n is a, c, t, g, unknown, or other
  misc_feature (425)..(425): n is a, c, t, g, unknown, or other
  misc_feature (426)..(426): n is a, c, t, g, unknown, or other
  misc_feature (438)..(438): n is a, c, t, g, unknown, or other
tggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtnggtggcgtcggtgctcaagaaccggnggntgtcgacggcctcccgccggggccctccgggttgggncgggtggtgggggaaccctgttcccagtgatccctgcagcgacggncctttcatgtacgtggtgcgcgacttcccggnnagaagtacgggnccatcttccccattgccggatggggcagcgcacccttcatcgtggccaccctcggcggagctcatcaacgaagcgcttgggtgaagcagggcccccatgtttcgcgagccgggccccgaggaaagccccaaccggctccttctttcaggggtcggaaaagggacccgtaaattcgggggcctaagggccccccctgg

SEQ ID NO: 12361 - DNA, 631 bp, Zea mays
  misc_feature: Ceres CLONE 1370216-F
  misc_feature: Encodes the peptide sequence at SEQ ID NO. 12362
  misc_feature (565)..(565): n is a, c, t, g, unknown, or other
  misc_feature (588)..(588): n is a, c, t, g, unknown, or other
tccccgcggtggcggccgctctagaactagtggatcccccgggctgcaggaattctctcgagaccattacctaaaacatcctaatcgatgaatcgcgccctcacgtagcatcgcacagctgaagggcactttctactactacttatatcgtggattctgaagaatggcatgcgttaaactcaccgtttgtagtgccgagcgagccgacaccgtcggaggatactctcgctctctccgctggacctcgttctgacccatgagacgccacaccccaacagactacctgcacagccccagctatgtcgccgccaccgatggtctcttctacgtggcccggctcaaggacgttatggccaacaccttgatgaacttctaccccctcgctgtgcgtctctgcgccaacaacgatggcaggagagagatcacctgcaccggcaagggcgcactctttgtggccgctcatgctgacctcagcgttggtgacatcgaggactacttcaggtcgtcatcgcagctgtagcaagctgcttgttccatgcattgactcaggatccgtcatatggtncatactggtgtctttccccatgntcccggtagtgtcgtggactatgaaaccattctccaccatgac

SEQ ID NO: 12362 - protein, 87 aa, Zea mays
  misc_feature: Ceres CLONE 1370216-F
  misc_feature: SWISSPROT Homolog: EC 2.3.1.167 10-deacetylbaccatin III 10-O-acetyltransferase
MRRHTPTDYLHSPSYVAATDGLFYVARLKDVMANTLMNFYPLAVRLCANNDGRREITCTGKGALFVAAHADLSVGDIEDYFRSSSQL

SEQ ID NO: 12363 - DNA, 651 bp, Zea mays
  misc_feature: Ceres CLONE 1370224-F
  misc_feature: Translation starting site: 231
  misc_feature: Pfam Name: Sec1 Pfam Description: Sec1 family
  misc_feature (504)..(504): n is a, c, t, g, unknown, or other
  misc_feature (508)..(508): n is a, c, t, g, unknown, or other
tggagctccccgcggtggcggccgctctagaactagtggatcccccgggctgcaggaattcgcacgagaccattacctagaacatcctaatcgaaaaacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctgccggaaggaggtcttcctcgtcgagaccatggacaacgcctccagctccagggagtccatggcgcaccctcaaggccgtctacttcctccgaccctccgctaacaacgtccagaaaagctccgcaggcacctcgccatgcgncgcnttcgccgagtaccacctattcttctccaggaaatattgaaaggtcccgcagattcaaatacttgctggactcggtgaaaacacaggaggttgtgcagcaagagttcaggaggtctatgggcctggatttttggtgccattgga

SEQ ID NO: 12364 - DNA, 664 bp, Zea mays
  misc_feature: Ceres CLONE 1370228-F
  misc_feature: Encodes the peptide sequence at SEQ ID NO. 12365
  misc_feature (547)..(547): n is a, c, t, g, unknown, or other
  misc_feature (555)..(555): n is a, c, t, g, unknown, or other
aaagctggagctccccgcggtggcggccgctctagaactagtggatcccccgggctgcaggaattcgcacgagaccattacctagaacatcctaatcgaaaaattcaccttggctgcagcctgcaacacaatcctacgcttccgacttcaacgcgcgcccctcccattttcacctagccctactcctttgtacataaaggaagatgggagcatatgcaacgactggtatgcagatgatagcaacacgcccttccatcccggcctacaggcaaatacttgggtcgacatcagcactatctgcatttggaaggtcaatctgttccagaactggctttgccatctcttctaaagccacatcagcaggaccactggtttcttcgaattgcaagagggttgttgtgagggcaatgtcgcagagaggtgcccaaggacttcccattgatctcacaggtaaaagagcatttatagctggagttgctgatgataatggttatggttgggcaattgctaaggctcttgctgctgctggtgctgagaatcttgtggntacatggntgccctgcgtgaaactatttgagacaagcttgaaacgtgggaaagtttgatgaatcacggagctacctgatggatcctctatggaaatggctaaagtatatccctggaa

SEQ ID NO: 12365 - protein, 133 aa, Zea mays
  misc_feature: Ceres CLONE 1370228-F
  misc_feature: SWISSPROT Homolog: EC 1.3.1.9 Enoyl-[acyl-carrier-protein] reductase (NADH)
  misc_feature (115)..(115): Xaa is any aa, unknown, or other
  misc_feature (118)..(118): Xaa is any aa, unknown, or other
MGAYATTGMQMIATRPSIPAYRQILGSTSALSAFGRSICSRTGFAISSKATSAGPLVSSNCKRVVVRAMSQRGAQGLPIDLTGKRAFIAGVADDNGYGWAIAKALAAAGAENLVXTWXPCVKLFETSLKRGKV

SEQ ID NO: 12366 - DNA, 664 bp, Zea mays
  misc_feature: Ceres CLONE 1370230-F
  misc_feature: Translation starting site: 265
  misc_feature: Pfam Name: Mito_carr Pfam Description: Mitochondrial carrier protein
  misc_feature (486)..(486): n is a, c, t, g, unknown, or other
caaagctggagctccccgcggtggcggccgctctagaactagtggatcccccgggctgcaggaattcgcacgagaccattacctagaacatcctaatcgaaaaaacaaccatttcttcttcctttttctatatcgcgttacgtccctacccagcgatctaggccgccgcctctcctactgcatctccctcgctctcgtcgcctcgttcgcttcgcctccgccccgccccgccccgagcagagcgcagccctatccggagctgggatggcggacgcgaagcagcagcagcagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccagttgggtgagggctctgctggtcaggtcacaaggaacatgcttgaaatgganggtgtccgttctttctaacaagggtttgtccgccggattgctgaggcaagcgacgtacacgactggctcgtcttggattccctttagggttctaccttaacaaagcagttgaaaagaatgaagggaagccattgcctctatttcagaaagcttttattggtctgactgctggtgcaat

SEQ ID NO: 12367 - DNA, 615 bp, Zea mays
  misc_feature: Ceres CLONE 1370233-F
  misc_feature: Encodes the peptide sequence at SEQ ID NO. 12368
  misc_feature (251)..(251): n is a, c, t, g, unknown, or other
  misc_feature (261)..(261): n is a, c, t, g, unknown, or other
  misc_feature (285)..(285): n is a, c, t, g, unknown, or other
  misc_feature (517)..(517): n is a, c, t, g, unknown, or other
  misc_feature (544)..(544): n is a, c, t, g, unknown, or other
aaagctggagctccccgcggtggcggccgctctagaactagtggatcccccgggctgcaggaattcgcacgagaccattacctagaacatcctaatcgaaaaacactttgttgcgctcctttagcgccggcggcccgtagcctcaatcatcatttccattctatccggtttcttccgacgacggtgtgtacagagagcaggatcggacaagtctctgctggtagaagcatggcgcagcgccggctgttggncacggcgcgngcgcccgcggacgatgcggcgtcncacggctcgggctccagccccgacgcgatgcgggatcatggtgggcgtgctggtaacggtcatcgtctgcacgctgctctactgcgtctactggctggcggtggcggaagcgcatgcccatccggagatccctgctggcgctaaatggggccggcggtcgaggtcggacctgccgctcatggacctgggctgcatcctcgctgccaccgacaacttctccaaggcacaaggntcgggcgagggcggcttcggcccgtcntacagaggcgtgctgagcgagggctccgagatcgccgtggaacgttgtttcggcccggtcgcgcaggaacg

SEQ ID NO: 12368 - protein, 113 aa, Zea mays
  misc_feature: Ceres CLONE 1370233-F
  misc_feature: SWISSPROT Homolog: EC 2.7.11.1 Non-specific serine/threonine protein kinase
  misc_feature (4)..(4): Xaa is any aa, unknown, or other
MRRXTARAPAPTRCGIMVGVLVTVIVCTLLYCVYWLAVAEAHAHPEIPAGAKWGRRSRSDLPLMDLGCILAATDNFSKAQGSGEGGFGPSYRGVLSEGSEIAVERCFGPVAQE

SEQ ID NO: 12369 - DNA, 644 bp, Zea mays
  misc_feature: Ceres CLONE 1370235-F
  misc_feature (519)..(519): n is a, c, t, g, unknown, or other
tggagctcaccgcggtggcggccgctctagaactagtggatcccccgggctgcaggaattcgcacgagaccattacctagaacatcctaatcgaaaaagccagccagtgggtctgttccggaggcacacacgcacagttgctgctgaagcacacggcagttgccttgcctgttcgattgctgcttccttcctcctccctcgagtcttcttctcagcccagagagacagacgccaaggaagagctggtaggtgccgcttgctctgcctccgatccaacccaacccaaggcagcagcagcagcgggtacgttcttctcggccatgcatggaatggaacgaagaccgcccaccgccggcgccgcctagatctctgcatccggtggccgccattggcggttcttggctccgattcggtgctgcctggtgacgagtaaaagcgaaggaaaaaaaaagaaggaagggacggcgattcaggcctcactcttggcctgtgagcctgtcgtcgacatgaagtacatgnaagcttggatccaagccggacgccttttcagacggaggggaacagtaaatcaggtctgttgcaactgagctggcagtgggatattgtcgcacttgggtaggggggatgtcaagttctaaccttca

SEQ ID NO: 12370 - DNA, 675 bp, Zea mays
  misc_feature: Ceres CLONE 1370237-F
  misc_feature: Encodes the peptide sequence at SEQ ID NO. 12371
  misc_feature (331)..(331): n is a, c, t, g, unknown, or other
  misc_feature (395)..(395): n is a, c, t, g, unknown, or other
  misc_feature (397)..(397): n is a, c, t, g, unknown, or other
  misc_feature (398)..(398): n is a, c, t, g, unknown, or other
  misc_feature (412)..(412): n is a, c, t, g, unknown, or other
  misc_feature (415)..(415): n is a, c, t, g, unknown, or other
  misc_feature (443)..(443): n is a, c, t, g, unknown, or other
aaagctggagctccccgcggtggcggccgctctagaactagtggatcccccgggctgcaggaattcgcacgagaccattacctagaacatcctaatcgaaaaacgaggcaatgctgtcccgtcgccgcagctcgccgcgcccgctcgcacctggcctcctcctgttactcctcgccatggcgccgccaccgccggcttccgcggtgggtgtgaactggggcttcgcgtcctcccactcgcttccggcggcgcaggtcgtacggggcctcctcctccccaactctgttccccgcgtccgcctcgccgccgcctcctccgacgcgctcacggngctcgaaggcaccggcatcgccgtcagcgtcgggatcccccgacgcgctgctccggcccctcgncnntctcacaagggagncgncgcgtgggtccacgacaacatcacccgntactcctccagggggcgggtcgagtaatattggttgtgggggatgagccctttcttctacggcatggacaaaatttccatccttttgaagtcaagccgcaaaaaaggttcaaaaggattaacccatggaaaattgctggcaaaataaagggggaaaaaccctgaaagggtgaacacttccaaaaagcctttccccggccccaaaaaattttcttcaaacggggttgaaaaac

SEQ ID NO: 12371 - protein, 97 aa, Zea mays
  misc_feature: Ceres CLONE 1370237-F
  misc_feature (52)..(52): Xaa is any aa, unknown, or other
  misc_feature (74)..(74): Xaa is any aa, unknown, or other
  misc_feature (79)..(79): Xaa is any aa, unknown, or other
  misc_feature (80)..(80): Xaa is any aa, unknown, or other
MAPPPPASAVGVNWGFASSHSLPAAQVVRGLLLPNSVPRVRLAAASSDALTXLEGTGIAVSVGIPRRAAPAPRXSHKGXXAWVHDNITRYSSRGRVE

SEQ ID NO: 12372 - DNA, 641 bp, Zea mays
  misc_feature: Ceres CLONE 1370240-F
  misc_feature: Translation starting site: 283
  misc_feature (431)..(431): n is a, c, t, g, unknown, or other
aaagctggagctccccgcggtggcggccgctctagaactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggcaccatagtggcttcaaaaaggggtatggggtcttaccagaaggacaaaanggactgggcgtccaaaaatttggatatacagggacaaagttactaatgaaccaaagggtgatgcaacagtcacctatgaggatccacatgctgcttcagctgctgtggaatggttcgataacaaggatttccatgggagcactattcaggttcacatagctgagtcaaaaagcaaagatgcattcgataaccccacaagtttaacatcat

SEQ ID NO: 12373 - DNA, 670 bp, Zea mays
  misc_feature: Ceres CLONE 1370241-R
caattgggtaccgggccccccctcgaggtcgacggtatcgataagcttttttttttttttttttaaacaagaattctgatcttcttttatagaaccgacccgtatgagctagtatgtcattgctacggggtctgcttcttctgatgggtaccccttgatttgtctgtggcatgcataaaagctcgaaacctaacaccctgcattagtatggctacacagcattcacacgctcgcactcccgcttcgatggatagatacattattattacagagagagatagaaagcttcaatacctgatggtacaattttttcttcctgggaggctggtgacttcttcttggttactgaatccctctttcccttagaatgtactcgctcttgttctttgtcctccggccccgaattgggagttccatctagttccatatgcccttgtaatcccctttctccttctttctctcattcggctcacaggtgaaacatgtcatgtctccctctatcatgtacttgccttcctccttacggaaggtgatgacctcctcctcggagaggtccttggtgatcttgctcatcaaattaaggtccacgaatatctggcgtgagcctgatcttccaatgtcttgtctatactgccgcgagtactcctccctcatgtggtgtggaatctcc

SEQ ID NO: 12374 - DNA, 662 bp, Zea mays
  misc_feature: Ceres CLONE 1370241-F
  misc_feature: SWISSPROT Homolog: EC 1.3.1.77 Anthocyanidin reductase
aaagctggagctcaccgcggtggcggccgctctagaactagtggatcccccgggctgcaggaattcgcacgagaccattacctagaacatcctaatcgaaaaagagcgctcgtccgtctaaactgtggtctctgtacttccgctcacttcttcagcgacggcgtgacaacgacagcaagaaagtatcaaaacccgacagcaatgcacgcgtgggccaatagcgtgtgcgtgaccggtgcgcccggtttcatcgcgtcatgactggagaagctcctcctctgccgttgccaatacaaggtccgcggcaccgtgcgcgaccctggtgctagcaagaatgctcatctcaaggtgctggaaggggatgtggaaaggttgcagcttgtcaaggctgatttgttgtactacagcagtgttgcatcaacaattgccggctgcgatgctgtcttccatgtatctagccctgtcccttccgggcggtcctccaaccctgaggaggaggtcataggtcctgctgtaacaggtacaatcaatgtgataaaggcttgctatgacgcaaaagttgggcgagatgtggtggtctcttcatgtgcagctgtctatgctaatcctaattatccaaagggtaaggtctttgacgaagactgctggacagatgaagcttc

SEQ ID NO: 12375 - DNA, 671 bp, Zea mays
  misc_feature: Ceres CLONE 1370255-F
  misc_feature (423)..(423): n is a, c, t, g, unknown, or other
  misc_feature (428)..(428): n is a, c, t, g, unknown, or other
  misc_feature (448)..(448): n is a, c, t, g, unknown, or other
aaagctggagctccccgcggtggcggccgctctagaactagtggatcccccgggctgcaggaattcgcacgagaccattacctagaacatcctaatcgaaaaccatttggaacacacgtcttttccttcgcgggtgagcctggcccgtgctcgcctggtaaaagtgctagggttcttctcgcccatcgcagccgccgccgcggctctcgcctcttgactcgctctcgcctctcggagcaaaagctgtgtccgctcctcctggtgatcccggagccagtcctcgccgcaccgcgctgtgtctgctcctcctggtgatcccgcaccgtgctgtgtccgctccatcttcctccgccgccacactcagcgccggtgcgagggcatgtctacctacccgaggacctacgatctcatccatgcggactncgtgntcaccctgtacaggacaggnagagatcctcctggttgtcagacgtattggactaccccatgagcatgacccagattcggagcaggactggcaaggcatttttactgaacccaaaaggttcggccatgggtttgggtaccaagcggggctcttgggggactcttttttttccgggaaaaaaattggggggcaaattttcgaaggaagcccaaagggggggttttaaaatcggggggggtggggc

SEQ ID NO: 12376 - DNA, 645 bp, Zea mays
  misc_feature: Ceres CLONE 1370262-F
  misc_feature (439)..(439): n is a, c, t, g, unknown, or other
  misc_feature (589)..(589): n is a, c, t, g, unknown, or other
  misc_feature (610)..(610): n is a, c, t, g, unknown, or other
aaagctggagctccccgcggtggcggccgctctagaactagtggatcccccgggctgcaggaattcgcacgagaccattacctagaacatcctaatcaaaaagatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcaatccgagcacgcagctagtagggaaagtatccgagaaaagttgcagattttgctgggggcaacggagcgagaacaagttactgcagaaggaaagggcnaaaggtgggggaggcgccggagaatgagggatgctatcagctctgatggattatttgaaatcttggctcgggtccggcatcaccgggctgggcgtcccccgcaaaggatcggatgccaccggcccgccagggacgggctcctgtggtacnaggacggcgggcagggtcgtncggatggtgagtcctccccatggccgtggtccagg

SEQ ID NO: 12377 - DNA, 575 bp, Zea mays
  misc_feature: Ceres CLONE 1370276-F
  misc_feature: Translation starting site: 367
  misc_feature (204)..(204): n is a, c, t, g, unknown, or other
  misc_feature (213)..(213): n is a, c, t, g, unknown, or other
  misc_feature (216)..(216): n is a, c, t, g, unknown, or other
  misc_feature (217)..(217): n is a, c, t, g, unknown, or other
  misc_feature (223)..(223): n is a, c, t, g, unknown, or other
  misc_feature (268)..(268): n is a, c, t, g, unknown, or other
  misc_feature (467)..(467): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (498)..(498): n is a, c, t, g, unknown, or other
  misc_feature (500)..(500): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (528)..(528): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (556)..(556): n is a, c, t, g, unknown, or other
  misc_feature (557)..(557): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (573)..(573): n is a, c, t, g, unknown, or other
aaagctggagctccccgcggtggcggccgctctagaactagtggatcccccgggctgcaggaattcgcacgagaccattacctagaacatcctaatcgaaaaacaaattagcaaagccgcgcgcattacattacattacatacaaacatacacagtttggccgttaattagccagcgctgacaattaaccctcgtcttcgtcgnctggaccgncgnncgacgncgtacgtgaccacaaccaggctatagagctacctccagccgcggnccgcgcgcttccgccgcggtggtacatagtcttgccccggagcacgcgcgcggacatggctcaatgaaaggcgcgcgggcaaccgaaattccgcccgcatggcggacgggaccccggagaagtctccgcgactccgggggggtgtacaaccgggggctttgaaggtttggaacagaagggcagggggggagggaacccnaacgcaaaaacaccccgggggggnnnnnnananannnaaaannnngccccctggggggggnannnccccccnnnaaggggaaaaaaccnngggnnnnccaaaaccncg

SEQ ID NO: 12378 - DNA, 650 bp, Zea mays
  misc_feature: Ceres CLONE 1370277-F
aaagctggagctccccgcggtggcggccgctctagaactagtggatcccccgggctgcaggaattcgcacgagaccattacctagaacatcctaatcgaaaaattacttactggtccgcactcccaaccaaccaatcaacctcctctgtctgccgcttctcctgctgcgggtgtacacgatatgctatcactaaaggatcgaatccatgttccattactgcatactattatcgaccgaacgaactcatgagcataaggatcccatgttaccctgctgcaataaacttcccgcatgacatcggaggggcgcgatcctcatctcgacgcccgctgcctcctcgttgagggcccctgccctttggacatccgcttgccccctgctgggctgagcatcacagtgcctgcagatgacatgcaccagatggtgccagccgtgcttccaatactgaacactgcatgatcaacatagcataccatcacgatcgcacagatcatgtgaactacacaaagctcctcgttaaaggcaaatatgttgatcccgcatacgggaataacgtcccaactctggaccctcgtactgactaccttgatagatcctgcccttgaggcagactgaaaacacattaaacgagctacacatgcctatccac

SEQ ID NO: 12379 - DNA, 664 bp, Zea mays
  misc_feature: Ceres CLONE 1370279-F
  misc_feature: Encodes the peptide sequence at SEQ ID NO. 12380
  misc_feature (426)..(426): n is a, c, t, g, unknown, or other
  misc_feature (435)..(435): n is a, c, t, g, unknown, or other
  misc_feature (443)..(443): n is a, c, t, g, unknown, or other
  misc_feature (444)..(444): n is a, c, t, g, unknown, or other
aaagctggagctccccgcggtggcggccgctctagaactagtggatcccccgggctgcaggaattcgcacgagaccattacctagaacatcctaatcgaaaaaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgagggaggactacgtccagaacgccgtcaagtttctctcccaccccaaggtcaggggctcccccgtcgtctacaggcgatccttcctcgagaagaggggccttagcacccgagagatcgacgaggccttcccgaaggttcctgantcctcaccnagcactanncggtacacttctccgcagcagcaggtcaacaggcagaaatcaatccgtcggggtgcaggcttatgggcaggacaaccgggggacccagaaaccgtggccttggcggtcttcccagcggagccaaggtttaacgtggaccaaaaatttctggggtggaggttcttggttgggtttgggggcaagccttgttggttttaacaaaaatgggccttccaagggt

SEQ ID NO: 12380 - protein, 156 aa, Zea mays
  misc_feature: Ceres CLONE 1370279-F
  misc_feature (37)..(134): Pfam Name: Pex14_N Pfam Description: Peroxisomal membrane anchor protein (Pex14p) conserved region
  misc_feature (85)..(85): Xaa is any aa, unknown, or other
  misc_feature (91)..(91): Xaa is any aa, unknown, or other
MASGIGSGQQQPPAPAADADPGAVGDKLVFEAPPQPVREDYVQNAVKFLSHPKVRGSPVVYRRSFLEKRGLSTREIDEAFPKVPXSSPSTXRYTSPQQQVNRQKSIRRGAGLWAGQPGDPETVALAVFPAEPRFNVDQKFLGWRFLVGFGGKPCWF

SEQ ID NO: 12381 - DNA, 611 bp, Zea mays
  misc_feature: Ceres CLONE 1370287-F
  misc_feature (256)..(256): n is a, c, t, g, unknown, or other
aaagctggagctccccgcggtggcggccgctctagaactagtggatcccccgggctgcaggaattcgcacgagaccattacctagaacatcctaatcgaaaagtcccaaaaagggcaacgaaatccagacaccgctccccatctccccttccttcctttcctactcccacactcccccaccctccactagtactagtactagtaccacaaccaccccaccgggaaaaaacccatcaggtggtaggggcgtcgccgncagcaggggcgccgtggagatcgcggcccgatctaacgcgctggggcacgggggtccccggatcgacgacgctcccgcgcagggttccgatgggtatgcggaaagaaaaccctgtgcttaatgggtgtgcaggataccatgggccggatacgccgaggtcaaggttgttgtgaaacggcgaaagctttggagtttcccctctggtgccactggccgggaaaaccggaaggaaaacagactggccaaagggaaggggaaacgagggttcttcctatggaaacacccgggggaaggggtggctttttcgggccccggcctaaaaagggacagactctccggggattgaccccaattt

SEQ ID NO: 12382 - DNA, 664 bp, Zea mays
  misc_feature: Ceres CLONE 1370298-F
  misc_feature: Encodes the peptide sequence at SEQ ID NO. 12383
  misc_feature (343)..(343): n is a, c, t, g, unknown, or other
  misc_feature (344)..(344): n is a, c, t, g, unknown, or other
  misc_feature (355)..(355): n is a, c, t, g, unknown, or other
  misc_feature (363)..(363): n is a, c, t, g, unknown, or other
  misc_feature (384)..(384): n is a, c, t, g, unknown, or other
aaagctggagctccccgcggtggcggccgctctagaactagtggatcccccgggctgcaggaattcgcacgagaccattacctagaacatcctaatcaaaagaaaaatttagaaaaagtctagacgacgcgcttgtgtgcgtggccggacctgaaaagccggttcctcccccgaccccggcgccccaccgcagccgccggctcccaccgcccggcgcaccccgtcacctctccaccaaccggatacccggacggatccgctcccacctggatcctgatccggggaagtcaaaggggagatcgaagcttgagcagagggagccaaaatggtgaaggacacgcgnntactacgacgntgctgggncgtggacccgtccgccaccgnagtccgagatcaagaaggcgtactacgtcaagggcgaggctggtccaccccgataagaacccgaatgatccgcagccgcgcggagaagttccaggaactaggagaagcataccaagttctcagtgaccctacacagcgccaagcttatgatcaacatggggaaagacggcatctcaacgggagggggattattgatcctgcaacaatttttgcaattcttggtttggtagtgagctttttgagggaatatatttggtcaactggcaatggcatcaatggc

SEQ ID NO: 12383 - protein, 113 aa, Zea mays
  misc_feature: Ceres CLONE 1370298-F
  misc_feature (7)..(7): Xaa is any aa, unknown, or other
  misc_feature (13)..(13): Xaa is any aa, unknown, or other
  misc_feature (20)..(20): Xaa is any aa, unknown, or other
MVKDTRXLRRCWXVDPSATXVRDQEGVLRQGRGWSTPIRTRMIRSRAEKFQELGEAYQVLSDPTQRQAYDQHGERRHLNGRGIIDPATIFAILGLVVSFLREYIWSTGNGING

SEQ ID NO: 12384 - DNA, 645 bp, Zea mays
  misc_feature: Ceres CLONE 1370300-F
  misc_feature: Encodes the peptide sequence at SEQ ID NO. 12385
  misc_feature (423)..(423): n is a, c, t, g, unknown, or other
tccccgcggtggcggccgctctagaactagtggatcccccgggctgcaggaattcgcacgagaccattacctagaacatcctaatcgaaaaagaactgactccctcgatcccagcggcagcggcggaagcgaacggtgaccgcgacctcccctgaccctgaggctgcatatactcggatcgggtttcacatctccggttttggattggttggttgcccgcggtgatgggaggagagctgtggtggtatccataggggatcctcgtttgcgtccttgtgcgatggcttcgacctccgttcctgagttaaccgcggacaagaaatgcgacaaagccatcgcggatacggcggcaccacttacttctcagggacactcccgaagaacgactggagaagtcagcacactagtgcctgctttggccgntgtaattgcagcagccgatggggctgcatcccagtggggggatagaaaacagaaatggcatggacaattctgctggatgggtctttgaagcggaatgaccgtgaaggtgctgaaataagttccctggcggggggcgggcaaggaaagctccgggggcggctaaatggattgacagggggagaccaccctgtcaaaaagcccggggaagaccccaaaaattcg

SEQ ID NO: 12385 - protein, 76 aa, Zea mays
  misc_feature: Ceres CLONE 1370300-F
  misc_feature (48)..(48): Xaa is any aa, unknown, or other
MASTSVPELTADKKCDKAIADTAAPLTSQGHSRRTTGEVSTLVPALAXVIAAADGAASQWGDRKQKWHGQFCWMGL

SEQ ID NO: 12386 - DNA, 635 bp, Zea mays
  misc_feature: Ceres CLONE 1370440-F
  misc_feature: Encodes the peptide sequence at SEQ ID NO. 12387
aaagctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcc

SEQ ID NO: 12387 - protein, 135 aa, Zea mays
  misc_feature: Ceres CLONE 1370440-F
  misc_feature (49)..(135): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGF

SEQ ID NO: 12388 - DNA, 581 bp, Zea mays
  misc_feature: Ceres CLONE 1370442-F
  misc_feature: Translation starting site: 147
  misc_feature (195)..(195): n is a, c, t, g, unknown, or other
  misc_feature (196)..(196): n is a, c, t, g, unknown, or other
  misc_feature (201)..(201): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (208)..(208): n is a, c, t, g, unknown, or other
  misc_feature (258)..(258): n is a, c, t, g, unknown, or other
  misc_feature (322)..(322): n is a, c, t, g, unknown, or other
aagctggagctcaccgcggtggcggccgctctagaactagtggatcccccgggctgcaggaattcgcacgagaccattacctagaacatcctaatcgaaaacttgtgaacatcgcagtgctgtagcctccttcgtcttgagcgagcatggagatgtcagccatggaggaagccctcccaagccgaatggaagagnnagaangnnnagnctcagaaccattccgttcatcatcttaaacgagatattcgagaaagtggncacgttcggggctgtcggccaacatgattctgtaactcaacgagcggtatctcatgaccaacgnctttggcaacggcggtctctaaatctgggatggcctcccaactttctggccatcttaggggcgtggttgccgaagcccggctcgggcggttcggggaatcaaccttggtcctgggttaagctctttggaatggtctggtgtgggtgaagggaatccttcgggggaaagaaacccccgaatgggcgcgggcggcccgaaaggggggcggggtttcccgggaaatttgccttccttttcaggcgttcgcgtatgtcccccg

SEQ ID NO: 12389 - DNA, 632 bp, Zea mays
  misc_feature: Ceres CLONE 1370443-F
  misc_feature: Encodes the peptide sequence at SEQ ID NO. 12390
  misc_feature (469)..(469): n is a, c, t, g, unknown, or other
  misc_feature (470)..(470): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (512)..(512): n is a, c, t, g, unknown, or other
  misc_feature (566)..(566): n is a, c, t, g, unknown, or other
aaagtggagctccccgcggtggcggccgctctagaattagtggatcccccgggctgcaggaattcgcacgagaccattacctagaacatcctaatcgaaaaatctcctttctctctctacacatactcagacgagcagaagcagctagggacaccataggcaaactacttcagcaagaaattaaactatctcctacgcaagatcagaagaaactgtgtatggagcaagaagaggttggcctcgccctgggcctctccctcggctccggccaccaccaccaggagctcaagccccaacatccgtcgcatccgggtgcgggcgttgttggagccttctctgtcgctcagcggcccggcgaccaaggatgatggcccgaccgcacgggtggaggaggttcgctgccgtgaagagggagctgcagacgatggaggggaacgacgacgagccaccggcagggactgcactccanngggggggggggcnnnngggggggggnnnntggcggacgccgncgaaggggggcaccagcagcccggaagaagctggaggctggcccaaggagcaancgggcgctgctggaaggaccactttcagggagcacagcacccttcaaccctaagcagaaaggtgct

SEQ ID NO: 12390 - protein, 49 aa, Zea mays
  misc_feature: Ceres CLONE 1370443-F
MEQEEVGLALGLSLGSGHHHQELKPQHPSHPGAGVVGAFSVAQRPGDQG

SEQ ID NO: 12391 - DNA, 606 bp, Zea mays
  misc_feature: Ceres CLONE 1370444-F
  misc_feature (249)..(249): n is a, c, t, g, unknown, or other
  misc_feature (278)..(278): n is a, c, t, g, unknown, or other
  misc_feature (307)..(307): n is a, c, t, g, unknown, or other
  misc_feature (361)..(361): n is a, c, t, g, unknown, or other
  misc_feature (363)..(363): n is a, c, t, g, unknown, or other
  misc_feature (396)..(396): n is a, c, t, g, unknown, or other
caaagctggagctccccgcggtggcggccgctctagaactagtggatcccccgggctgcaggaattcgcacgagaccattacctagaacatcctaatcgaaaagttttccaacacagcgaggcccacgttgtagggttttttgcttgcttcgcccggcggtaaagctgagcgcggcgagagccggagaccgaagaagcgccgcccgccgcgcgcccggtcatggagatcggacagtaccccgcgagcgngctgctccaaggagcaccagaagatctanccaggagtggttcgcgctcgcggacgcangatggggatggccgcatcacgggcccccgatgcgatccagtttttttgcatgtncnagctctcccggccgggactcaagcaggttgggnctatcgcggacaccgaaaggaggggaattctggttttccctgaatccgcccggggagatggattatatcttcctgggaaaaagggggggaacgggattactcaagaatacccctttagggaaaggttttttggagcattttaaaacccccccggtgtagggaaaaagtttttggtcgccccccttttggggaaaaataaaaaatttgggg

SEQ ID NO: 12392 - DNA, 651 bp, Zea mays
  misc_feature: Ceres CLONE 1370449-F
  misc_feature: Encodes the peptide sequence at SEQ ID NO. 12393
tccccgcggtggcggccgctctagaactagtggatcccccgggctgcaggaattcgcacgagaccattacctagaacatcctaatcgaaaaatcacaattcactccactcatcttttctcgtttagaacctctaaaatttcccccactcgccagtcgcagcagcacctgtagcagtcatggacgccagcggagccggtagcaaggggaagaagggggcgggcgggcgcaaggcaggcggtcccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctctccgtcgcttcagtcatggcggagggacaccctgagagggttctcagttcgatgctaagcactatgattctaagatgcaggagctgctgagcaccggtgaagactgaggagctcttcattcatatggatgaagcttcttgcagagtgttgatgatatgagacctccagagaatcttctgagaggctttatgggctaagggactagagaagacatctgcaattcagccagagaagtaattgttcctttctgcaaggggtttttgt

SEQ ID NO: 12393 - protein, 99 aa, Zea mays
  misc_feature: Ceres CLONE 1370449-F
  misc_feature (29)..(96): Pfam Name: Histone Pfam Description: Core histone H2A/H2B/H3/H4
MDASGAGSKGKKGAGGRKAGGPRKKSVTRSVKAGLQFPVGRIGRYLKKGRYAQRVGTGAPVYLAAVLEYLSVASVMAEGHPERVLSSMLSTMILRCRSC

SEQ ID NO: 12394 - DNA, 797 bp, Zea mays
  misc_feature: Ceres CLONE 1370467-R
ttccaaaatgggtacagggccccccctcgaggtcgacggtatcgataagcttttttttttttttttttggtttgcatattgatacaatactacctccgttcttgaatatttgtcgcctattgtttcaaaaaacgacaaataaaaaaattaaaaaagaatggagagtatttttatgctgctgctatgcacggctcatacatttctgttcgacaggctcaatttattgttgtgctgttacatacatgcatggctgcacattgggcagcagttagctcacaatcagactttgctgtctccaagaagcagtgcctccttttaaactggcatgatttggtttgcatattaccagcaggcaaatacaatattttgcagaagctaggaacccttgctgattttctactgaccctgtggttagtttggggtcgtcggcagcagcggcatatgcatatgcgtgcacactctctctggatctcccctcgcccacaggttctgcagctcccctctcttgcatccagcgcgatcaagtgccaagagtgaaaggcacgatgtacaaaagggcaagttgtccatgcccatccatcaagttcagcgcaacatatgtgattagaagtccagagccataggccaacattgcccacaaaaagtaaccagaccgtaagcccttctttgcagaaaaatcgtatcttagcgagaaagccactaaaagaacaggaagaaagatatcaccaaagccaatgatgctgtatccaccccatggatcaaaacattcccgggatttttagcagcatgggcacacc

SEQ ID NO: 12395 - DNA, 652 bp, Zea mays
  misc_feature: Ceres CLONE 1370467-F
ggagctccccgcggtggcggccgctctagaactagtggatcccccgggctgcaggaattcgcacgagaccattacctagaacatcctaatcaaaaaatagccgaatactgaaagcgaacaagaaaataaagagaggaggagagacacactagcgatccttctgcacactgccgtggctctcatccccttacatttccgtggagggccagaaaaccgccgcttgttctggaagtggagtagagaaatgtatagaacataggacggggcatgggggtggccgtggctcacggcggcaaacatagacgaggaagcgggcgctctccacatagctcattgatactgccatcactgcagagtattgtatgctcgaactactaaattctgtcaatagagcacaacttgaacagtgcacaagaggccggccagcctctggctgccatggctaatcctaacgatgatgtctactccgaggacaagcatgcagacggaagtaaactcacgactggcacaacctataggatggctggtctcctccgaaacataaagtaaactgcagactgatctcctagcacgaagcgcgcaagtgcaagttcacttcgaaaggaagacaagttgaagtcctagagcttattgggggctatatgaatcataa

SEQ ID NO: 12396 - DNA, 799 bp, Zea mays
  misc_feature: Ceres CLONE 1370467-R2
  misc_feature (1)..(1): n is a, c, t, g, unknown, or other
  misc_feature (2)..(2): n is a, c, t, g, unknown, or other
  misc_feature (71)..(71): n is a, c, t, g, unknown, or other
nngggagcgtttgatacatactacctccgttcttgatatttgtcgcctattgtttcaaaaaacgacaaatnaaaaaattaaaaaagaatggagagtatttttatgctgctgctatgcacggctcatacatttctgttcgacaggctcaatttattgttgtgctgttacatacatgcatggctgcacattgggcagcagttagctcacaatcagactttgctgtctccaagaagcagtgcctccttttaaactggcatgatttggtttgcatattaccagcaggcaaatacaatattttgcagaagctaggaacccttgctgattttctactgaccctgtggttagtttggggtcgtcggcagcagcggcatatgcatatgcgtgcacactctctctggctctcccctcgcccacaggttctgcagctcccctctcttccatccaagcgcgatcaaggtgccaagagtgaagggcacgatgtacaaaagggcaagttgtccatgcccatccatcaggttcagcgcaacatatgtgattagaagtccagagccataggccaccattgcccacaaaaagtaaccagaccgtaagcccttctttgcagaaaaatcgtatcttagcgagaaagcaactaaaagaccaggaagaaagatatcaccaaagccaatgatgctgtatccaccccatggatcaaacattcgcggggatttttagcagcatgggcacaccatccttcgtcggtcttgtcgccacgcgcaaccacaatcatcacgctctcatgaaaccatctcttggagat

SEQ ID NO: 12397 - DNA, 654 bp, Zea mays
  misc_feature: Ceres CLONE 1370496-F
  misc_feature (474)..(474): n is a, c, t, g, unknown, or other
  misc_feature (563)..(563): n is a, c, t, g, unknown, or other
  misc_feature (638)..(638): n is a, c, t, g, unknown, or other
aaagctggagctccccgcggtggcggccgctctagaactagtggatcccccgggctgcaggaattcgcacgagaccattacctagaacatcctaatcgaaaaacaagcctgccaaaccaaaccagccttccgccggattggaaactaccagatgctaccagcgctactaatccagcgtctcccaccgtaggaatctctcaattagcgacccgtgtcctgttgcacaattatatagccaccatttgagaagataggggggaggtggagcagagcacaaggagaggggacaaggagggacgggaaggggaataagctgaggggaaggcaaggcaagcaggaatcggctggattgcgcgccgacttcctggccgagtttttctagccatcggatcgaggcagtcccatcggcgaagacccggttccgttcggggcccatggcggttggtttctctgcttggtctgtcaggactctgnatgggcatggtcatcctaaggtttctggttgctttgctcgggggtccaagctgtgcttcatctcagggttgccgcggtagagcgcaaanaaatgatgatgtctttcctttcggaggcggcccgggagcgtcgttcccgctcctaaaatgtggttggagttcggnagatgatcttggaatt

SEQ ID NO: 12398 - DNA, 659 bp, Zea mays
  misc_feature: Ceres CLONE 1370503-F
  misc_feature: Encodes the peptide sequence at SEQ ID NO. 12399
  misc_feature (589)..(589): n is a, c, t, g, unknown, or other
aaagctggagctccccgcggtggcggccgctctagaactagtggatcccccgggctgcaggaattcgcacgagaccattacctagaacatcctaatcgaaaaatcaaatcttacagttatagcaatggacactccaagtggcactatcatcttcaccaccgttggtcgcactcactacggcttcgacgttttctctctccacatcgcctcctctgtcgaacgccgtttaacagacggagtttccgtcaacttcaacgctcagttcgctgacgacaacggtaacgatatcgtgttcgtttcggaacgagctggatctgcccggattttcagaacccgacccgggaattccaaacccgagcagcttcccggagctccggaaagcttcttccacgaccgtccaatcatcactcaagacaacactctctacttcatctccgctcacgagcagcctgatcgccatttcaagaactggacagcgctctactccgtgaacagccaagggaaagaagtgacacgtgtcactccaccagacaccgccgacttcaagccccgcggtttctaaatcgggaaaagtatttcgccgtggcgntcgtacggatctcgctcatgggggcggcgagtttcacgagatcaactcttgacatcgttgtcttcaaacc

SEQ ID NO: 12399 - protein, 145 aa, Zea mays
  misc_feature: Ceres CLONE 1370503-F
MDTPSGTIIFTTVGRTHYGFDVFSLHIASSVERRLTDGVSVNFNAQFADDNGNDIVFVSERAGSARIFRTRPGNSKPEQLPGAPESFFHDRPIITQDNTLYFISAHEQPDRHFKNWTALYSVNSQGKEVTRVTPPDTADFKPRGF

SEQ ID NO: 12400 - DNA, 655 bp, Zea mays
  misc_feature: Ceres CLONE 1370530-F
  misc_feature: Encodes the peptide sequence at SEQ ID NO. 12401
  misc_feature (449)..(449): n is a, c, t, g, unknown, or other
  misc_feature (530)..(530): n is a, c, t, g, unknown, or other
aaagctggagctccccgcggtggcggccgctctagaactagtggatcccccgggctgcaggaattcgcacgagaccattacctagaacatcctaatcgaaaactttccctttctggccgcattccctcgtcctccggcagccgtcgccagcttccgatggtccggaaggagacggccatgaggctgcccccgcagcaccagggcctggaggtcaagatccccagcttcttccgctgccccatctcgctggacgtcatgcgctcgcccgttagcctctgcaccggcgtcacctacgaccgcgcctccatccagcagtggctcgactccggcaacaccacgtgcccggccaccatcctcccgctcccctccaccgacctcgtccccaacctcactctccgcagctcatcggccccactgggccgcctccggccgcctcctgtccccaccgnccgccggggggggcccgggagtcgccgactcctcttcggcacgtacttcttctcccgcgagctcgtcccgcagggtggttnctgttcccggcgtggaacccctcgccggcccctccgcgagctggcagcctatctctccggacgaacgacgtcgacgacttcgaaaagaacgcgctttggtggggcgccggccgcgcccccgagac

SEQ ID NO: 12401 - protein, 166 aa, Zea mays
  misc_feature: Ceres CLONE 1370530-F
  misc_feature (20)..(94): Pfam Name: U-box Pfam Description: U-box domain
  misc_feature (98)..(98): Xaa is any aa, unknown, or other
  misc_feature (125)..(125): Xaa is any aa, unknown, or other
MVRKETAMRLPPQHQGLEVKIPSFFRCPISLDVMRSPVSLCTGVTYDRASIQQWLDSGNTTCPATILPLPSTDLVPNLTLRSSSAPLGRLRPPPVPTXRRGGPGSRRLLFGTYFFSRELVPQGGXCSRRGTPRRPLRELAAYLSGRTTSTTSKRTRFGGAPAAPPR

SEQ ID NO: 12402 - DNA, 645 bp, Zea mays
  misc_feature: Ceres CLONE 1370532-F
  misc_feature (325)..(325): n is a, c, t, g, unknown, or other
  misc_feature (442)..(442): n is a, c, t, g, unknown, or other
  misc_feature (468)..(468): n is a, c, t, g, unknown, or other
  misc_feature (488)..(488): n is a, c, t, g, unknown, or other
  misc_feature (531)..(531): n is a, c, t, g, unknown, or other
tccccgcggtggcggccgctctagaactagtggatcccccgggctgcaggaattcgcacgagaccattacctagaacatcctaatcaaaaatttttggtctcatatcttcttctcgtccgtctcgcttctctctctcctgaggcgcagcggtggggtggggtagggccgtagggggagcggcattgcgagctcacaccacctgcggcgcggcgatcccgggccaccgactgtcgggctatgtgatgatccgggccgtgatctcgacggctattcgcggctgaacgggcggcggcgatgaacggagcgagcgccggcgtcggcggngaggcgccgctggtgtacaaggcatggaaggggaacatgtgtttctactgaaggggaggttcatatttggcccctgatgcagatccctggttatcaccatggttcctttatgtcgcngcgggtatcatcttcttgcgcgtcgntgcggaagaattgatggatnagttctctaatggtctgggaattgccggttatgatggcaccanttctattccagcaaaagatctggagcctcgggttctaatttcggggaaaagaccggggatctaactcgcaaaggccattcccccaaaaacccaaagggtttggggggaaggcaa

SEQ ID NO: 12403 - DNA, 658 bp, Zea mays
  misc_feature: Ceres CLONE 1370538-F
  misc_feature: Encodes the peptide sequence at SEQ ID NO. 12404
  misc_feature (506)..(506): n is a, c, t, g, unknown, or other
  misc_feature (525)..(525): n is a, c, t, g, unknown, or other
  misc_feature (538)..(538): n is a, c, t, g, unknown, or other
  misc_feature (599)..(599): n is a, c, t, g, unknown, or other
  misc_feature (600)..(600): n is a, c, t, g, unknown, or other
tggagctccccgcggtggcggccgctctagaactagtggatcccccgggctgcaggaattcgcacgagaccattacctagaacatcctaatcaaaagagctaccaaacgggacctgccacgtcacgtggaacgcgtcataggtgtgagtgtgagtgtgtgacactgacatctgagaccagctctcctgcttcgcggctgtctctttcatcggccacccacggcggcggagcatagtagtaagcaagcagcggagacgccggagagcggtgaagaagcatggagatggagcagctctgctcgctgctccgcgacctcgacgcgctcaagcagcatcccgacgatctcacttccaccatcgatcggatgcgggagcggctagtggcgatgatgaatccggcagccggtgccgcttctcgatccaagattaaggacatgagtgcagaagtggtggacaacaatccctacagcagactttatggcgttgcaacggatggggcgtagtggnagaattatgagcgcatcangggactactccgnttgcctcgttggcataaagggggcggttttggtaggggttgcccgcggagatgctcactannatgtggaatttttgcaacccctttggttgttgtatgactaccacccccgggtcgagtt

SEQ ID NO: 12404 - protein, 74 aa, Zea mays
  misc_feature: Ceres CLONE 1370538-F
MEMEQLCSLLRDLDALKQHPDDLTSTIDRMRERLVAMMNPAAGAASRSKIKDMSAEVVDNNPYSRLYGVATDGA

SEQ ID NO: 12405 - DNA, 662 bp, Zea mays
  misc_feature: Ceres CLONE 1370544-F
  misc_feature: Translation starting site: 197
  misc_feature (333)..(333): n is a, c, t, g, unknown, or other
  misc_feature (343)..(343): n is a, c, t, g, unknown, or other
  misc_feature (378)..(378): n is a, c, t, g, unknown, or other
  misc_feature (445)..(445): n is a, c, t, g, unknown, or other
  misc_feature (526)..(526): n is a, c, t, g, unknown, or other
aaagctggagctccccgcggtggcggccgctctagaactagtggatcccccgggctgcaggaattcgcacgagaccattacctagaacatcctaatcgaaaagcacaacacaacgcttatattacttacaacaaaagataagcccacgaatcagtagatcgaggtcccgcccagtccagcagaagcgcacacggagatgtcccagctgagccctgctggccacatggctgcgacgctcctcctcatcctcctggcctccgcagcagcagcagcggtgtcagctgaccaacaggtctctgcctgccagaatgacatagacgcactgtggcgcanctgcaagcangttcgtccagaaggaggggcccaagatgcctccgntccgaggactgctgcaaaaccatcaaggccttagacgcgcacgcgtcctgcatctgcggactacgtncggctccccggacgccaggaataagctagacctgggacaaggtgttcttcgttaccaaccagtgcggcgtcaccgtccccnaggggctgcggaatcaaagcaggactggaagagcggctggaatctgaatgggagcaagttggctaacatacgcacggcagctacaaatacttataggaataaataagttggtcaaatgttgggtttctcggggggg

SEQ ID NO: 12406 - DNA, 553 bp, Zea mays
  misc_feature: Ceres CLONE 1370547-F
aaagctggagctccccgcggtggcggccgctctagaactagtggatcccccgggctgcaggaattcgcacgagaccattacctagaacatcctaatcaaaaagttagtagttcaccagagttcacacaaaaatcacaagcaagcagtcgcgtgtgtagctcgcaacaatggcgacgtagcccggcctctttcacgagtggacgtgggagaagctcggcgaacttcagtacctgctggctgccccgtggtggctcacggcgactacaagcgcgacaaggggtggagggcggcgacctggggacgtggcatctcccgtcctggtcctcggggctggcaacacaggctgattcaccggtcccgctgataggggggcggccggggaagtgtcggtccccgtacctagtttaacagggggacccgagaggactgggacaaccaaaccggttaagggttcctcctggactgggtcccacctggggggggggggtgccgttcggggggagccccgccccattttattttttggggggagaaagcgggccccacgaggtgt

SEQ ID NO: 12407 - DNA, 651 bp, Zea mays
  misc_feature: Ceres CLONE 1370551-F
  misc_feature: Translation starting site: 253
  misc_feature (430)..(430): n is a, c, t, g, unknown, or other
  misc_feature (651)..(651): n is a, c, t, g, unknown, or other
aagctggagctccccgcggtggcggccgctctagaactagtggatcccccgggctgcaggaattcgcacgagaccattacctagaacatcctaatcgaaaagttcctttcttccccactacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatgggtgagcgtggtgtacagccagtcggactggctgccggaaggaggtcttcctcgtcgagaccatggacaacgcctccgnctccagggagtccatggcgcaccctcaaggccgtctacttcctccgaccctccgctaacaacgtcagaaaagctccgcaggcacctcgccatgcggcggcttcgccgagtaccacctattcttctccgggaaatattgaaaggtcccgcagattcaaatacttgctgactcgatgaaaaaaaggaggttgtgcagaaagggtcaggaggtctatgggcttn

SEQ ID NO: 12408 - DNA, 630 bp, Zea mays
  misc_feature: Ceres CLONE 1370552-F
  misc_feature (411)..(411): n is a, c, t, g, unknown, or other
tggagctccccgcggtggcggccgctctagaactagtggatcccccgggctgcaggaattcgcacgagaccattacctagaacatcctaatcgaaaaactgctctgctctccgagtaacttattgcgagcagcgccccaggtgaccgagcgagcgggccggcgagggctcagctttggataattcttgctccctcttgtcctttcggtttgaagctttctggagggagaagggagcacgcagctcggcgccagtgagagagaggattagaggagcgagaggaaaggggggagatcatgcttgcagagcgtgctccgtgatgcggtgagcgccgctaacctcggttgatttcttggtgggaggcgacaaacgcgtgcgtgagccgccgcttgcttgcgtaaggtggtgagancaccaggcgtgctccttccacttgtctctggttggagttcgctgtcgtcaggcatatatcacgagcaccatgcgtcgagttcttgtagctccgcagcttcctcgcttcttagatcctttgcactgggcccccctgctggtttcctctgatctccatggaggaagaaatgctgagcgtgcccatggaaggagtcccgtgcacgatgcaacgatgtgctcg

SEQ ID NO: 12409 - DNA, 638 bp, Zea mays
  misc_feature: Ceres CLONE 1370661-F
  misc_feature: Encodes the peptide sequence at SEQ ID NO. 12410
aaagctggagctccccgcggtggcggccgctctagaactagtggatcccccgggctgcaggaattcgcacgagaccattacctagaacatcctaatcgaaaactaatcgaaaagccgcatcccttctttcattcgccgccgccgcctcctctctgctgccgtcgccatggggagaaggcctgcgagatgctatcgccaaatcaagaacaagccataccccaagtccaggtactgccgtggtgtccctgaccccaagattaggatctacgatgttggcataaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccttccatgtccttcgtatcaacaagatgctttcgtgtgctggggctgataggctccagactggaatgaggggtgcctttggcaagcctcagggcacctgtgctagggtggacattggtcaggtactcctttctgttcgatgcaaggacaacaatgctgcacatgccagtgaagctctgcgacgcgccaagttca

SEQ ID NO: 12410 - protein, 157 aa, Zea mays
  misc_feature: Ceres CLONE 1370661-F
  misc_feature (5)..(157): Pfam Name: Ribosomal_L16 Pfam Description: Ribosomal protein L16
MGRRPARCYRQIKNKPYPKSRYCRGVPDPKIRIYDVGIKRKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKF

SEQ ID NO: 12411 - DNA, 651 bp, Zea mays
  misc_feature: Ceres CLONE 1370663-F
  misc_feature: Encodes the peptide sequence at SEQ ID NO. 12412
aagctggagctccccgcggtggcggccgctctagaactagtggatcccccgggctgcaggaattcgcacgagaccattacctagaacatcctaatcgaaaaaagaccaagatagaccacccaagcattgaagccgtagccgccgccgccggacgagacaggttgaggcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgttccgtcgcgtcggggctctcgttcggccacaccccggcgtccgtcatggcgacgctgtgcttcttccgcttctggctcgggttcggcatcggcggcgactacccgctgtcggcgaccatcatgtccgagtacccaacaaga

SEQ ID NO: 12412 - protein, 158 aa, Zea mays
  misc_feature: Ceres CLONE 1370663-F
MAAGDLEVLTALDTAKTQWYHFTAIVVAGMGFFTDAYDLFCISLVTKLLGRIYYTVEGSATPGTLPPHVSASVNGVAFVGTLSGQLFFGWLGDKLGRKKVYGMTLMLMVLCSVASGLSFGHTPASVMATLCFFRFWLGFGIGGDYPLSATIMSEYPTR

SEQ ID NO: 12413 - DNA, 654 bp, Zea mays
  misc_feature: Ceres CLONE 1370683-F
  misc_feature: Pfam Name: MatE Pfam Description: MatE
  misc_feature (499)..(499): n is a, c, t, g, unknown, or other
  misc_feature (500)..(500): n is a, c, t, g, unknown, or other
  misc_feature (535)..(535): n is a, c, t, g, unknown, or other
  misc_feature (604)..(604): n is a, c, t, g, unknown, or other
tggagctccccgcggtggcggccgctctagaactagtggatcccccgggctgcaggaattcgcacgagaccattacctagaacatcctaatcgaaaagaatcgttattatcagtgggctagaacatactaatgcgagtgctgtgctgctaaatctaatctgcgtgcgattggtcgatgggcaggttcggtggagatcgccgccgttggcgtttcgatcgccatatttaaccaagtctccaaggtctgcatctaccctctcgttagcgtcacaacgtcgttcgtcgcggaggaagacgcgatcatcagtaaggccgtccgaggaaacagcagccaggaggaggacgtggagaaagcctcccacgtgggctttgatccggagaccagcaatctgcatgcatctggccctgcaggtatggcagaatgcgtgaactcgtgtatccctacggagtgcgcagcagatccctctggcaggcaagggcggggcgagaaagaggtacnngtgccgtcggtcacgtcggcgctttaatagtcggnttccattctcggcctgccttcaggcccgtctttcctgggtcctttcggggccagattcggtcaaaaaancatgggggggggtgttaaagtcccggatccccgatgcaaggggggccctg

SEQ ID NO: 12414 - DNA, 592 bp, Zea mays
  misc_feature: Ceres CLONE 1370711-F
  misc_feature: Encodes the peptide sequence at SEQ ID NO. 12415
  misc_feature (194)..(194): n is a, c, t, g, unknown, or other
  misc_feature (231)..(231): n is a, c, t, g, unknown, or other
  misc_feature (264)..(264): n is a, c, t, g, unknown, or other
  misc_feature (385)..(385): n is a, c, t, g, unknown, or other
  misc_feature (386)..(386): n is a, c, t, g, unknown, or other
ggagctccccgcggtggcggccgctctagaatagtggatcccccgggctgcaggaattcgcacgagaccattacctagaacatcctaatcaaaaaagttagtagttcaccagagttcacacaaaaatcacaagcaagcagtcgcgtgtgtagctcgcaacatggcgacgaaccccggcctcttcaccgagtggnccgtgaagaagctcggcaactttcagtacctgctgcntgcgccgtgggtggcgcacggcggctaccaagncgcgaccaaggggtggaggcggccgaactgtggtaccgggcattctcccgtccttgtcctccgggggctgacaaaccagcgtggatcaccggtcccgcctgtaaaagcgcgcgggcggggnnaggtcctggacccggaatctagatccaaaaagtggaaccgaacgccaatggaacaaccgattctggtcagcggatcctcctgtactggtcacaccaggcgggggggggcagacacctccctgtggttggggggggaaaagccccttttttttcttttggtgcccgcccccccgagatttctttaaataggggtccccccggcgctc

SEQ ID NO: 12415 - protein, 136 aa, Zea mays
  misc_feature: Ceres CLONE 1370711-F
  misc_feature (12)..(12): Xaa is any aa, unknown, or other
  misc_feature (24)..(24): Xaa is any aa, unknown, or other
  misc_feature (35)..(35): Xaa is any aa, unknown, or other
  misc_feature (76)..(76): Xaa is any aa, unknown, or other
MATNPGLFTEWXVKKLGNFQYLLXAPWVAHGGYQXATKGWRRPNCGTGHSPVLVLRGLTNQRGSPVPPVKARGRGXVLDPESRSKKWNRTPMEQPILVSGSSCTGHTRRGGADTSLWLGGEKPLFFLLVPAPPRFL

SEQ ID NO: 12416 - DNA, 651 bp, Zea mays
  misc_feature: Ceres CLONE 1370717-F
  misc_feature: Encodes the peptide sequence at SEQ ID NO. 12417
  misc_feature (543)..(543): n is a, c, t, g, unknown, or other
aagctggagctccccgcggtggcggccgctctagaactagtggatcccccgggctgcaggaattcgcacgagaccattacctagaacatcctaatcaaaaaaatctctcgcacgcaaacgactagcgcaggcgcagcaaacaccccacctcgctcgcggtcgcggcacggcggcggcgatccaccgcggctcgctgccttcgccagtgatctggtctcttcgagtcccggcatcagataatcatccacagcccctcccctcctctcccagccccctcccttccccttccgctgaatcggcgcggagaggatgccgtcccggcggggcagcagcagtggccggtgctctgcgagggatccaacctgccgtcttgttgcgcctcgtgcgtcaacgcgaggctggtcgagtaccacacgaggctgcgcatgatgaggagcctccgcgactccctccacggccgaatcgccgcacgcctcgaagccaagagaaaaacacatgagcagcggatctggagaacaagcaaagaacaggataaccatgggnagtggaggaatcggctcactggaattgaagagaaaaactgccgtagacccaagaccgaaggtcgagaaggggccattcgaggtgatctcaagggcaaaaactgtggcc

SEQ ID NO: 12417 - protein, 75 aa, Zea mays
  misc_feature: Ceres CLONE 1370717-F
  misc_feature (40)..(40): Xaa is any aa, unknown, or other
MMRSLRDSLHGRIAARLEAKRKTHEQRIWRTSKEQDNHGXWRNRLTGIEEKNCRRPKTEGREGAIRGDLKGKNCG

SEQ ID NO: 12418 - DNA, 615 bp, Zea mays
  misc_feature: Ceres CLONE 1370721-F
  misc_feature (403)..(403): n is a, c, t, g, unknown, or other
  misc_feature (452)..(452): n is a, c, t, g, unknown, or other
aagctggagctccccgcggtggcggccgctctagaatagtggatcccccgggctgcaggaattcgcacgagaccattacctagaacatcctaatccaaaaacaccaacccgatctgcctccgcttcgatcatggggtgggcgcgctttcatcgccgccatcaacgatgtcgctatctcctccctatccggcgtccgtgatgatcgtcacccctcctcctccaggcgtcggacgctcgccatgcttgcatctctacactccggttcgccttgctccactttcgatctttagtcgcgagcgattgctaaaacgtccagcacgcacaagctcgccagcggtgcgatgtcccgcaacctctccgtggacgcctgatccgcgtcggcccaccatcgcctggggtgggnactcggaccaggtccgctcatgcttggaagtgcaggtctcgcacacgancgcgggcggcgtccgaactcgtggcggtttttgaaaaccgtcccggcagcggattccaattacggcttcctcaatcctcgggtggcctcgtcccattcccctcgtcaatcgaatccgagattcgcggccacgagggggataaacggtgaagtccgcccccgcc

SEQ ID NO: 12419 - DNA, 641 bp, Zea mays
  misc_feature: Ceres CLONE 1370732-F
  misc_feature: Encodes the peptide sequence at SEQ ID NO. 12420
  misc_feature (349)..(349): n is a, c, t, g, unknown, or other
  misc_feature (355)..(355): n is a, c, t, g, unknown, or other
  misc_feature (384)..(384): n is a, c, t, g, unknown, or other
  misc_feature (402)..(402): n is a, c, t, g, unknown, or other
  misc_feature (408)..(408): n is a, c, t, g, unknown, or other
  misc_feature (413)..(413): n is a, c, t, g, unknown, or other
  misc_feature (425)..(425): n is a, c, t, g, unknown, or other
  misc_feature (428)..(428): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (461)..(461): n is a, c, t, g, unknown, or other
  misc_feature (462)..(462): n is a, c, t, g, unknown, or other
  misc_feature (465)..(465): n is a, c, t, g, unknown, or other
aaagctggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggncccggncacatccaagccgcccgctccggcccggncacacccaagccggcgcntccggnccggncacacccagcgnccnccaagggnnnaagaaaaaagccnnnnggccccnnggnggaccttcacggcgtccccgggagggggtaaaggggaggcccggggttgggaaccaacggtcccacgggggggggtccggatggccgtcccccaggggggggccaagttcgcttggttttatccccgggaaaagccccccacctgggccaaagggaaagttttttccgaggatccg

SEQ ID NO: 12420 - protein, 137 aa, Zea mays
  misc_feature: Ceres CLONE 1370732-F
  misc_feature (40)..(40): Xaa is any aa, unknown, or other
  misc_feature (42)..(42): Xaa is any aa, unknown, or other
  misc_feature (52)..(52): Xaa is any aa, unknown, or other
  misc_feature (58)..(58): Xaa is any aa, unknown, or other
  misc_feature (60)..(60): Xaa is any aa, unknown, or other
  misc_feature (69)..(69): Xaa is any aa, unknown, or other
  misc_feature (70)..(70): Xaa is any aa, unknown, or other
  misc_feature (74)..(74): Xaa is any aa, unknown, or other
  misc_feature (75)..(75): Xaa is any aa, unknown, or other
  misc_feature (78)..(78): Xaa is any aa, unknown, or other
  misc_feature (79)..(79): Xaa is any aa, unknown, or other
MGAVTSTVAARFAFFPPSPPSYGFEQPAPLPAPATPEPPXPXTSKPPAPARXHPSRRXRXGHTQRPPRXXEKSXXAPXXTFTASPGGGKGEARGWEPTVPRGGVRMAVPQGGAKFAWFYPREKPPTWAKGKVFSEDP

SEQ ID NO: 12421 - DNA, 707 bp, Zea mays
  misc_feature: Ceres CLONE 1370740-F
  misc_feature: Encodes the peptide sequence at SEQ ID NO. 12422
  misc_feature (417)..(417): n is a, c, t, g, unknown, or other
  misc_feature (439)..(439): n is a, c, t, g, unknown, or other
aaagctggagctccccgcggtggcggccgctctagaactagtggatcccccgggctgcaggaattcgcacgagaccattacctagaacatcctaatcgaaaaactagttgttcgttcccaccgcaagcaaagcattttcagccgccccaccgcagcagcagagaagaggccgccgccgccgcgaccaagagccgatggatccgaagatgacagaggtgacccagatgttcgcccgcttcaaggcggcctacacccgcaacgacctcgacgcctgcgtcaccctcctctcacagctcaaggtccatctcaccaaattccccagccttccgccctcatttgagcagacacctaaagccgtggaggagctcaaacttgcaagggacatttatgagcatgctggtgttttgagtgtgaaancttgaggacaaagatgcatttngaacgtgatttctgtcagctaaagcccttattacatggatacatgggggcttaattccccccctccaccaagggggaccccaattttgggacctaaatctttcgagggttgttgtgttcaaaaagaaattggtggggttccaaacgggcgtggagcttttacctggaaagggacttgtgaaccccttttttaaaaaagggggggaaaatttggggaaatccctttgggggggggggcccaaccccaggtgttaaaggccccgaaaagg

SEQ ID NO: 12422 - protein, 74 aa, Zea mays
  misc_feature: Ceres CLONE 1370740-F
MDPKMTEVTQMFARFKAAYTRNDLDACVTLLSQLKVHLTKFPSLPPSFEQTPKAVEELKLARDIYEHAGVLSVK

SEQ ID NO: 12423 - DNA, 666 bp, Zea mays
  misc_feature: Ceres CLONE 1370746-F
aaagctggagctccccgcggtggcggccgctctagaactagtggatcccccgggctgcaggaattcgcacgagaccattacctagaacatcctaatcgaaaatctctccgatcggatgaaaacttcaacagattggtatgagctcctgaacgttgtagtttatcttcgcttttcgttatcttcttcgattccgtctcgaattttgaattgatgattctccttatttcatcggaagcatcgaggatttggagattacgaatcttttgatccgatcaaacgttggagcctcttcagataaagtagaatgagtagaaaaagagcagaaaatgacactgagtcaggatcaggaacagccactccggtggatagattcgggttcctgaagcaagaacatgccagcaaggctagaacaacaacaacatcatcatccactgaccaggacagagaggagagaaaagtgaggaaatggaggaagatgattggggttggaggcagtgactggaagcattacgttagaaggaaacctaacgttgtcaagaggcgtatacgcaaagggatccctgattgtttaagaggtcttggtttggcagttgatctctggaagccgcgaccttttgcttatgaaatcctggtgttatggagcaactggtgatttatgagacatcg

SEQ ID NO: 12424 - DNA, 733 bp, Zea mays
  misc_feature: Ceres CLONE 1370746-R
  misc_feature (713)..(713): n is a, c, t, g, unknown, or other
ccaattgggtaccgggccccccctcgaggtcgacggtatcgataagcttttttttttttttttttatttttttacctttttcacataaataataatgagatttttttacaagcacaagtcactatacctacacaaaggtgggtgggacatataccttcttcttctttcccagaagttgctaagaagaatcagagggtgtctgataaagagattcccacccaacttgaccaatatgatgatagaaagaatacattccaataagataaagataagggaggagtaaagaatttgaatccaagctgatgtgtacaggttattagtcaaaccggttttcttatggttgaacaggtttggcaatagtcttctcatagtccactttcagttcttccaaacgctttgataccttgatggggtaggccaatggaagcaaggtatccggattcattgcatcttcagggaatgttttcagagcatgtatgagtttctcaaacggtaattttaccagctcatcttggcaatacttcaacaatgctaagcccactttgaacactattttaactccctcagagagtgacacatcccatatccgaagagcctaaggcaaaggaaacgaataacagtagacggtgatgaaccattggcttgcatacatactcggactgatcatctcttgagtacaatgctctccgagctctggaatagctcctttaccnagctttctaactgaaacagg

SEQ ID NO: 12425 - DNA, 626 bp, Zea mays
  misc_feature: Ceres CLONE 1370754-F
  misc_feature: Encodes the peptide sequence at SEQ ID NO. 12426
  misc_feature (521)..(521): n is a, c, t, g, unknown, or other
  misc_feature (603)..(603): n is a, c, t, g, unknown, or other
aaagctggagctccccgcggtggcggccgctctagaactagtggatcccccgggctgcaggaattcgcacgagaccattacctagaacatcctaatcaaaaagttcaacgttcaaacccttgcagctccctctcccttggtcgcgcagtcgccattcacgaccccgaccccgacccccgacccccgtccccctctcttaaatcccacctctccccgtctacgcctcattcgctccagctcgcatcccacagccaagccagttagcccgggagatctccaagaaaccatcttggaatccgagaacgcccagcattcttggtcggccaaggattcgaattccgacgaacggcttctacggccgaaaaaagtccgataatttccgcggggagctcaggaggtgtctcggtctcgggaaccggaggaggaggccgtgggggattgacgagggggcaagatggtgaggctgccgtacacaacggcgttgaccacgctgttcagctacggcctgctcttcgccttgngcaggctcagggatttcttccgcaagttcgtcgactggttcaggccaagaacgtcaaggggtacgcgccgatctgccggggncctggaggatttctatgtgcgaa

SEQ ID NO: 12426 - protein, 57 aa, Zea mays
  misc_feature: Ceres CLONE 1370754-F
  misc_feature (23)..(23): Xaa is any aa, unknown, or other
  misc_feature (50)..(50): Xaa is any aa, unknown, or other
MVRLPYTTALTTLFSYGLLFALXRLRDFFRKFVDWFRPRTSRGTRRSAGXLEDFYVR

SEQ ID NO: 12427 - DNA, 664 bp, Zea mays
  misc_feature: Ceres CLONE 1370758-F
  misc_feature: Encodes the peptide sequence at SEQ ID NO. 12428
  misc_feature (475)..(475): n is a, c, t, g, unknown, or other
  misc_feature (477)..(477): n is a, c, t, g, unknown, or other
aaagctggagctccccgcggtggcggccgctctagaactagtggatcccccgggctgcaggaattcgcacgagaccattacctagaacatcctaatcgaaaagacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgagggaggactacgtccagaacgccgtcaagtttctctcccaccccaaggtcaggggctcccccgtcgtctacaggcgatccttcctcgagaagaagggccttagcaccgaggagatcgacgaggccttccgaagggttcctgatcctcaacccagcactacggctaccacttctccgcagcagcaggtcaacagccagatccantnccgtcggggtgcaagcttatgcgccagcacaacctgtgcacccagcaaacgctgggccctgtcgtccttccaacgcagccaaaggtttagctggtaccaagcattccctggctgcagggctcttgtgctttgggttttggtgcttagcgctgctgtcttaatcaagaaactgttccttcctaggctc

SEQ ID NO: 12428 - protein, 168 aa, Zea mays
  misc_feature: Ceres CLONE 1370758-F
  misc_feature (37)..(135): Pfam Name: Pex14_N Pfam Description: Peroxisomal membrane anchor protein (Pex14p) conserved region
  misc_feature (105)..(105): Xaa is any aa, unknown, or other
  misc_feature (106)..(106): Xaa is any aa, unknown, or other
MASGIGSGQQQPPAPAADADPGAVGDKLVFEAPPQPVREDYVQNAVKFLSHPKVRGSPVVYRRSFLEKKGLSTEEIDEAFRRVPDPQPSTTATTSPQQQVNSQIXXRRGASLCASTTCAPSKRWALSSFQRSQRFSWYQAFPGCRALVLWVLVLSAAVLIKKLFLPRL

SEQ ID NO: 12429 - DNA, 654 bp, Zea mays
  misc_feature: Ceres CLONE 1370759-F
  misc_feature: Translation starting site: 499
  misc_feature: Pfam Name: Pex14_N Pfam Description: Peroxisomal membrane anchor protein (Pex14p) conserved region
aaagctggagctccccgcggtggcggccgctctagaactagtggatcccccgggctgcaggaattcgcacgagaccattacctagaacatcctaatcgaaaagacaccttctccgttcccgacgactcccgtgagcgtggagcggggactaggtgaggacatggactccggcatcggctccggccagcagcaacccccagcggcggcgtaagatgctgacccgggagccgtcggcgacgagttcgtcttcgaagagccgcctcagtccgtgagggaggactacgttcagaacgccgtctagtttctctcccaccccaaggtcaggggattcccccgtcgtctacaggtgatccttcctcgagaagaagggccttaacaccgaggagatcgacgaggcgcttccgaagggttcctgatcctcaacccagcactacggctaccacttctccgcagcagcaggtcaacagacagaatccattcccgtcggggtgcaagcttatgcgccagcacaacctgtgcaccagcaaacgctgggccctgtcgtccttccaacgcagccagggttttagctggcaccaagcattcctggctgcgagatcttgcattgagggtttgggcgcaaaagggtgctgtcttaattcagtaactgttctt

SEQ ID NO: 12430 - DNA, 626 bp, Zea mays
  misc_feature: Ceres CLONE 1370775-F
  misc_feature: Encodes the peptide sequence at SEQ ID NO. 12431
  misc_feature (508)..(508): n is a, c, t, g, unknown, or other
tggagctccccgcggtggcggccgctctagaactagtggatcccccgggctgcaggaattcgcacgagaccattacctagaacatcctaatcgaaaaattatattagtttggtagtttagtgacgctgaggcctcgtccccgatcagacttgttcggcctcttcgacggcgtgcccgtctccccgggctcattcgccatgcattcctcagcctccgcgagaggaggacgagggctcctcttgccggcggcggttgtggtgctactgttgggtgcagtggcgccagcggcgggttgctatccgcgcgtgttcaacttcggggactctctggcggacacgggcaactacccgttcgtctatggcaacggctcagccaagctccgtccaccatacggcgagaccttcttccaccgcgccaccgggcgcgcctccaacgggcgccctagtggtggacttcatcgcggacacactccggcctcccgttcgtgcgaccgtatctgagcggacgnagcgcgaggggacttccgcgggcgggcccaaatttccccccgtggggcggcgccacggcggctcagcccggacttcttcgggggggcaaggggggttccacaacatgggggaaaccga

SEQ ID NO: 12431 - protein, 100 aa, Zea mays
  misc_feature: Ceres CLONE 1370775-F
  misc_feature: SWISSPROT Homolog: EC 3.2.1.51 Alpha-L-fucosidase
MHSSASARGGRGLLLPAAVVVLLLGAVAPAAGCYPRVFNFGDSLADTGNYPFVYGNGSAKLRPPYGETFFHRATGRASNGRPSGGLHRGHTPASRSCDRI

SEQ ID NO: 12432 - DNA, 631 bp, Zea mays
  misc_feature: Ceres CLONE 1370777-F
  misc_feature: Translation starting site: 165
  misc_feature (381)..(381): n is a, c, t, g, unknown, or other
  misc_feature (433)..(433): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaagggcaagatggacaaggaggaggaggacgaggcgaagggcgcggagaagatgtgcggcatctgcctatctcgacggccggcgggccatccgcggcgagctcgactgctgcgcccatttcttttgctttgtctgcatcatggcttggggccgcgcnaaagtcccgctgtcccttctgcagggcccgcttccacaccatccgccgccgncccgtcggccggccggttccccgacgagcgaatcgtctcgatccaagagcgcaaccaggtacaccatcctcagggcaacgggagcagcaagngggggcggagatccttacgtgaaaccaattgggcacggtttgcagcagctccagcgatgactagctgctgctactctgcgagctctgcgactcagctgacacactt

SEQ ID NO: 12433 - DNA, 629 bp, Zea mays
  misc_feature: Ceres CLONE 1370779-F
  misc_feature: Encodes the peptide sequence at SEQ ID NO. 12434
aagctggagctccccgcggtggcggccgctctagaactagtggatcccccgggctgcaggaattcgcacgagaccattacctagaacacctaatcgaaaatcattactgacaagcgcctgagcagagagggagagttagaacacacagggggagagtgcttctccttccctctgatgaatccggcggactttgcctgtctgctgctctgctatctgctccccgccggccccggcctccgcgcgaggacatcgtctccccgcagtccggcctcgtcgccgaggtcctcgccctcttcctcgccaacttcgtcggcgacgacgagcccgacgtgcagctagagtttcaggcgctgctggcgatcgacaacccggtgcaccacatgcgcgccatagcgctctcgcgcctctaccggatggccaacgccttcctccactccatcctcttccgggacctcgcgctccgcgaccttctccgcgccgtacgggcgccgtgtcgtctacttcctcagcgccataatcaacttcctccactacaggcaggataagctcagctttcttgagcccatcgtccaagagtacagcccccttcaggaacggcacacggagctcagggctaagatcgccgagct

SEQ ID NO: 12434 - protein, 54 aa, Zea mays
  misc_feature: Ceres CLONE 1370779-F
MRAIALSRLYRMANAFLHSILFRDLALRDLLRAVRAPCRLLPQRHNQLPPLQAG

SEQ ID NO: 12435 - DNA, 639 bp, Zea mays
  misc_feature: Ceres CLONE 1370785-F
  misc_feature: Encodes the peptide sequence at SEQ ID NO. 12436
aaagctggagctccccgcggtggcggccgctctagaactagtggatcccccgggctgcaggaattcgcacgagaccattacctagaacatcctaatcgaaaaaccagctttccccttctctacggtccgagaatcgaaagctcacggcagaagccatggcgcagacgcatcttttgttgctcgcttgcttctgggtcctgccaacatgctccttgctacttgatgcttcctccgatggactgtctaataatcagcctgaacaagaagagactggaccaggaagctttgactgctgcgaagttggcgaaaaaggagagcaagcttctaaggtctgtgtgcgctgaccagaatctcagtgcctcatctgatgacataggccctttggacaactacctggacacccagtactttggacagatcagcatcggcacgccaccacagaacttcacagcgatattccacactggaagctccaacttgtggcttccctcatccaggtgctacttttcgatagcatgctacttacaccacagatacgagtcaaccaagtcgaagacttacgacaggaatggagaatcttgtacgataacatatggttctggggaaatcctggctgcttcaggggggggacaatgtgtg

SEQ ID NO: 12436 - protein, 135 aa, Zea mays
  misc_feature: Ceres CLONE 1370785-F
  misc_feature: SWISSPROT Homolog: EC 3.4.23.40 Phytepsin
MDCLIISLNKKRLDQEALTAAKLAKKESKLLRSVCADQNLSASSDDIGPLDNYLDTQYFGQISIGTPPQNFTAIFHTGSSNLWLPSSRCYFSIACYLHHRYESTKSKTYDRNGESCTITYGSGEILAASGGGQCV

SEQ ID NO: 12437 - DNA, 669 bp, Zea mays
  misc_feature: Ceres CLONE 1370912-F
  misc_feature: Pfam Name: PGK Pfam Description: Phosphoglycerate kinase
  misc_feature: SWISSPROT Homolog: EC 2.7.2.3 Phosphoglycerate kinase
  misc_feature (492)..(492): n is a, c, t, g, unknown, or other
aaagctggagctccccgcggtggcggccgctctagaactagtggatcccccgggctgcaggaattcgcacgagaccattacctagaacatcctaatcgaaaaactcgaagcacatcctgtcgtatcccatgccaataccacccatctcgactcccgtcgattctagccgtttcttccaacccaagatctgtgatggcgaggaagaggaccgcgcatgccctcggcgagggggatctgatcgtgaagaaggtgtttccgggtccccacctcgactgttcctctcaacgacgcccagaagatcaccgacaacacccgcatccacgcctccgtccccaccatctggttcctcctcaagaagggcgccaaggtcatcctcgacaggcacctgcgtcgaacaaaaagtgtcacaccaaaggacagcttgaagactcttgatctaagcttgtctgagatccttgcagttgaatgcacgatgaccaatgattgtcttgnatgaggagagtgcacaagttggctgcctgctttgccacaaggtgcagttctgctactacagaatgtgacattctacgatgacgacgacgaagaactgacctgagattgctaacaagataacatctgttgctgacctttatgtcaatgatggcttttggaactgcacacgcagctcat

SEQ ID NO: 12438 - DNA, 676 bp, Zea mays
  misc_feature: Ceres CLONE 1370929-F
  misc_feature: Encodes the peptide sequence at SEQ ID NO. 12439
  misc_feature (468)..(468): n is a, c, t, g, unknown, or other
  misc_feature (533)..(533): n is a, c, t, g, unknown, or other
  misc_feature (614)..(614): n is a, c, t, g, unknown, or other
  misc_feature (667)..(667): n is a, c, t, g, unknown, or other
  misc_feature (668)..(668): n is a, c, t, g, unknown, or other
aaagctggagctcaccgcggtggcggccgctctagaactagtggatcccccgggctgcaggaattcgcacgagaccattacctagaacatcctaatcgaaaaatccatcacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcagaggcccgnttccgggggggggcggcgtcagcatggccaacgccgccaacatcccctccaagtgcggcgtcttnccgtcggcgtgcccatcagcccccaccgtcgactgcaccaagatcaactgatcgatggaaccacatagtggaggtagctcngctcgttggatgggcagcgtacgtagccatcagcagcatggcagtcgtcgtcnnaagcagag

SEQ ID NO: 12439 - protein, 131 aa, Zea mays
  misc_feature: Ceres CLONE 1370929-F
  misc_feature (39)..(119): Pfam Name: Tryp_alpha_amyl Pfam Description: Protease inhibitor/seed storage/LTP family
  misc_feature (94)..(94): Xaa is any aa, unknown, or other
  misc_feature (115)..(115): Xaa is any aa, unknown, or other
MAARSSSSQPQLVAAAAVLAAALLLLAAGAGTASAAVSCGEVTSSVAPCLGYAMGSAASPSAACCSGVRSLNSRASSTADRQATCNCLKSRGPXPGGGGVSMANAANIPSKCGVXPSACPSAPTVDCTKIN

SEQ ID NO: 12440 - DNA, 644 bp, Zea mays
  misc_feature: Ceres CLONE 1370934-F
  misc_feature: Encodes the peptide sequence at SEQ ID NO. 12441
  misc_feature (411)..(411): n is a, c, t, g, unknown, or other
  misc_feature (490)..(490): n is a, c, t, g, unknown, or other
tccccgcggtggcggccgctctagaactagtggatcccccgggctgcaggaattcgcacgagaccattacctagaacatcctaatcgaaaaagcagtccgatagccaggaagcccgtgcacgtcgaccgacgtacgccaccatgccggggctcaccataggcgacaccgtccccaacctggagctggactccacccacggcaagatccgcatccacgactacgttggcgacggctacgctatcatcttctctcacccagccgacttcacgcccgtgtgcacgacggagatggcggcgatggcggggtacgccaagggagtcgagaagcgtggcgtgaagctgctgggcatctcgtgcgacgacgtggagtcgcacaggcagtggaccaaggacgtgaaggcgtacggcggnaagcagcagcagcagcagcatacgacgacgaagggtgacgtcccaatcctggcggacccggggggggacgccattcggnagctggacatggtggaccccaacaaaaagggaccggggggggggagaatgccgtccggggggtttccaggtttttcggccccaaaaaggcccgggaaatttaattttctctggacccgggcccccacgggggggaaaatggaccaaagggtgtc

SEQ ID NO: 12441 - protein, 167 aa, Zea mays
  misc_feature: Ceres CLONE 1370934-F
  misc_feature (6)..(166): Pfam Name: AhpC-TSA Pfam Description: AhpC/TSA family
  misc_feature: SWISSPROT Homolog: EC 1.11.1.15 Peroxiredoxin
  misc_feature (117)..(117): Xaa is any aa, unknown, or other
MPGLTIGDTVPNLELDSTHGKIRIHDYVGDGYAIIFSHPADFTPVCTTEMAAMAGYAKGVEKRGVKLLGISCDDVESHRQWTKDVKAYGGKQQQQQHTTTKGDVPILADPGGDAIRXLDMVDPNKKGPGGGRMPSGGFPGFSAPKRPGKFNFLWTRAPTGGKMDQRV

SEQ ID NO: 12442 - DNA, 636 bp, Zea mays
  misc_feature: Ceres CLONE 1370937-F
  misc_feature: Encodes the peptide sequence at SEQ ID NO. 12443
  misc_feature (190)..(190): n is a, c, t, g, unknown, or other
  misc_feature (325)..(325): n is a, c, t, g, unknown, or other
  misc_feature (326)..(326): n is a, c, t, g, unknown, or other
tccccgcggtggcggccgctctagaactagtggatcccccgggctgcaggaattcgcacgagaccattacctagaacatcctaatcgaaaaattgaatccattctaccgctgctcctcctccttgctctgccgagaagccggcgatgaggggccgcaagaggcagcaggtgagcgccagctcggccgcgncgctggtgaaggggagggagagcaccaagcagaaggagaaagaagctaggaaggagaaggaggcgagggaggccggcagggagccggcggcgaaggagaggcagagaggcggcagggccgggaaggagaagaggnnaaacccggccgcagaggtgaaggagccagccaaggagaaggaggtcagggaagagggcaaggagaacgacaagcacaaggagaaggcgaagacgaaggccaacgtctgcccgcagttcttcaaggtcttcttccccgagcagtccacggagcggctgagaatcccaaccatgttcaaccagcacctcaaggagcagcagccaaccggagcagtttccctgagaggcccgagcggcaacagatggcaggcagcgctcgcttcagagtccgagtcggaggccgcgtggtgcttctagcagggctggaaggag

SEQ ID NO: 12443 - protein, 158 aa, Zea mays
  misc_feature: Ceres CLONE 1370937-F
  misc_feature (16)..(16): Xaa is any aa, unknown, or other
  misc_feature (61)..(61): Xaa is any aa, unknown, or other
MRGRKRQQVSASSAAXLVKGRESTKQKEKEARKEKEAREAGREPAAKERQRGGRAGKEKRXNPAAEVKEPAKEKEVREEGKENDKHKEKAKTKANVCPQFFKVFFPEQSTERLRIPTMFNQHLKEQQPTGAVSLRGPSGNRWQAALASESESEAAWCF

SEQ ID NO: 12444 - DNA, 724 bp, Zea mays
  misc_feature: Ceres CLONE 1370943-R
  misc_feature (19)..(19): n is a, c, t, g, unknown, or other
ccgggccccccctcgaggncgacggttacaataagcgtttttttttttttttttttcccccaacaatgtattgattatttctaggaaacacatgtcggtatgagggcaccattgtccagtacttctcatatgtaatctaaaagatggcacctccaacgatgggttgctgcaaggcagggttcatcaaagagaactggttgtatggcaccaattgttgttgctgctccaagaaggtagcgaccaatgggttagccactgccaatggattaatttactgttgtccctgttgtaggtacacaccagagtttgacacctccagttggttgaatggaagcaactgttgtaagaaggcagtacggcttgccacaactagctgagtcacagctagtacaatttgttgcaacaactgttggtgtatggacccaagtacattgcccaccgccagcgggctatattaaacctcttgtatgtatacggcaagggtcaccatggctagttgactgaccactgccctaaactgttgcatctgttactgttgctggtatgcagctacattcaccagaccaagcgggttggatgcctgcagctgctgttgcaagtaagcgacctggttcaccacggctatgaggctcactgatggaccacactggagttcttcttgctgcattacaatggaatgtagggtcagatgtgccaacgattggtgttgcaattgagcaattgg

SEQ ID NO: 12445 - DNA, 660 bp, Zea mays
  misc_feature: Ceres CLONE 1370954-F
  misc_feature: Translation starting site: 218
caaagctggagctccccgcggtggcggccgctctagaactagtggatcccccgggctgcaggaattcgcacgagaccattaccagaacatcctaatcgaaaacttacactctccttttgtcaccttctcttcgttcccctcctcggctcctcgcgatccttctttactgcccgagagttctgactagccacatccagtcaagcagtaaaggcgcaccatggaggcggcggcggagaataaggaggccgagcaggagcagcagcagctaccgcacgcgcggaaggataacgcgcccgccgccgccgaggaagacgaagcggattcggaggagaccgagcgccgcaaccgcgacctcaagtccggccttcacccccttaggcacaaactcgtgctctggtacactcgccggacgcctggagcgaggtcgcagtcgtacgaggacaacatcaagaagtatcatcgatttcagcacagtcgaatcggttctgggtttgctactgccaccttgcgcgaccttcttccctgccgagccccactgaccttcatctcttcaaggatggcatccgtcccactctgggaggatcctgcaaaccagaatggaggccagtggataattagattcataaggcagattcaggtcgatgttgggcaagatctggt

SEQ ID NO: 12446 - DNA, 657 bp, Zea mays
  misc_feature: Ceres CLONE 1370963-F
  misc_feature (143)..(143): n is a, c, t, g, unknown, or other
  misc_feature (511)..(511): n is a, c, t, g, unknown, or other
  misc_feature (514)..(514): n is a, c, t, g, unknown, or other
acaagctgggagcttccccgcgggggcggccgcttctaagaactaagtgggacccccgggcttgcaggaatttcgcacgagaccatttaacctaagaacattcctaatcgaaaaatagttcggtgcctttttttctagcgggngaggaggcaggcggcgcgatctggcaccggccatcacgttccctcccgccgcttccccctccctgccctcccgttccccagatctgaagccattaaaaccagcggatctcacctcggggcgcgtccgcggcatctgggcaagcgagtggtagagccagcagccatgagatggtatgcatcggtagcctcctgagggcgctggtcctgagtgcggcggcgtctgcgggcaggcgccgggggcccaggatcctgtgtggccacggagcggatgtacgcgtgactcctcggcacggacacggctggcgcggattccgggcagtcacgggaaggatgatgctggactcctctgactgtgcctctgctgccgncgncgcggaagcggggcaagtgcagccgcagcgccgccgcggggggggccctggccctggcgcacgaccgcggctacgccagcggcggatgggaaaaaagaagatgccaaactggattggggatacttcaagttttagagcaagag

SEQ ID NO: 12447 - DNA, 646 bp, Zea mays
  misc_feature: Ceres CLONE 1370985-F
  misc_feature: Pfam Name: TBC Pfam Description: TBC domain
  misc_feature: SWISSPROT Homolog: EC 3.1.2.15 Ubiquitin thiolesterase
aaagctggagctccccgcggtggcggccgctctagaactagtggatcccccgggctgcaggaattcgcacgagaccattacctagaacatcctaatcgaaaatctctccgatcggatgaaaacttcaacagattggtatgagctcctgaacgttgtagtttatcttcgcttttcgttatcttcttcgattccgtctcgaattttgaattgatgattctccttatttcatcggaagcatcgaggatttggagattacgaatcttttgatccgatcaaacgttggagcctcttcagataaagtagaatgagtagaaaaagagcagaaaatgacactgagtcaggatcaggaacagccactccggtggatagattcgggttcctgaagcaagaacatgccagcaaggctagaacaacaacaacatcatcatccactgaccaggacagagaggagagaaaagtgaggaaatggaggaagatgattggggttggaggcagtgactggaagcattacgttagaaggaaacctaacgttgtcaagaggcgtatacgcaaagggatccctgattgtttaagaggtcttgtttggcagttgatctctggaagccgcgaccttttgcttatgaatcctggtgtttatgagcaactg

SEQ ID NO: 12448 - DNA, 576 bp, Zea mays
  misc_feature: Ceres CLONE 1370987-F
  misc_feature (339)..(339): n is a, c, t, g, unknown, or other
aagctggagctccccgcggtggcggccgctctagaactagtggatcccccgggctgcaggaattcgcacgagaccattacctagaacatcctaatcgaaaagcgtttctttaccctaagcttttagctggtccaacgaaaggcacacagcccgacagccgccgctgtttcttcatcttcctcgcagcgccggcgctccttcttccgctccctctccgattcgcgatcggacgcacgcggacggctggaggcagctcgtgctcggactctcagcgacagggggcagcccacactcgtgcgcagggagttcgcggaccaatttacgcctgtaacttagcgnctactgcacggcgcctctggacatacgaacaccgacaggttgacgtagagtgacgacttccgatcacgccagtcgtcagtgaaaccgacgaatactgattgggcccttcaactttgcaaaaaacgatggcaatttgaaggggcccagggaaaaagaaagaaatcccttgggtgggtttcacggcggaaatggatcccttccggtctttaaaaatgggagaaaaaaagccggacattt

SEQ ID NO: 12449 - DNA, 666 bp, Zea mays
  misc_feature: Ceres CLONE 1370997-F
  misc_feature (217)..(217): n is a, c, t, g, unknown, or other
  misc_feature (221)..(221): n is a, c, t, g, unknown, or other
  misc_feature (223)..(223): n is a, c, t, g, unknown, or other
  misc_feature (224)..(224): n is a, c, t, g, unknown, or other
  misc_feature (398)..(398): n is a, c, t, g, unknown, or other
  misc_feature (637)..(637): n is a, c, t, g, unknown, or other
gctggagctccccgcggtggcggccgctctagaactagtggatcccccgggctgcaggaattcgcacgagaccattacctagaacatcctaatcgaaaaacacttattagcttcctaatttcaattattgtatttcagtcgagttgctaaacaacacgaactcagtcgtttgagttttgaggaggcaagcaagaggacccatcgatggcctccttgnaagnannaccactgggttgccgtgggtggcagcagttgtagtggcgatctgcttcgtcgtcctcgccgccgccctcccttcgcatgcgtcgacggcggtggacgagccggcgaagtataagcccagcaggggcgcccagcgcccgtccccctgggcatctgcaatcatccaatccctaacntcccggccggcgggtccaggccggtgatcgtcggtccaggggcgttcatcttaactggcaaggtcctgtgcaaggctctcagggggttaccaaaaaggcggagtgggaagccgttcccttcttccccaatgggaaagggcaagcctggggggggtacgggcgaccccgaaaaaacaaattacccggggggttgaaaacaaaaagaagaaagggggcccccgaaaaaaaaaaaagggggnatttttttttttctccggggggggggggg

SEQ ID NO: 12450 - DNA, 617 bp, Zea mays
  misc_feature: Ceres CLONE 1371001-F
  misc_feature: Encodes the peptide sequence at SEQ ID NO. 12451
  misc_feature (141)..(141): n is a, c, t, g, unknown, or other
tccccgcggtggcggccgctctagaactagtggatcccccgggctgcaggaattcgcacgagaccattacctagaacacctaatcgaaaatcattactgacaagcgccagagcagagagggagagatagaacacacaaggnggagaggggtggggaagggaaggcgaagggaggcgcactcgtcccgtctggtgctctggtatcgtctccccccggcagggaaggagtagaaggaagagaagtacgtaggaggaggaggggagaatgcgtgtcggcggcgggcgggacgacgacgacgaggtgtcccggaagctcaagagcatggacgtggacaagctggagaacggcggcagggaggagagcccgcggcccgccgtcaagtaccacggctggaaggccatgccgttcatcatcgggaacgagacgttcgagaagctggggacgctaggcacgtcggcgaacctgctggtgtacctgacgcaggtgttccacatgcggagcgtggacgcggcgacgctactcaacgggctcaacggcaccaccagcctcgcccccatcatcggcgccttcctctccgacgcctacctcggccgctacctcgcgctcgccatcgcctc

SEQ ID NO: 12451 - protein, 117 aa, Zea mays
  misc_feature: Ceres CLONE 1371001-F
MRVGGGRDDDDEVSRKLKSMDVDKLENGGREESPRPAVKYHGWKAMPFIIGNETFEKLGTLGTSANLLVYLTQVFHMRSVDAATLLNGLNGTTSLAPIIGAFLSDAYLGRYLALAIA

SEQ ID NO: 12452 - DNA, 664 bp, Zea mays
  misc_feature: Ceres CLONE 1371005-F
  misc_feature (349)..(349): n is a, c, t, g, unknown, or other
  misc_feature (357)..(357): n is a, c, t, g, unknown, or other
aaagctggagctccccgcggtggcggccgctctagaactagtggatcccccgggctgcaggaattcgcacgagaccattacctagaacatcctaatcgaaaaatattcgccaacaaactcatttcccgtctccacttgttcctcctctgtgctctcgcctttccattcctccaccggcctcatcccccaactccgtcgagcattaccgtcagagggcggcggcgcggcgcggcgccgccggcgacggggaccgcgtgaggcaggatcacctcaaggctcgtcctcatcgtcgtgaggcgtcgccgctgccccgccatctggggctgcgtcgcgtgcaggagacagctgnagatccgnccgtctctgcttggattgcttccttctcccgagagggtatgagcgatgtactcaccaaaacagagtctagttttgaccaaatcccaactcgggtacacacagcagcaaatgggaattacttggggcaacatgggccctggtaatggagaaaaaaccataccacatgggtggaaagaacccttaccctggaaaatgaactgaatgaaaaattgttcagggttaactcacctgggggcccggaagggacaccccaaagggttggaaaaatatgggggaaaagggtaaacaaaacccggtaaaagacttt

SEQ ID NO: 12453 - DNA, 629 bp, Zea mays
  misc_feature: Ceres CLONE 1371014-F
  misc_feature: Encodes the peptide sequence at SEQ ID NO. 12454
  misc_feature (509)..(509): n is a, c, t, g, unknown, or other
aaagctggagctccccgcggtggcggccgctctagaactagtggatcccccgggctgcaggaattcgcacgagaccattacctagaacatcctaatcgaaaaatgggtaattcctcgctcccggattcagcgtcgggtttctctctctctctctacaattatcactacctgctgctccctcatgcaccgtgctcaaatctgaccaaagtgggttctgctgactgttttttgtgtttttttggggtctctcgatcttctctggatgcaggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcangaaccctgaggaaatcccgtggggtgaggctggcgctgagtatgtcgtggagtcccacggcgtcttcactgacaaggacaggctgctgacatctcaaggtggtgccaagaaggttgtatt

SEQ ID NO: 12454 - protein, 175 aa, Zea mays
  misc_feature: Ceres CLONE 1371014-F
  misc_feature (58)..(175): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (136)..(136): Xaa is any aa, unknown, or other
MGNSSLPDSASGFSLSLYNYHYLLLPHAPCSNLTKVGSADCFLCFFGVSRSSLDAGKIKIGINGFGRIGRLVARVALQSEDVELVAVNDPFITTDYMTYMFKYDTVHGHWKHSDITLKDSKTLLFGDKPVTVFGIXNPEEIPWGEAGAEYVVESHGVFTDKDRLLTSQGGAKKVV

SEQ ID NO: 12455 - DNA, 624 bp, Zea mays
  misc_feature: Ceres CLONE 1371017-F
  misc_feature: Encodes the peptide sequence at SEQ ID NO. 12456
  misc_feature (160)..(160): n is a, c, t, g, unknown, or other
  misc_feature (164)..(164): n is a, c, t, g, unknown, or other
  misc_feature (171)..(171): n is a, c, t, g, unknown, or other
  misc_feature (172)..(172): n is a, c, t, g, unknown, or other
  misc_feature (191)..(191): n is a, c, t, g, unknown, or other
  misc_feature (230)..(230): n is a, c, t, g, unknown, or other
  misc_feature (340)..(340): n is a, c, t, g, unknown, or other
  misc_feature (343)..(343): n is a, c, t, g, unknown, or other
  misc_feature (351)..(351): n is a, c, t, g, unknown, or other
  misc_feature (524)..(524): n is a, c, t, g, unknown, or other
aaagctggagctcaccgcggtggcggccgctctagaactagtggatcccccgggctgcaggaattcgcacgagaccattacctagaacatcctaatcgaaaacactccgtaaaaccacaggaaacctcacacgtcttcctccgtccagcctgtctccggncggncccccgnncttcttaaactcgcatcantccctttccatctcgtcttcccagcaaccgaaacgatcnaaatcacttccgttcgattctccgcgaagggggagggtaacctgaggacatttccggggacgccatggcgtccttctgcctggttctcctctgggcaaggtttcgggggnggncggaaggnggggggggaaatttcgcagattccggaaaaatcccgcggtttcaaaaagggcaaactggggggaagagcccgaacaatcacaatgcgatgaagctggaaggggacctatctgggggggtccctccgcgggggggctcttccggggcctcacacccgccggttcgggagaagcngccttttaacttttgggctcctcggggtccccggggggggcggctctcttcttttcgccgggggggggggggggggggtgtttccaagagtttcggggaa

SEQ ID NO: 12456 - protein, 110 aa, Zea mays
  misc_feature: Ceres CLONE 1371017-F
  misc_feature (16)..(16): Xaa is any aa, unknown, or other
  misc_feature (17)..(17): Xaa is any aa, unknown, or other
  misc_feature (77)..(77): Xaa is any aa, unknown, or other
MASFCLVLLWARFRGXXEGGGGNFADSGKIPRFQKGQTGGKSPNNHNAMKLEGDLSGGVPPRGGSSGASHPPVREKXPFNFWAPRGPRGGRLSSFRRGGGGGGVSKSFGE

SEQ ID NO: 12457 - DNA, 599 bp, Zea mays
  misc_feature: Ceres CLONE 1371022-R
tttatcgataagcttttttttttttttttttgaagattttaggaggagcagcagctctggtacgcacggtacattaacatcacacagcaaacttgaaatgcagacattcagaaccactcatcagagtcttttagaacaccaaacggacaggtagcagtagcagcagcagcagcaacgaacatgtccttcagacatgggcgctagccgtacatgcatgctatatattattcgtccattccggaaccgaggacgccaagacacagaccgataacagctaaagcggatgaggatcaattggggggccgacgaagcatctaggcaaggttccttggattcctccagctcgtctctgttcacgttcaccagggaaggatcttccagcggtggttgtgcacccttggcccactcccaaaggacaacagtggtgccgtcgtggacgcctccgtggtccttgtcgccctggaaggcgtccatgttgaggtagatgttgttcaccatgcgcacgcaacgtgaagccgtgcccgacgtcacggctctccgtacccagcaccgactcgtcaacgtactcaggggtgtaaggcacaaggcgtaccgggcgg

SEQ ID NO: 12458 - DNA, 654 bp, Zea mays
  misc_feature: Ceres CLONE 1371032-F
  misc_feature: Translation starting site: 164
  misc_feature (496)..(496): n is a, c, t, g, unknown, or other
  misc_feature (498)..(498): n is a, c, t, g, unknown, or other
  misc_feature (499)..(499): n is a, c, t, g, unknown, or other
  misc_feature (519)..(519): n is a, c, t, g, unknown, or other
  misc_feature (547)..(547): n is a, c, t, g, unknown, or other
  misc_feature (553)..(553): n is a, c, t, g, unknown, or other
tggagctccccgcggtggcggccgctctagaactagtggatcccccgggctgcaggaattcgcacgagaccattacctagaacatcctaatcgaaaaagttagtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctaccaagcggcgaccaaggggtggagggcggccgacctggggtacgtggccatcctcccgtcgctgctcctccgggcgctgcacaaccaggcgtggatcaccgcgtcccgcctgcagagcgcgcgcggccggcggccaggtcgtggaccgcggcatcgagttcgagcaggtggaccgcgagcgcaactgggacgaccagatcctgctcagcggcatcctcctgtacctggtcacaancnngggggggggggggggcagancctttccccctgtggggggccccggggnaagggnccccgggtttattcgccctggttgcacgcccgggccccggtcgaagctccgtctaactaactggcttggcaccgcggcggctggcacccacccaactttcc

SEQ ID NO: 12459 - DNA, 660 bp, Zea mays
  misc_feature: Ceres CLONE 1371148-F
tggagctccccgcggtggcggccgctctagaactagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcaaccctgccgcgtccgtattatgcacgccaggtcctggacgcgccctccctgcaggacgacttctatctcaacctcgtcgactggtcctcgcagaacgtgctcgctgtcggcctcggcacctgcgtctacctctggtccgcgtccaatagcaaggtcaccaagctctgcgatttggggcctagggacagcgtatgcgcagtgcattggtcacgggaaggctcttatctttccattggcaccggccttggagatgtccagatttgggatagttctcgttgtaagg

SEQ ID NO: 12460 - DNA, 716 bp, Zea mays
  misc_feature: Ceres CLONE 1371160-F
  misc_feature: Encodes the peptide sequence at SEQ ID NO. 12461
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (474)..(474): n is a, c, t, g, unknown, or other
  misc_feature (476)..(476): n is a, c, t, g, unknown, or other
  misc_feature (477)..(477): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (485)..(485): n is a, c, t, g, unknown, or other
  misc_feature (487)..(487): n is a, c, t, g, unknown, or other
  misc_feature (488)..(488): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (497)..(497): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (528)..(528): n is a, c, t, g, unknown, or other
  misc_feature (529)..(529): n is a, c, t, g, unknown, or other
  misc_feature (536)..(536): n is a, c, t, g, unknown, or other
  misc_feature (537)..(537): n is a, c, t, g, unknown, or other
  misc_feature (549)..(549): n is a, c, t, g, unknown, or other
  misc_feature (558)..(558): n is a, c, t, g, unknown, or other
  misc_feature (560)..(560): n is a, c, t, g, unknown, or other
  misc_feature (561)..(561): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (568)..(568): n is a, c, t, g, unknown, or other
  misc_feature (569)..(569): n is a, c, t, g, unknown, or other
  misc_feature (577)..(577): n is a, c, t, g, unknown, or other
  misc_feature (589)..(589): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (601)..(601): n is a, c, t, g, unknown, or other
  misc_feature (605)..(605): n is a, c, t, g, unknown, or other
  misc_feature (614)..(614): n is a, c, t, g, unknown, or other
  misc_feature (633)..(633): n is a, c, t, g, unknown, or other
  misc_feature (634)..(634): n is a, c, t, g, unknown, or other
  misc_feature (638)..(638): n is a, c, t, g, unknown, or other
  misc_feature (650)..(650): n is a, c, t, g, unknown, or other
  misc_feature (652)..(652): n is a, c, t, g, unknown, or other
  misc_feature (657)..(657): n is a, c, t, g, unknown, or other
  misc_feature (663)..(663): n is a, c, t, g, unknown, or other
  misc_feature (667)..(667): n is a, c, t, g, unknown, or other
  misc_feature (693)..(693): n is a, c, t, g, unknown, or other
  misc_feature (694)..(694): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
aaagctggagctccccgcggtggcggccgctctagaactagtggatcccccgggctgcaggaattcgcacgagaccattacctagaacatcctaatcgaaaaatctcgcaataccaaccttccggatccagtgccgcacgcctcactccccgtccccgacacccatgacacgcaagaggcggaagcacgccgccgccgccgccgccgcctagggttccgatcccttcctcatggattcgctgccgcggaagcgcaagggcgcgcgcgccgcgtgctccctggccggatcccgccacgatgcgcctgccgcccgcaagcgcacctgccgcgagcccaagccgcggcccgagaagaagaagccctcttccgccgatgagggctccgcctccccgcggggggtttattataaataaaacggcgggggnnnnnnnnnnnnnnnnnnnnnnnnnnannngnnnnnnnannnnnnnntgnanntgnnnnangnnaannnnttntttnnnnngagggggaaaggggnnngaatgnnttttggnnaatgaataaagngggaatttngnngnnnaannatggaagnttaaaggggggntaattnnngaanggtnggattaggngggaggaaaattttggggnntttntttggttaattngngggtnaagggngganttaattttaaaaaggggggagggggnntnnntttgggggttgggaaatt

SEQ ID NO: 12461 - protein, 60 aa, Zea mays
  misc_feature: Ceres CLONE 1371160-F
MDSLPRKRKGARAACSLAGSRHDAPAARKRTCREPKPRPEKKKPSSADEGSASPRGVYYK

SEQ ID NO: 12462 - DNA, 629 bp, Zea mays
  misc_feature: Ceres CLONE 1371176-F
tccccgcggtggcggccgctctagaactagtggatcccccgggctgcaggaattcgcacgagaccattacctagaacatcctaatcgaaaaattggcatctggcagctgtgctctccggtaaccatggaatacttgttctactactccctcaccatagtcatctgcatcacaggcatcgccctcctctccatccttcatacgttcaccgctaccaggacgacggcaggggctcccgcccgaaccgacatctgctgacactgattaccccgttcctcttcctcggtcgaaagaagttcggaatcaagcggattgtctccgacgcgagaacccaatacgagcccggcttcacggtctacctgctcccgacccgccgcggccatcttcatcgccgaccacgccgtgaggcaccgcgtgtgtgtggcagagctggcgccgccttggccgacagggcgccgactgacctccccttacgcctcgtctcctgtgagcagcgtgacatcacatcggtagcctacgggcctggctggtgcgcgctctgtcgcaaccaaagaggaaaccagttccaacaggcacgtatggaacgtgctcgcgccgatttacggcgacggctgcgacctcttcgtcgacg

SEQ ID NO: 12463 - DNA, 709 bp, Zea mays
  misc_feature: Ceres CLONE 1371180-R
  misc_feature: Encodes the peptide sequence at SEQ ID NO. 12464
  misc_feature (21)..(21): n is a, c, t, g, unknown, or other
  misc_feature (40)..(40): n is a, c, t, g, unknown, or other
  misc_feature (41)..(41): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
gggtggtggggggggtttttntcctctacgagggccaaannaannnnacccattnnnnnnncccaatgggtccgggccccccctcgaggtcgacggtatcgataagctttttttttttttttttctacagacgcacgcttttatttttacatcatgacgcgaatcaaagaacagtcaaacttagggcctgagatgaagagcagcagttccctatacaaacagttggccatcgggcggcaaaacttacgtcaagtcactgttgagtccaaaatcaacacctaggaagggaacctttaattaacgacggagcagagttgcagcatgtccatctccatgttgccccgcagcccgcaggcagagctcagaaggccagcagcagctggctacaaacacatcactactacatgtcctgcactaatctggaccgcgtgctcgcggagggcgggtcgcccccgtagcagctgctgccgtcgcatgaccccgccgccggattcctcgccttctccagggggctgccgttgcccggcccaaaagttccacgatcctctccatacgggaaaacgtcgacttcgaccatggggattaccggccccaccttggggccgtttctgccagtcgggggatcacgcaccctcagggcggaacccggagaggcccttcctttgaaccccctagggaggaagggattctccccgccagacttcggggt

SEQ ID NO: 12464 - protein, 44 aa, Zea mays
  misc_feature: Ceres CLONE 1371180-R
MGITGPTLGPFLPVGGSRTLRAEPGEALPLNPLGRKGFSPPDFG

SEQ ID NO: 12465 - DNA, 625 bp, Zea mays
  misc_feature: Ceres CLONE 1371186-F
  misc_feature: Encodes the peptide sequence at SEQ ID NO. 12466
  misc_feature (625)..(625): n is a, c, t, g, unknown, or other
tggagctccccgcggtggcggccgctctagaactagtggatcccccgggctgcaggaattcgcacgagaccattacctagaacatcctaatcgaaaaaggattagtttgaccccctccagtacgtccgcaccgcaaggcctctcgccgtccttggacattctccgtccgtcgcctttgcctggggcagataacaatatctgatatccctgggccttcgccgtccgggcccccctaccttctctcatccgtcctcacacaaagcagaagggggagggagttttaggggaggagggggcggcaggaggagccattattatttcttcttccagcggcaattcctggccaccaccgggcgcgctatattactccgggttcgtggacaagcatgcagaggggcgtgtccttccctggcggaatggcgaaggagtgcccgcccgccgagctctggctcccggacgagttcctggacgacgacttcttctccgaggaggagaaggcggcggtcgcggccaagagcgagagcgacgaggaggaagggatggacggcctctcgcaccgcgcggccgggctcgtcgtcgggggtggaggggacggttcccctgcaaaggcgcaagtgttagccgn

SEQ ID NO: 12466 - protein, 79 aa, Zea mays
  misc_feature: Ceres CLONE 1371186-F
MQRGVSFPGGMAKECPPAELWLPDEFLDDDFFSEEEKAAVAAKSESDEEEGMDGLSHRAAGLVVGGGGDGSPAKAQVLA

SEQ ID NO: 12467 - DNA, 633 bp, Zea mays
  misc_feature: Ceres CLONE 1371188-F
  misc_feature: Encodes the peptide sequence at SEQ ID NO. 12468
  misc_feature (255)..(255): n is a, c, t, g, unknown, or other
  misc_feature (281)..(281): n is a, c, t, g, unknown, or other
  misc_feature (282)..(282): n is a, c, t, g, unknown, or other
  misc_feature (287)..(287): n is a, c, t, g, unknown, or other
  misc_feature (298)..(298): n is a, c, t, g, unknown, or other
  misc_feature (439)..(439): n is a, c, t, g, unknown, or other
  misc_feature (470)..(470): n is a, c, t, g, unknown, or other
  misc_feature (488)..(488): n is a, c, t, g, unknown, or other
  misc_feature (614)..(614): n is a, c, t, g, unknown, or other
  misc_feature (615)..(615): n is a, c, t, g, unknown, or other
tggagctccccgcggtggcggccgctctagaactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacgggnttctcttcgggcccgccgcctgcttnncggantcgcgggcgangccccgtcgtacaacagcgtgccacggccccccgatgagatccagctcgcgaagcagcgcgcgcaggaatccgcggcgcggatctttaacgccgcagaggccaagcgtcctcgcgtcgactacggcgacgatgacagcggngggcttcggagtaggtctgggcagaatctgntggaggggacgccttggnccggagtgggactgagattctcgtattctggacggcgtggcaaagggagcttctattccactattaacttgtcggatcagaggctgcgcagaacgtcctcttatggtggatatcagggtacgacgnngacagtttgaaatgcaaa

SEQ ID NO: 12468 - protein, 207 aa, Zea mays
  misc_feature: Ceres CLONE 1371188-F
  misc_feature (85)..(85): Xaa is any aa, unknown, or other
  misc_feature (94)..(94): Xaa is any aa, unknown, or other
  misc_feature (96)..(96): Xaa is any aa, unknown, or other
  misc_feature (99)..(99): Xaa is any aa, unknown, or other
  misc_feature (157)..(157): Xaa is any aa, unknown, or other
  misc_feature (163)..(163): Xaa is any aa, unknown, or other
  misc_feature (205)..(205): Xaa is any aa, unknown, or other
GAPRGGGRSRTSGSPGLQEFARDHYLEHPNRKTLSTRVFRCLIPSSTLPAAAAQTLATRPPPWPTTTTPLRGSTTTPRRRRGARXSLRARRLLXGXAGXAPSYNSVPRPPDEIQLAKQRAQESAARIFNAAEAKRPRVDYGDDDSGGLRSRSGQNLXEGTPWXGVGLRFSYSGRRGKGSFYSTINLSDQRLRRTSSYGGYQGTTXTV

SEQ ID NO: 12469 - DNA, 674 bp, Zea mays
  misc_feature: Ceres CLONE 1371200-F
  misc_feature: Translation starting site: 214
  misc_feature (606)..(606): n is a, c, t, g, unknown, or other
aaagctggagctccccgcggtggcggccgctctagaactagtggatcccccgggctgcaggaattcgcacgagaccattacctagaacatcctaatcgaaaaatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcaggcctgcctcgccgggaggaggctcaccgcgctggtgcaggagccggccataaccatgaggtaccacaagggcgcgctcctgtcgggccccatcgccgtcaacttcatctggtacggcgacttctcggcgccgcagcgggcggcgatcaccgacttcgtctcgtcgctgaaaacggcggcggccccggccgcggcgcagcccggagccgtccgtgggccacgtgggttcaagacggcgcgcaagtactacgccagctcccaaggtgccgtttcccggcgctgcgcctcgaatcccacgccgtcggaccggaactgcttccctcggaggcgnctggaacggagaggtacctgctcaggctcgccgccaggggagccccgagccgcgccatcaacctggtg

SEQ ID NO: 12470 - DNA, 646 bp, Zea mays
  misc_feature: Ceres CLONE 1371204-F
gctggagctccccgcggtggcggccgctctagaactagtggatcccccgggctgcaggaattcgcacgagaccattacctagaacatcctaatcgaaaagagttcaaacacacatcaggaaagctcaaagaaaagactgtcagttgttacccaccgcgcgcgcgcacgattactctagctacagatacgctcgcgatcaaaacaaacacacagcggcatggtgcgagatctctgaccgcggcaacaactaccgtagcaccgaccacctgatggcggacaccgcatcttcctgcctgatgctcaacaccaccgatgcaccatccggaacggggacttccccagcagcgtggtactgacgaacacgcttcaccggcggcaccgctctcgccgctatcttgtcgtcgactcggcgaccatagccgaacacgaggacgaccctgtgacgatcgaggacgtgatacctcagatctcatcaggacacgcccgactacggctagctcgccgcgcgaaggtggtaggtccacgccagcaactactgagagggactgctggaacccatcgactgcgtgctcctccaggagctcatccgtttacggcgagttcgcccaggccacctacagagaggttcgactaagaacgcttctcc

SEQ ID NO: 12471 - DNA, 618 bp, Zea mays
  misc_feature: Ceres CLONE 1371233-F
  misc_feature: Encodes the peptide sequence at SEQ ID NO. 12472
  misc_feature (429)..(429): n is a, c, t, g, unknown, or other
  misc_feature (501)..(501): n is a, c, t, g, unknown, or other
  misc_feature (518)..(518): n is a, c, t, g, unknown, or other
aagctggagctccccgcggtggcggccgctctagaactagtggatcccccgggctgcaggaattcgcacgagaccattacctagaacatcctaatcgaaaactaccgagttttccttccccacctccccgccccacccgtcgccgaatcggagtcccgctcgcgtccacccttgccagagctcaagagctacctcctggtccggttggacagatcccttcgggcgctgcgtccaccgggattcaggcaaagtggtgtaacataagatgcaagggggaagaggtgggaggcagggtttgttcggttttggggacccttttgttggtttcggcggctttggacagccagggaacataatgtccggtttctttggtggcgcaaatccctttgatgaccctttcttcacaaaccccttttggtggcatgatgncacctagtttctcaaccccttttcagcgcatgatgcaacctagcttcatgaacccctttggtagcatgatgncacctagcttgcttggnatcagtatgtttgcagcccatggcaaatctcatgggagcactttttggaagccagaaccttctccatcaaggatgagcaatggcagtgtttcatttcaca

SEQ ID NO: 12472 - protein, 56 aa, Zea mays
  misc_feature: Ceres CLONE 1371233-F
  misc_feature (55)..(55): Xaa is any aa, unknown, or other
MQGGRGGRQGLFGFGDPFVGFGGFGQPGNIMSGFFGGANPFDDPFFTNPFWWHDXT

SEQ ID NO: 12473 - DNA, 633 bp, Zea mays
  misc_feature: Ceres CLONE 1371235-F
  misc_feature: Encodes the peptide sequence at SEQ ID NO. 12474
  misc_feature (394)..(394): n is a, c, t, g, unknown, or other
  misc_feature (425)..(425): n is a, c, t, g, unknown, or other
  misc_feature (459)..(459): n is a, c, t, g, unknown, or other
  misc_feature (543)..(543): n is a, c, t, g, unknown, or other
  misc_feature (585)..(585): n is a, c, t, g, unknown, or other
tggagctccccgcggtggcggccgctctagaactagtggatcccccgggctgcaggaattcgcacgagaccattacctagaacatcctaatcgaaaaactactagtgatcagaccagtgagctagcgactgtaccatgcagcagctgtaggagagcctggtggtaggtaggataggagtagcgccagccgccaagtgcgcgtccgggctggctgcttcgacgagcagaagggagccgcaccgccgggctcccgcaatgtcgcctcctccgcccccgccgctgctgcgcaacgagctgtcgcgcaggacggcggtgctgggcctgcgcctgtgggtgctggtgggcatcgccgtcggggccgccttcgtgctgctcctcgtgctcatctccctcncacctcgccgcggcgcggcggaggcggcccnaggaagggcgtcgcgcacgcgccggcgggggggncccgccgctgtccccgtccaccatcccgcccgggtccaaggagatccagggagggtgggccgtccacgtcggctcgctccgccnactacctgggagacggggcacgcgttcctcaaggacggcggncgacggcgacggcgaccggcgagtccgtgggcgcacggggtcgcagcg

SEQ ID NO: 12474 - protein, 126 aa, Zea mays
  misc_feature: Ceres CLONE 1371235-F
  misc_feature (47)..(47): Xaa is any aa, unknown, or other
  misc_feature (57)..(57): Xaa is any aa, unknown, or other
MSPPPPPPLLRNELSRRTAVLGLRLWVLVGIAVGAAFVLLLVLISLXPRRGAAEAAXGRASRTRRRGGPAAVPVHHPARVQGDPGRVGRPRRLAPPTTWETGHAFLKDGGRRRRRPASPWAHGVAA

SEQ ID NO: 12475 - DNA, 696 bp, Zea mays
  misc_feature: Ceres CLONE 1371236-F
  misc_feature: Encodes the peptide sequence at SEQ ID NO. 12476
  misc_feature (425)..(425): n is a, c, t, g, unknown, or other
  misc_feature (426)..(426): n is a, c, t, g, unknown, or other
  misc_feature (456)..(456): n is a, c, t, g, unknown, or other
  misc_feature (542)..(542): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (551)..(551): n is a, c, t, g, unknown, or other
  misc_feature (582)..(582): n is a, c, t, g, unknown, or other
  misc_feature (604)..(604): n is a, c, t, g, unknown, or other
  misc_feature (611)..(611): n is a, c, t, g, unknown, or other
aaaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccgggccgcccatccccggtggtgggacctctcggtgacgcggcgcgaggacctagtcgagcaggtgaggcaccnnggccgggacggtgggcttcttctgtggggnaaaaaccccaggaagtgccggaggagctgatgggcggatggttccgcggggtgcgcattacgggggccccccccggggggggggancannnnccncccccttcccccccgggggacctcggctcgnaaccctgcggcttcgccctccntctttcnccctctttcaggggctgctggcggccgacttggcgcgacacgctttttttctgcgaggggggcttccgaaacccgccggccggtg

SEQ ID NO: 12476 - protein, 79 aa, Zea mays
  misc_feature: Ceres CLONE 1371236-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGPPIPGGGTSR

SEQ ID NO: 12477 - DNA, 680 bp, Zea mays
  misc_feature: Ceres CLONE 1371237-F
  misc_feature: Encodes the peptide sequence at SEQ ID NO. 12478
aaagctggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgtgggcggcggcggaggcagcagcaccgcgccgaccgggcagccgaccacggtagcgtccaaggtgctggacatgggcgcggcggcgatgcaatcgctgcgccccgtgaagcaggcgaatcatgacatgtgctcgttcgcgctgtacgcgcacgacccgaagcggcatgtggagactgcacactacgtctgcctgcctcaacaggacttactacagtgggcgggctatgactccgaaaaagcgacgagggtttcatcggggtggagaactccgggtccaggaatatctctaatccctttgcgggggtgaaaaaggggtgggccctctttacggcccgattccaaaattaggttgggggcccccccccctcgggggggttttttcctaaaaagggcaaggggaccccaagggcctccacccccggaattttggggaccccggggagggggccccagaacccccccccccgggggggcccccc

SEQ ID NO: 12478 - protein, 78 aa, Zea mays
  misc_feature: Ceres CLONE 1371237-F
  misc_feature (1)..(79): Pfam Name: DUF1264 Pfam Description: Protein of unknown function (DUF1264)
MGAAAMQSLRPVKQANHDMCSFALYAHDPKRHVETAHYVCLPQQDLLQWAGYDSEKATRVSSGWRTPGPGISLIPLRG

SEQ ID NO: 12479 - DNA, 635 bp, Zea mays
  misc_feature: Ceres CLONE 1371240-F
  misc_feature: Encodes the peptide sequence at SEQ ID NO. 12480
  misc_feature (476)..(476): n is a, c, t, g, unknown, or other
  misc_feature (505)..(505): n is a, c, t, g, unknown, or other
  misc_feature (531)..(531): n is a, c, t, g, unknown, or other
  misc_feature (586)..(586): n is a, c, t, g, unknown, or other
  misc_feature (587)..(587): n is a, c, t, g, unknown, or other
aaagctggagctccccgcggtggcggccgctctagaactagtggatcccccgggctgcaggaattcgcacgagaccattacctagaacatcctaatcgaaaaatcgtcctctcctttgccagcgccgccgaacccgccaccagccttctcccatcctcgaagcacggaaggctcccagaaggagctctcacctcgcagccatctctggcacgtccgtccttcttctccctcggtccctccccttctccacagctatcggattggcgcttggagtggagatcgacccgggctcggaattcccttcgttggtaaggaaccctaatttggtcagatgggatttccaacttcgacaaagcccgcgaggtcgatcgatctcagttgacgcgagggattggaaaactaagttgcgggtgtagttaattttctaggaaagattggggtttcagctcaaactcccatgctcgacgctgaggacnaccctggcgggagatgacgaggatcttgntgcagcgcgggaccgccggctcctcntccagctccggccgctcggacacgcagccagtgcagccggagcagcttgccgggnnaaggaaggagttgccgctgcaacctcaaccacagctgccggagctatt

SEQ ID NO: 12480 - protein, 48 aa, Zea mays
  misc_feature: Ceres CLONE 1371240-F
  misc_feature (6)..(6): Xaa is any aa, unknown, or other
  misc_feature (33)..(33): Xaa is any aa, unknown, or other
MTRILXQRGTAGSSSSSGRSDTQPVQPEQLAGXRKELPLQPQPQLPEL

SEQ ID NO: 12481 - DNA, 628 bp, Zea mays
  misc_feature: Ceres CLONE 1371247-F
  misc_feature: Encodes the peptide sequence at SEQ ID NO. 12482
  misc_feature (316)..(316): n is a, c, t, g, unknown, or other
aaagctggagctccccgcggtggcggccgctctagaactagtggatcccccgggctgcaggaattcgcacgagaccattacctagaacatcctaatcaaaagctctcgcttcgctcccttaatttatcaccattcctaatttattctatttcttagtatcatagcacagtatttcgctcgccccgatttcccgactcttcccgtgcctcagacagcatcggattgcttgatctcgattgtcagaataagattcagcgcaggtttggattcaccgaatccaccgattgtgtgcggccccggcgggtcgcgcgcggcnggaatttcggccgccgccaattcgggcctctcccggaagggggtccccgggtgtggttcgcctaatatccgctgccctcgtgcgggactcctcgtgattttcggctgtgcgcttggcttttccagtcccggtgttgtggttccagcctttcaggggatggggcggccgcgggttgctcaaggctgcgcttctgctgtgcttccttgctgcttgctccgggagagaacttacgatcaaacagaacccttccactaccatatacaactcgactcttgccaagatactcgtggaatatgcttctgcaatctatac

SEQ ID NO: 12482 - protein, 52 aa, Zea mays
  misc_feature: Ceres CLONE 1371247-F
MGRPRVAQGCASAVLPCCLLRERTYDQTEPFHYHIQLDSCQDTRGICFCNLY

SEQ ID NO: 12483 - DNA, 585 bp, Zea mays
  misc_feature: Ceres CLONE 1371249-F
  misc_feature: Encodes the peptide sequence at SEQ ID NO. 12484
  misc_feature (350)..(350): n is a, c, t, g, unknown, or other
  misc_feature (352)..(352): n is a, c, t, g, unknown, or other
tggagctccccgcggtggcggccgctctagaactagtggatcccccgggctgcaggaattcgcacgagaccattacctagaacatcctaatcgaaaaaaccatttcttcttcctttttctatatcgcgttacgtccctccctacccagcgatctaggccgccgcctctcctactgcatctccctcgctctcgtcgcctcgttcgcttcgcctcctccccgccccgccccgagccgagcagagcgcagccctatccggagctgggatggcggacgcgaagcagcagcagcagcagccacagcaggcggcagcggcagccaccggcgtgtggaaagacggtcagcccttcgntnaacgcggggcctctgggatgctcgcgacctgcgtcatccaggctatcgacatgggtcaggttgaggatccaatttgggtggagggctcccctggtcagggcccaaggaaactggctgcaaatggagggggccggtccttctaaaaggtttggctgccggattgcttaaggaaggggaacaaccaaagggccggcttgggaaccttttaggggttcaaacaaaaaaaaggggtg

SEQ ID NO: 12484 - protein, 76 aa, Zea mays
  misc_feature: Ceres CLONE 1371249-F
  misc_feature (29)..(29): Xaa is any aa, unknown, or other
  misc_feature (30)..(30): Xaa is any aa, unknown, or other
MADAKQQQQQPQQAAAAATGVWKDGQPFXXRGASGMLATCVIQAIDMGQVEDPIWVEGSPGQGPRKLAANGGGRSF

SEQ ID NO: 12485 - DNA, 642 bp, Zea mays
  misc_feature: Ceres CLONE 1371251-F
  misc_feature: Encodes the peptide sequence at SEQ ID NO. 12486
  misc_feature (410)..(410): n is a, c, t, g, unknown, or other
  misc_feature (434)..(434): n is a, c, t, g, unknown, or other
  misc_feature (453)..(453): n is a, c, t, g, unknown, or other
  misc_feature (519)..(519): n is a, c, t, g, unknown, or other
  misc_feature (520)..(520): n is a, c, t, g, unknown, or other
aaaagctggagctccccgcggtggcggccgctctagaactagtggatcccccgggctgcaggaattcgcacgagaccattacctagaacatcctaatcaaaaatcgctctctcctttgcacccctagctagctagtactactctgctcctccgacttgctcttcgcgcagcaggacggagaaacaagaaccatccctccccctaccggctaccgctgctactcatggtcgcgcgcactgcctcctggtgccgccgcgtatgatccagacatgaatagggcgcacagcagcagctccaagctcatcaacgagaagctcgtggaacaccggatctccactgcgaagcactgcccccactgcggcgagaaaatcgacagcaaacgggaatgggggggggctggccgcaggcgntccagttcgatcccactgaacagnagctgatcgagcacctccnaggcggaagtggaaggatgaagggttcgagatctcaccctctcaatcgacgagttcataccacaannaagagggggggggaagggcatatgttacacccaccccgagaaaacttccaagtgggggaaaagggatggcctaagcaagcacttctttcccacgggccgtccaaggccctacacgacgggca

SEQ ID NO: 12486 - protein, 56 aa, Zea mays
  misc_feature: Ceres CLONE 1371251-F
  misc_feature (55)..(55): Xaa is any aa, unknown, or other
MNRAHSSSSKLINEKLVEHRISTAKHCPHCGEKIDSKREWGGAGRRRSSSIPLNXS

SEQ ID NO: 12487 - DNA, 575 bp, Zea mays
  misc_feature: Ceres CLONE 1371257-F
  misc_feature: Translation starting site: 209
  misc_feature (182)..(182): n is a, c, t, g, unknown, or other
  misc_feature (219)..(219): n is a, c, t, g, unknown, or other
  misc_feature (240)..(240): n is a, c, t, g, unknown, or other
  misc_feature (263)..(263): n is a, c, t, g, unknown, or other
  misc_feature (277)..(277): n is a, c, t, g, unknown, or other
  misc_feature (281)..(281): n is a, c, t, g, unknown, or other
  misc_feature (282)..(282): n is a, c, t, g, unknown, or other
  misc_feature (296)..(296): n is a, c, t, g, unknown, or other
  misc_feature (297)..(297): n is a, c, t, g, unknown, or other
  misc_feature (308)..(308): n is a, c, t, g, unknown, or other
  misc_feature (309)..(309): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (368)..(368): n is a, c, t, g, unknown, or other
  misc_feature (369)..(369): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
aaagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgnatagatcgatcgatcgctcggccatcatgggcgcggngaggagcaggcgctgctgtcngacggagatcgtggaaccgcggncgtgggagccgcgngggnnccccggacggccgnngctcgcgggcnncttcttcgggtggcgcggtgggcgccgcnnncgcctggccgggaccttccctgggcagnntcggtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12488 - DNA, 645 bp, Zea mays
  misc_feature: Ceres CLONE 1371261-F
  misc_feature (411)..(411): n is a, c, t, g, unknown, or other
  misc_feature (479)..(479): n is a, c, t, g, unknown, or other
  misc_feature (569)..(569): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaaggggcagagctggcaagtggcaaggctgcgcagccgcagagggactttttgtgtaaaatgcggtgggaaggtgcgctgcacctgcaagcagaggtgtgctctactgacagagtttgaactctcaagaggaggcgaggcagaaccgcaatcgcgaccgcgacccgcaggtgacatacatacggtgcgagcgccggaagccggaagcaccggtgacgaagccttccgtgtcatcactcatcaggatctcagggttttgtttcgtttcgcgggcgttgggaatccatccatggcgaggaagatgctcatccnacggggaggtggcggccgtcgcggatggtgggcactatgactacgatctcttcgccatcggggcgggnagagcggcggcgttcgcggctctcgcaccgccgcctccttcgggagctaagggttgcgatttgtgagctcccattccaccccatcagctncagagtggctaggagggacatggtggggacttgcggtggatacgtggttgcgtacctaanaagaatactcgtgtat

SEQ ID NO: 12489 - DNA, 656 bp, Zea mays
  misc_feature: Ceres CLONE 1371405-F
  misc_feature: Encodes the peptide sequence at SEQ ID NO. 12490
  misc_feature (376)..(376): n is a, c, t, g, unknown, or other
  misc_feature (446)..(446): n is a, c, t, g, unknown, or other
ggagctccccgcggtggcggccgctctagaactagtggatcccccgggctgcaggaattcgcacgagaccattacctagaacatcctaatcgaaaaagttaggcccataagcgtgcccgttctttttcgcgtttcacggcggcgcggacagagagccatcggcggcgcaccgaccgccggcgaagggtacagagatgaagacggttagcctcggcgcctctaggccttccactgtcaacttccgcatgccgacgagggacaacctcgtgcctatacgcgtcgacgtcgaggtggacggccagcgctacagggacgccttcacctggaacccgcgagatcccgactcggagataatcagcttcgctaagcggacggncaaggaccctcagctgccggccaatttcgtcccccagatgctccagtccatccagggggcactttgcggnagtccgttcctacgaggggcaggagatgcaaatcaaagagaagattgtgcctctgaagattgacctccgagggaacaccactggaatagggaccatttcttatggaaatccgcaaacctggaagggaccctgaagaattgggagggccctggggggtggatttgaaattaccaaccctggattggggccggaaaagctgttccctccggg

SEQ ID NO: 12490 - protein, 104 aa, Zea mays
  misc_feature: Ceres CLONE 1371405-F
  misc_feature (61)..(61): Xaa is any aa, unknown, or other
MKTVSLGASRPSTVNFRMPTRDNLVPIRVDVEVDGQRYRDAFTWNPRDPDSEIISFAKRTXKDPQLPANFVPQMLQSIQGALCGSPFLRGAGDANQREDCASED

SEQ ID NO: 12491 - DNA, 597 bp, Zea mays
  misc_feature: Ceres CLONE 1371415-F
  misc_feature: Encodes the peptide sequence at SEQ ID NO. 12492
  misc_feature (202)..(202): n is a, c, t, g, unknown, or other
  misc_feature (213)..(213): n is a, c, t, g, unknown, or other
  misc_feature (230)..(230): n is a, c, t, g, unknown, or other
  misc_feature (259)..(259): n is a, c, t, g, unknown, or other
  misc_feature (260)..(260): n is a, c, t, g, unknown, or other
  misc_feature (267)..(267): n is a, c, t, g, unknown, or other
  misc_feature (303)..(303): n is a, c, t, g, unknown, or other
  misc_feature (324)..(324): n is a, c, t, g, unknown, or other
  misc_feature (336)..(336): n is a, c, t, g, unknown, or other
  misc_feature (355)..(355): n is a, c, t, g, unknown, or other
aaagctggagctccccgcggtggcggccgctctagaactagtggatcccccgggctgcaggaattcgcacgagaccattacctagaacatcctaatcgaaaaaagaagctttacagtgaacgagtgagtatgtgcggcatacttgctgtgctcgggtgcgccgacgaggccaagggcagcagcaagaagtccccggtgctgnagctgtcgcgncggctgaagcacggggncccgactggagcgccctccgggcagtggnngactgcntactctctccacagggctcggcatcatcgaccgggnctctggggaacagccctctancacaggaccaantcggggggccccccccgcnaacgggaaaattaaaaccccctggacctcaggagcgccctcccggggcaaggccaagtttaagaaccgaagagaagtggaagagtttccgaacctgtccaagagatgggaaaaaaattttgggaaatttggaaggggggttctcccttttggggggggggaaaccccccctgggggaaccgcgcgggaaaaaaaatttttcagggggggtcggcaaccccctcgggggggcccccccttaaa

SEQ ID NO: 12492 - protein, 79 aa, Zea mays
  misc_feature: Ceres CLONE 1371415-F
  misc_feature: SWISSPROT Homolog: EC 6.3.5.4 Asparagine synthase (glutamine-hydrolyzing)
  misc_feature (25)..(25): Xaa is any aa, unknown, or other
  misc_feature (34)..(34): Xaa is any aa, unknown, or other
  misc_feature (44)..(44): Xaa is any aa, unknown, or other
  misc_feature (65)..(65): Xaa is any aa, unknown, or other
  misc_feature (69)..(69): Xaa is any aa, unknown, or other
  misc_feature (76)..(76): Xaa is any aa, unknown, or other
MCGILAVLGCADEAKGSSKKSPVLXLSRRLKHGXPTGAPSGQWXTAYSLHRARHHRPGLWGTALXHRTXSGGPPRXREN

SEQ ID NO: 12493 - DNA, 673 bp, Zea mays
  misc_feature: Ceres CLONE 1371417-F
  misc_feature (439)..(439): n is a, c, t, g, unknown, or other
  misc_feature (468)..(468): n is a, c, t, g, unknown, or other
  misc_feature (470)..(470): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (546)..(546): n is a, c, t, g, unknown, or other
  misc_feature (618)..(618): n is a, c, t, g, unknown, or other
  misc_feature (627)..(627): n is a, c, t, g, unknown, or other
aaagctggagctccccgcggtggcggccgctctagaactagtggatcccccgggctgcaggaattcgcacgagaccattacctagaacatcctgatcggaaaactcttctcccctctctctcttccccgccccctctgtctcgacatcggtgccgtcatcttctcggcctctcgccggttggatccatcgggcgctggtcggatctgcctttcggtcgccgttgcccctccgccacgcctcgcgccagccggtcctgctgagcgccggcctgatccgcctccctctagtcggatctgcttggcgtcggcctctcgccgctactgctccgcatcctgggcttcctcaccgatgcacgatcctggcaccacgccacgccggtgtgctaccggctccttgcggcggagcggaccacatggtctgtgctcacgctgagcaggnaccacgatcgctcgcgttctcatcattangncgactttctacttctcgacgctggagcagcttgactctcactgggtgtcgtcgtcgcctctcgccggcgtnnnggnttttcgcggtgccaagcgaagcggcctgttggcatttgcttgggaaccggttgaatggccggccccggtggnttcgatttncccttggttgggaaactgacaaaggggggggcccccggggggtggt

SEQ ID NO: 12494 - DNA, 626 bp, Zea mays
  misc_feature: Ceres CLONE 1371426-F
  misc_feature: Translation starting site: 173
  misc_feature (422)..(422): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (566)..(566): n is a, c, t, g, unknown, or other
caaagctggagctccccgcggtggcggccgctctagaactagtggatcccccgggctgcaggaattcgcacgagaccattacctagaacatcctaatcgaaaaaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtggagggaggactacgtccagaaacgccgtcagtttctctccccacccaaggtcaggggctccccccgtcgtctacaggcgatccttcctcgagaaagaagggcttagcaccgaggagatcgacgaggctttccgaagggntcctgatcnnntcaccagcactacggctaccactttctcgcagcagcaggtcaacagccagaatccatccggtcggggtgcaagcttatgcgccagcacaacctgtgcaccagcaacgctgggccctgtcgtccttccacgcangcaaaggttagctggtacaagcattcctgctgcaggctctgctttggggtttgggctaag

SEQ ID NO: 12495 - DNA, 673 bp, Zea mays
  misc_feature: Ceres CLONE 1371438-F
  misc_feature: Encodes the peptide sequence at SEQ ID NO. 12496
  misc_feature (512)..(512): n is a, c, t, g, unknown, or other
  misc_feature (515)..(515): n is a, c, t, g, unknown, or other
  misc_feature (516)..(516): n is a, c, t, g, unknown, or other
caaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggttcttctgtggaaaaacacaccagggagtgccggaggagctgatgggcgcatgcctccgcggggtgcgcgtaanggnnccccccctcggggggggggaaacaaaaccgcccttcctactgggaggaacctcggctcgaaaacgggggttttcgcctccaacttcgaccttcttcaagggttgctggcggcccgactggcgcgacacgctctttttggggggaaggtgggctccga

SEQ ID NO: 12496 - protein, 110 aa, Zea mays
  misc_feature: Ceres CLONE 1371438-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGSSVEKHTRECRRS

SEQ ID NO: 12497 - DNA, 646 bp, Zea mays
  misc_feature: Ceres CLONE 1371440-F
  misc_feature (539)..(539): n is a, c, t, g, unknown, or other
  misc_feature (543)..(543): n is a, c, t, g, unknown, or other
  misc_feature (565)..(565): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (623)..(623): n is a, c, t, g, unknown, or other
aagctggagctccccgcggtggcggccgctctagaactagtggatcccccgggctgcaggaattcgcacgagaccattacctagaacatcctaatcgaaaaattgcgggaactgaaagcaaaccaaaaaagaaagagagggggagagacacagaggcctcactccacacactgtcttgtctctcagtcccagagctttcttggatcgcgaggaatccactggaaattttgcaattgtagtagagaactgtatcgtccgacgaaggtgcatggtgttggccatgggtcacggcagggaacagagacgagcagggcggcgctctccccccagctcattgatcctgtcctcgctgtaaggtattcctgcggtggcctccgaatttcactcgatcgaacacgacatgaagcggccacgcggcgccagcccccctctggctgcgatgaccaatccgaacgatgatggtttacggcgtgggtcgggatggaggcggacgcggacgcggacgcggacgaggagaatgatggcgtgcgggcggcggncggngaagaagaagcggcgcctgggnctccgagcaggtgcgcgccgctggacgnnnnncctttcgaagtggagaaaagctgagnccggaaggcaaagggggggggcg

SEQ ID NO: 12498 - DNA, 642 bp, Zea mays
  misc_feature: Ceres CLONE 1371448-F
  misc_feature: Encodes the peptide sequence at SEQ ID NO. 12499
  misc_feature (444)..(444): n is a, c, t, g, unknown, or other
tccccgcggtggcggccgctctagaactagtggatcccccgggctgcaggaattcgcacgagaccattacctagaacatcctaatcgaaaaaaactgctgtaatgactgagcacgagcatcaagcactcagctgacggacagagcccacgtcgggttgacaaaaggaagacgcacgacgcgcgacgaggggagcaggcgatgcccggcgttggggcagggccgagcggtcaagcgccagcagagggaatcgccatggcgaacgcaggggcgagccaggagaaatcagggagcaggggctcgcggctagcaggagaagcagagatcaagctgggcgagatccaagcaggaagattggcggccggcagagggaggcgccatgggagggagacccgagcagaggagctgaaggggcgttggccatggggggaggcaaggaggaaagnttttggtgaggatagtgttaagtaaaaaagtccctcgcgtagtcatgaaatgtttgcagagtctgagcacgcacagggtataagaacccgcgtccggctgcgggagaggagatgcataaaagcacgctgcttgaatgagaatgtcggtacatgatttgttctcctgggcggacaggagactgcacgggtgtctgaata

SEQ ID NO: 12499 - protein, 89 aa, Zea mays
  misc_feature: Ceres CLONE 1371448-F
  misc_feature (82)..(82): Xaa is any aa, unknown, or other
MPGVGAGPSGQAPAEGIAMANAGASQEKSGSRGSRLAGEAEIKLGEIQAGRLAAGRGRRHGRETRAEELKGRWPWGEARRKXFGEDSVK

SEQ ID NO: 12500 - DNA, 644 bp, Zea mays
  misc_feature: Ceres CLONE 1371460-F
  misc_feature: Encodes the peptide sequence at SEQ ID NO. 12501
  misc_feature (486)..(486): n is a, c, t, g, unknown, or other
  misc_feature (502)..(502): n is a, c, t, g, unknown, or other
  misc_feature (503)..(503): n is a, c, t, g, unknown, or other
  misc_feature (511)..(511): n is a, c, t, g, unknown, or other
  misc_feature (549)..(549): n is a, c, t, g, unknown, or other
  misc_feature (556)..(556): n is a, c, t, g, unknown, or other
  misc_feature (561)..(561): n is a, c, t, g, unknown, or other
  misc_feature (562)..(562): n is a, c, t, g, unknown, or other
aaagctggagctccccgcggtggcggccgctctagaactagtggatcccccgggctgcaggaattcgcacgagaccattacctagaacatcctaatcgaaaaaacacaaaacacatccatcctcgctagctcgctctctcttgcaactccagtgcttctcactgccactgccagcaggtcgagctgctccgcaagtctgctttgctgctgcacctgcaagtctgcaaccgcgcacagagatgtcgacgactgtgagccgtgcgtccctcgaccagaaactcgccctcgccaagcgctgctcccgagaggcgaccctcgccggagccaaggcggcagccgtggcgactaatcgcctccgcgatccccaccctggccagcgtgcggatgctgccatgggccaaggccaacatcaaccccaccgggccagcgctcatcgtctcccacgtggctgggatggcctacttcatcgccgccgataagaagatncctgtcgctggcgagnncgcactcngtcgaccaagccctgagcaccctcagaacacctccttncaggggnacggnncgtccccaccgggttttcttcaggcgtgaaaacaagacctccggcaagctagctaacaactggcctctttcaggtccgcagg

SEQ ID NO: 12501 - protein, 68 aa, Zea mays
  misc_feature: Ceres CLONE 1371460-F
  misc_feature (34)..(34): Xaa is any aa, unknown, or other
  misc_feature (40)..(40): Xaa is any aa, unknown, or other
  misc_feature (43)..(43): Xaa is any aa, unknown, or other
  misc_feature (55)..(55): Xaa is any aa, unknown, or other
  misc_feature (58)..(58): Xaa is any aa, unknown, or other
  misc_feature (60)..(60): Xaa is any aa, unknown, or other
MLPWAKANINPTGPALIVSHVAGMAYFIAADKKXPVAGEXALXRPSPEHPQNTSXQGXGXSPPGFLQA

SEQ ID NO: 12502 - DNA, 659 bp, Zea mays
  misc_feature: Ceres CLONE 1371466-F
  misc_feature (394)..(394): n is a, c, t, g, unknown, or other
  misc_feature (420)..(420): n is a, c, t, g, unknown, or other
  misc_feature (421)..(421): n is a, c, t, g, unknown, or other
  misc_feature (561)..(561): n is a, c, t, g, unknown, or other
aaagctggagctccccgcggtggcggccgctctagaactagtggatcccccgggctgcaggaattcgcacgagaccattacctagaacatcctaatcgaaaacagctttgctttgtagttgtagcgctagcagcttaattggtctctgagctgaggtgcactactagctagctagtcgtgcaggaagaggaaggaatataatggctgagcgggaggtcgtcgaaggcgggacgacgacgggaggcgggctgtggcggaggtatgcgccgcacgtccagatggtggtgagcgcagctgtgctacacgctcatgtacttcatcaccgaggccgccttcgaccaggggctcaacccctacgtctacatcacctaccgccatctggtttcgtcgccgntcctcatctggcccttcgcatactannctgggaagaagggggctgaggcctaaaatgacgctcatggcttgttcgtggaagatattcgtgctctccctttctcggggtgagcttaactctggaacatgtacttcgcggagcctgaagtacacgtccccaacgtcgtnaaattttccgtggtgacaccttcgccccctcaatgacgttcgtcatcgcatctcctcagggatgggaaaattcgggcacgtgagaagccctacggtgg

SEQ ID NO: 12503 - DNA, 662 bp, Zea mays
  misc_feature: Ceres CLONE 1371467-F
  misc_feature (348)..(348): n is a, c, t, g, unknown, or other
  misc_feature (501)..(501): n is a, c, t, g, unknown, or other
caaagctggagctccccgcggtggcggccgctctagaactagtggatcccccgggctgcaggaattcgcacgagaccattacctaaaacaccctaatcgaaaactctcctatctctctctctctctccactcgccgccgcctcgacctgcccggtgcccgcccgcacacaccacctgtccccgttccgctccgtgttcccttcccctcccggaattcccgatacgcacgccgcccgcccgcctgacctcgacctcccctctcccctctcgcgccatccctcaggcccgggtttgtctcgccgccgctactggacttcgctcggtccgccgtgatggtgtctggctcgnccctgctgagaaaacaacctactgcgaccgctcatgggagcctccagattgctggtaggatcagcagccgaagcaatctcacgcacagggagcgacgtgtcggaacaccggatacttacttacaaagcgtacatctacctaaagccacgctgnctcctggtcgtgagtcttccctgaatatacgtgtttggctaagactgatgacgctcatcgagctatcaccccccactgtcgcctgatgctttttctgaactggaaacagccggtgtcatttcgtgtgacccaatctgcacgttccgcgtgaagccagtggt

SEQ ID NO: 12504 - DNA, 636 bp, Zea mays
  misc_feature: Ceres CLONE 1371476-F
tggagctccccgcggtggcggccgctctagaactagtggatcccccgggctgcaggaattcgcacgagaccattacctagaacatcctaatcgaaaaacacgaacacaacagcacagcctctctctcctctactagacttgttttttccgttcatccatccatacgtttcgtttgttccacctgcgcaactgcgacggggataagtacgtcttccagatgacgacggcggtatggccgcggccacgcttcctcgtcctcccccagcctggattcctccgctcggtctgcacgggctctgcgcccgctgtctcttctgcttcctgctgctcctcgccttcgcctgcagctccagctccggaaggggggtggtggtcaccagcttgctggggctttcgacggcgacctccccttcacctcgaaacagggtaacgtggaggggtggaggaggacacgccgtgcgtggagctcttctactacttcgtcagggtccgagttccggcgccgccgaccgccgccgaatgacaccgcttttcctcttctggctccaccggcgtggacccgctgtctccgtcttcaacggcgtccgcttaaccagatcggtcacatctacattcgtcgctgaaacctacaacggg

SEQ ID NO: 12505 - DNA, 498 bp, Zea mays
  misc_feature: Ceres CLONE 1371479-F
  misc_feature: Translation starting site: 221
  misc_feature (179)..(179): n is a, c, t, g, unknown, or other
  misc_feature (247)..(247): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (268)..(268): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (333)..(333): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (360)..(360): n is a, c, t, g, unknown, or other
  misc_feature (364)..(364): n is a, c, t, g, unknown, or other
  misc_feature (366)..(366): n is a, c, t, g, unknown, or other
  misc_feature (373)..(373): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (409)..(409): n is a, c, t, g, unknown, or other
  misc_feature (410)..(410): n is a, c, t, g, unknown, or other
  misc_feature (428)..(428): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (442)..(442): n is a, c, t, g, unknown, or other
  misc_feature (443)..(443): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
aagctgggctcaccgcggtggcggccgctctagaatagtggatcccccgggctgcaggaatcgcacgagaccattacctagaacatcctaatcgaaaaaccaccgcagccgcagacaatcgcctcgccttcccttccccaccagcccgtctctctcttctctctgactctctctctcgntaagccgcgtccacctcgcagcagcaagcaagcgcgaccaaatggcgcctctaggagacggcgggagncttgggnnnnnnnnnnnnntngggggggggggggggnnnnnnnnnnnnnnnnnnnngggggggggggggnnnnnnnnngnnngggnggggggggggggggggggnnnnnnngngggngnggggggngggggggggggggggggggggggnnnggnnnngggnngggggggggggggggggngnnnnnnnnnnntnnttttnnnttnnnnnnnnnnnnnnngggggnnnggnnnnnnnngggnnnnnnnnna

SEQ ID NO: 12506 - DNA, 640 bp, Zea mays
  misc_feature: Ceres CLONE 1371480-F
  misc_feature: Encodes the peptide sequence at SEQ ID NO. 12507
  misc_feature (365)..(365): n is a, c, t, g, unknown, or other
  misc_feature (366)..(366): n is a, c, t, g, unknown, or other
  misc_feature (411)..(411): n is a, c, t, g, unknown, or other
aaagctggagctccccgcggtggcggccgctctagaactagtggatcccccgggctgcaggaattcgcacgagaccattacctagaacatcctaatcgaaaaagctccaggagcagcaccaatcccccaagccgccatggccgccgaccccacgctgctgcttctcgtacctttcctcgccatccccctctacttcttcttggccaccagacgtaggaacgccacgcggggggcgcgcggctcccgccgggggccgtgggcgctggcccgtggtcgggcacctgcatcacctaagcccggggcctcccgcaccgcgtcatgcgcgaccctggcgaggcgccacggcccgctcatgatgctccggnntcggcgaggcccccggtggtggtggcactcctcgccggccgcggncgcgcgagggagatgcagacccacgacgcggggtgccgcgtcggggaccatcggtcccgagaccgcggatctggttccaggagcgacgaggggatcctcttcgcgcgctagagcgacaattggcgccacctgcgcagtgtctgtgcccatgagctcctcaccgcccgccgcgtgcaatccatgcgaccgcggagggaagacgagatcacggcgctgatcagccgtacga

SEQ ID NO: 12507 - protein, 67 aa, Zea mays
  misc_feature: Ceres CLONE 1371480-F
  misc_feature (16)..(16): Xaa is any aa, unknown, or other
MRDPGEAPRPAHDAPXSARPPVVVALLAGRGRAREMQTHDAGCRVGDHRSRDRGSGSRSDEGILFAR

SEQ ID NO: 12508 - DNA, 683 bp, Zea mays
  misc_feature: Ceres CLONE 1371482-F
  misc_feature: Translation starting site: 360
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (484)..(484): n is a, c, t, g, unknown, or other
  misc_feature (500)..(500): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctggggctccccgcggtggcggccgctctagaatagtggatcccccgggctgcaggaattcgcacgagaccattacctagaacatcctaatcaaaaagcgccgcctggatcgagcagccgagcgactaagcgaagactcccttttccccgagcaaagagaaccatggcggcggcggcagtttacggcggcttcaaaggaagcttggcgtcgaggatgcccccgagctgcagctcaacggcatccgcatcacactctcatccaagaacgtcaagactttggagaagttngtgcgaatttggtaangggagccaaggacaagcatttgagggttaaagggacctgttccggatcccctactaaggttctccaaatcaccactcgaagtccccctttgggggggagggaaaacccatggggaaacggggtttggattccccattcccaaaaggggggggttggccaaaacccctccccccggaggggggg

SEQ ID NO: 12509 - DNA, 683 bp, Zea mays
  misc_feature: Ceres CLONE 1371489-F
  misc_feature: Encodes the peptide sequence at SEQ ID NO. 12510
  misc_feature (510)..(510): n is a, c, t, g, unknown, or other
aagctggagctccccgcggtggcggccgctctagaactagtggatcccccgggctgcaggaattcgcacgagaccattacctagaacatcctaatcgaaaacaaggcctatgatcatccgccagtgtggtgccaccgcgcattcatcatccagctgctttccaacaacctggaggatcatttccaccgcgtacaacatatgtaacactgatctgctcccaatgcttacgccatggacttgccctgtacatgaagtgttctacaaagcatccatcatatgctcagagatctccacaaggagaatgtttacgagacatcgtatctacaacgcgatgaactggttcttcctcatcggtatgttgccagcacttactttctgacacctattcaagaagttcgcagatgagaaatggttcaaacttatccacagtccccttgatcatgctcagctgtaagcccaatgtcacaagctaaatgccggggattactggccatggaacatccgttgggntaggggtccaactactaattctggaggagtttaaaaagttggtggggggaggcaaaataaatttttccagaaacgtttgaccacgggaccgcctttttggggagggggaatttctttggggcccaaaaaaatggttttcaccctccctgttttggggggggcccttaaaaccc

SEQ ID NO: 12510 - protein, 89 aa, Zea mays
  misc_feature: Ceres CLONE 1371489-F
MIIRQCGATAHSSSSCFPTTWRIISTAYNICNTDLLPMLTPWTCPVHEVFYKASIICSEISTRRMFTRHRIYNAMNWFFLIGMLPALTF

SEQ ID NO: 12511 - DNA, 627 bp, Zea mays
  misc_feature: Ceres CLONE 1371495-F
  misc_feature: Translation starting site: 332
  misc_feature: SWISSPROT Homolog: EC 3.6.3.14 H(+)-transporting two-sector ATPase
  misc_feature: SWISSPROT Homolog: EC 3.6.3.15 Sodium-transporting two-sector ATPase
  misc_feature (419)..(419): n is a, c, t, g, unknown, or other
  misc_feature (489)..(489): n is a, c, t, g, unknown, or other
  misc_feature (513)..(513): n is a, c, t, g, unknown, or other
  misc_feature (550)..(550): n is a, c, t, g, unknown, or other
  misc_feature (578)..(578): n is a, c, t, g, unknown, or other
aaagctggagctccccgcggtggcggccgctctagaactagtggatcccccgggctgcaggaattcgcacgagaccattacctagaacatcctaatcgaaaaaaaagcctctttcagttgaattgggacctggaattcttggaaacatttttgacggtatccagcgacctctaaaaaccatcgctattaagtcaggagatgttatattcctcgtggtgtttcagttcctgcccttgacaagatgtattgtgggaatttcagccaacgaagctagggttggagatgtctcacaggtggagatctatacgctactgtttttgagaacacattgatgcagcaccatgttgctcttccaccgggttctatggggaaaataagttacattgcaccagctggccagtacaaccggcaggacacgntgctagaattgggaatttcagggcataaaaaagaaatttaccatgcttcagacaggggcctgtgcgttcnaccaaggcctgtttgcatcgaagncttgctgcggatacacctcttctgacagggggcaggntggtactggatgacaaatccccctcggnttctgggaaggcacttgtgctattccaggagccattttggctgttggta

SEQ ID NO: 12512 - DNA, 629 bp, Zea mays
  misc_feature: Ceres CLONE 1371501-F
  misc_feature: Encodes the peptide sequence at SEQ ID NO. 12513
  misc_feature (200)..(200): n is a, c, t, g, unknown, or other
  misc_feature (344)..(344): n is a, c, t, g, unknown, or other
aaagctggagctccccgcggtggcggccgctctagaactagtggatcccccgggctgcaggaattcgcacgagaccattacctagaacatcctaatcgaaaaacaccgatcctcccagctgcatctgcattgcattgcatgcacaggtcgcgcccaccatcagtagcggtcgccgccatgcagagactcgtgcgcgcccntcgtggtggcttgggcgtggccgccgcggcgtcggcgcaaggcccgacggcggcgccaacgacgcccacgcccacgccggcaacccccgcggcgcccgcgcccacgacggcgtccagcaacatcacaggcgtgctggccagggncgggcagttcaacaccttcatccggctgctcaagtccacgggcggtggcgtcgcagatcgacaaccaggtcgccaacggcggggacgggggtcacgggtgttcgcggccacggacaacgcgtttcagtcgctgccctcgggcacgcttcattcggtgtcggaccagacaaaaagcggcttggtgcagtaccccgggggtggccgccgccatccccatgggggaatttgaaaaccgtaaggaacccgttccgaacgaagcccggagggcctccccggggggaattc

SEQ ID NO: 12513 - protein, 131 aa, Zea mays
  misc_feature: Ceres CLONE 1371501-F
  misc_feature (8)..(8): Xaa is any aa, unknown, or other
  misc_feature (56)..(56): Xaa is any aa, unknown, or other
MQRLVRAXRGGLGVAAAASAQGPTAAPTTPTPTPATPAAPAPTTASSNITGVLARXGQFNTFIRLLKSTGGGVADRQPGRQRRGRGSRVFAATDNAFQSLPSGTLHSVSDQTKSGLVQYPGGGRRHPHGGI

SEQ ID NO: 12514 - DNA, 647 bp, Zea mays
  misc_feature: Ceres CLONE 1371504-F
  misc_feature: Encodes the peptide sequence at SEQ ID NO. 12515
  misc_feature (335)..(335): n is a, c, t, g, unknown, or other
  misc_feature (336)..(336): n is a, c, t, g, unknown, or other
  misc_feature (394)..(394): n is a, c, t, g, unknown, or other
  misc_feature (489)..(489): n is a, c, t, g, unknown, or other
  misc_feature (590)..(590): n is a, c, t, g, unknown, or other
aaagctggagctccccgcggtggcggccgctctagaactagtggatcccccgggctgcaggaattcgcacgagaccattacctagaacatcctaatcgaaaaacccctgttcctctgcgatttgggctcgtcctgtgtccttcctgttgctcaaaagctcgctcattcgatgtccctgtctgaaaggcgacaaatcccactggaattcggagcacagagctttgaatccaggggccaaaactttttgctcatctcccttgcggaaaagcgcctcctctgcgtctgaaagtcggatcttttttcacagattcgatttgaagttcccgagcagccgnnaggaccgcggtgtcggtaagacttgctttgaagatcttgatcaccacaagagatttgnctgaatttccggtcactgtactttttccactggacatgtcctttcgcagcatagtccgtgatgttagggaaagctttggtagcttatcaagaggnagccttgaggtcaagattttctgggtttgcctggtctggctaaaatctgttgaaatctgtgagtgacctgcgcgacagacctggtagtagtgatcaagcangggggggggttgggctttcctcctgaaatgcttcgagatgtaatgagaaggctttgg

SEQ ID NO: 12515 - protein, 41 aa, Zea mays
  misc_feature: Ceres CLONE 1371504-F
MSFRSIVRDVRESFGSLSRGSLEVKIFWVCLVWLKSVEICE

SEQ ID NO: 12516 - DNA, 642 bp, Zea mays
  misc_feature: Ceres CLONE 1371505-F
  misc_feature (166)..(166): n is a, c, t, g, unknown, or other
  misc_feature (200)..(200): n is a, c, t, g, unknown, or other
  misc_feature (208)..(208): n is a, c, t, g, unknown, or other
  misc_feature (269)..(269): n is a, c, t, g, unknown, or other
  misc_feature (342)..(342): n is a, c, t, g, unknown, or other
  misc_feature (351)..(351): n is a, c, t, g, unknown, or other
  misc_feature (630)..(630): n is a, c, t, g, unknown, or other
aaagctggagctccccgcggtggcggccgctctagaactagtggatcccccgggctgcaggaattcgcacgagaccattacctagaacatcctaatcgaaaaaggaaaaggagccgaggaagccctcccctctcgccgcagccgcaccaccagaccgacaaccggncggcttccctcgcccccggcgaggagtgaagacnagccgacnaggcaaaaccatcgcctgtacggtatccaaccgccgtcccgccgcacaacaaggatagggncgggagaagggggatctcgcttttccgtcccgctggcgcatgtgcaaacggcccttctcatggcacccactanggggaccanccagccccccttctcgtcgaacttccgcgcgggtggaatctgggtgagcaatcataccccttatatggggccgaacccatggggttggaaattttcgaaccgctggcggctccgcctctagaggggggggaagggggggaaacccggccatggtccccgggataacatcaaaggggctcgggggggtctcgggtctcctcctagggtctttttaatgggggcgagtttcatatccaaggaaggaaggacctcaagaaggcgcatcctcgcgcagaaaanggggggggtggg

SEQ ID NO: 12517 - DNA, 644 bp, Zea mays
  misc_feature: Ceres CLONE 1371507-F
  misc_feature: Encodes the peptide sequence at SEQ ID NO. 12518
  misc_feature (277)..(277): n is a, c, t, g, unknown, or other
  misc_feature (316)..(316): n is a, c, t, g, unknown, or other
  misc_feature (358)..(358): n is a, c, t, g, unknown, or other
  misc_feature (511)..(511): n is a, c, t, g, unknown, or other
  misc_feature (636)..(636): n is a, c, t, g, unknown, or other
aaagctggagctccccgcggtggcggccgctctagaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactggggnggcctcgcggtcccatccctgctggaggactaccacctngatcgagaaggtggcgcacttcgcgcgcgagcgcatcccggnagcgcgtggtgcacgcgcgcggggcctccgccaagggcttcttcgaggcacccacgacgtgaccgtcgctgacgtgcgccgacttcctgcgggcgcccggcgtgcggacgccccgtgatcgtggccttcctcgacggtgatcccccgagcggngttcccccggagacgatccgcgaacccgcgcggggttccgccgtgaagttctaccacccgcgaggggcaactggggacctgctggggaacaaccttccccgtcttcttcatccgcgacggcatcnggttcccc

SEQ ID NO: 12518 - protein, 100 aa, Zea mays
  misc_feature: Ceres CLONE 1371507-F
  misc_feature: SWISSPROT Homolog: EC 1.11.1.6 Catalase
  misc_feature (35)..(35): Xaa is any aa, unknown, or other
  misc_feature (48)..(48): Xaa is any aa, unknown, or other
  misc_feature (62)..(62): Xaa is any aa, unknown, or other
MDPTKFRPSSSHDTTVTTTNAGAPVWNDNEALTGXASRSHPCWRTTTXIEKVAHFARERIPXARGARARGLRQGLLRGTHDVTVADVRRLPAGARRADAP

SEQ ID NO: 12519 - DNA, 646 bp, Zea mays
  misc_feature: Ceres CLONE 1371513-F
tggagctccccgcggtggcggccgctctagaactagtggatcccccgggctgcaggaattcgcacgagaccattacctagaacatcctaataaaactgtctcgccgaggtcgagatcggagcgcaaggtccacaccaggaccaagaagcggccggcctccctcctccgggtcaccacctaggtgttacgtccgtcaccgcgtctgccacggaggaccagtggcgtcgaattcttccatccccaagcggatgccttccagaggcacggtctaaggtattttctatcaccgatggcgcgactgctgctgccaatgactgcgagcagcaaaaatatcatatgactcccgcagaaaaaacgggactgcggtattcggctaccacatgtacggcgcactcgggattcatcatcaagacaacgttctctctctgagactgcgagatgatgcatcttctactgtagtgctggttgctaaagtgcatcttagagtgcgtacaggcgcgccaggacagcggcccggacctggcgactagaataccacgattcgattcactgatcattgtatgacgaactctgcgtgtaggctcgtggtaccaaggtattaggactgaaggcgcagccatcgcaaggatgcgacgcatgctctgga

SEQ ID NO: 12520 - DNA, 652 bp, Zea mays
  misc_feature: Ceres CLONE 1371515-F
  misc_feature: Encodes the peptide sequence at SEQ ID NO. 12521
  misc_feature (461)..(461): n is a, c, t, g, unknown, or other
  misc_feature (546)..(546): n is a, c, t, g, unknown, or other
  misc_feature (576)..(576): n is a, c, t, g, unknown, or other
aagctggagctccccgcggtggcggccgctctagaactagtggatcccccgggctgcaggaattcgcacgagaccattacctagaacatcctaatcgaaaactcccaaccgccgcgcgcgcgcgcagaaccaaccaacttaaaccgccaacaccgagcccaaggcacaaacgttcccatggcgcggctggtgtcgacggcgacgaaggcaatggcggtcgtggtcctcgcggcggcgtcggcagcgctggccgcgcacgactacggtgacgccctccacaagagcatcctcttcttcgaaggccagcggtccggccggctgccaccgaaccagcgcctccggtggcggcaggactcggccatccacgacggcgccgaggcgggggtggacctgacgggcgggtactacgacgcgggcgacaacgtggaagttcgggttccctatggcgttcacggcgagcncccatgtcgtggggcctgaatcgacttcggtcgcagcttcgcgcgcaccgaagcggaggccccgggaaaccggcgtggggtgggncgacggactacctgatgaaggcgacgcganccccccgggggggggggtgaacggggacaggtccgggaacgcgtcccgggaaccacgcgtgggctgggaaagcgca

SEQ ID NO: 12521 - protein, 100 aa, Zea mays
  misc_feature: Ceres CLONE 1371515-F
  misc_feature: SWISSPROT Homolog: EC 3.2.1.4 Cellulase
  misc_feature (95)..(95): Xaa is any aa, unknown, or other
MARLVSTATKAMAVVVLAAASAALAAHDYGDALHKSILFFEGQRSGRLPPNQRLRWRQDSAIHDGAEAGVDLTGGYYDAGDNVEVRVPYGVHGEXPCRGA

SEQ ID NO: 12522 - DNA, 658 bp, Zea mays
  misc_feature: Ceres CLONE 1371652-F
  misc_feature: Encodes the peptide sequence at SEQ ID NO. 12523
aaagctggagctccccgcggtggcggccgctctagaactagtggatcccccgggctgcaggaattcgcacgagaccattacctagaacatcctaatcgaaaaattgagtctaagacgtcgtctgcgtttggtaccaaaatatttgtgtgttaattcgctcccttcaaaactcaaaatgaagttccagtacaaggaagagcacgcgtttgagaagaggaagagcgagggcgagaagatcaggaggaaataccccgacagagtgcctgtcattgtagagaaggcacctaaagcaaggattggggatcttgacaagaagaaatatttagtgccgtctgacttgactgttggtcagttctacttcttgatccgcaagcgtatccatcttcgacctgaggatgcccttttcttcctcgtaaacagtgtagttccacccagcagtgccaccatgggttcactctatcaggagcaccatgaagaggactttttcttgtacattgcttacagtgatgagaatgtttatggaaaattataacttaaacacctaaactacagccaggaatttcgaagcagaatcaacaaaatgaaaaaatcaacaaaaagcttaaaacctacttagaaaccttacaaaaaaaaattaaaaaccctctgaggcatctgc

SEQ ID NO: 12523 - protein, 118 aa, Zea mays
  misc_feature: Ceres CLONE 1371652-F
  misc_feature (13)..(116): Pfam Name: MAP1_LC3 Pfam Description: Microtubule associated protein 1A/1B, light chain 3
MKFQYKEEHAFEKRKSEGEKIRRKYPDRVPVIVEKAPKARIGDLDKKKYLVPSDLTVGQFYFLIRKRIHLRPEDALFFLVNSVVPPSSATMGSLYQEHHEEDFFLYIAYSDENVYGKL

SEQ ID NO: 12524 - DNA, 677 bp, Zea mays
  misc_feature: Ceres CLONE 1371670-F
  misc_feature: Encodes the peptide sequence at SEQ ID NO. 12525
  misc_feature (653)..(653): n is a, c, t, g, unknown, or other
aaagctggagtccccgcggtggcggccgctctagaactagtggatcccccgggctgcaggaattcgcacgagaccattacctagaacatcctaatcgaaaaaaaattcccctcatgcgtctcacagtatcagggctattctccctcctcaacggagacaatcaacctgacaccaccagacgatcgcgccttatatgctgggccgtcccggggaggcggctcggagccggatgagtgctcgcctcggttggggaaggccctacgccccggcggcggtcccggcaggacctactccgccgcggtgaaggagataagtgtacaggaaggattgaatagccgcattagatgaagaaatgtcactgagacccttgtgcttgcatggatgcaacaataggctgtggagtaccactggcatgacaagatatccaagggcttgcttagactaaatgaccccgatacgtcatctcgatactccgatcactgaggcggtcttcagtggcattggcgtagcagccgcttatgatggtcttcgacctattggagaggtcatgacagataactattcgatggaggagatcggtcacatgattaattcatgctgccaagtcataactacatgtcagctgcgcagacatctgaccctaatgacatgtnggcccaccagaatggtgactgctg

SEQ ID NO: 12525 - protein, 77 aa, Zea mays
  misc_feature: Ceres CLONE 1371670-F
  misc_feature: SWISSPROT Homolog: EC 1.2.4.1 Pyruvate dehydrogenase (acetyl-transferring)
  misc_feature (70)..(70): Xaa is any aa, unknown, or other
MTPIRHLDTPITEAVFSGIGVAAAYDGLRPIGEVMTDNYSMEEIGHMINSCCQVITTCQLRRHLTLMTCXPTRMVTA

SEQ ID NO: 12526 - DNA, 678 bp, Zea mays
  misc_feature: Ceres CLONE 1371677-F
  misc_feature: Translation starting site: 194
  misc_feature (336)..(336): n is a, c, t, g, unknown, or other
  misc_feature (377)..(377): n is a, c, t, g, unknown, or other
  misc_feature (378)..(378): n is a, c, t, g, unknown, or other
  misc_feature (398)..(398): n is a, c, t, g, unknown, or other
  misc_feature (402)..(402): n is a, c, t, g, unknown, or other
tggagctccccgcggtggcggccgctctagaactagtggatcccccgggctgcaggaattcgcacgagaccattacctagaacatcataatcgaaaaacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcangaagctccagactggagtcaataagcttgcagacctagtcnngagtacactcggaccaaggnaaangaaaatgtgttttggagagcaagtatgggtctcctaaaaatgttaacgatggtgttacagttgccaaaaaagttgacctggaggaccctggggagaaaattgggggctaaatttggccggcaagcaccagttaaacccaatggtctactggggaaggggaaacccccccctgggggccttggccaggggcttgaacccttaagggggttaaggttggggaaatggggggaaaacccgtgtcaaataaaccggggggttcggaaaaaacggaaaaac

SEQ ID NO: 12527 - DNA, 677 bp, Zea mays
  misc_feature: Ceres CLONE 1371682-F
  misc_feature: Encodes the peptide sequence at SEQ ID NO. 12528
  misc_feature (567)..(567): n is a, c, t, g, unknown, or other
  misc_feature (675)..(675): n is a, c, t, g, unknown, or other
aaagctggagctccccgcggtggcggccgctctagaactagtggatcccccgggctgcaggaattcgcacgagaccattacctagaacatcctaatcgaaaaacaccgcacacgcacgcacgaacgcgctcccaccccctcccgccgcaaacgccgccaaaaccccggcccgactcggcgtcctccgccaacctcctcctgggcagcgccggcggggggatatggcatcggaggacgtggtgggcaagagcaggggcgacacggccgtcaccaccatcgtcaacctggcggaggaggccaagctcgcgcgcgagggggtcaaggcgcccggccaccagatcctcaccatctgcaagtcgctcgtcgccggcggcgtagcaggcggagtgtctcgtactgctgttgctccacttgaacgattgaaaatattgcttcaggttcaaaatccgcacagcatcaagtacaatggtactgttcagggtctcaagtatatctggagaacagagggcctccgtggacttttcaagggcaatggtaccaattggtgcaaggattgttccaaattcntgcccgtgaagttttttagctacgagcaggcgtcaaaggggaattctgtgggcctaccgtcaaaggaactgggttgaagaggatgctcagcttactccgctcttgcgncc

SEQ ID NO: 12528 - protein, 140 aa, Zea mays
  misc_feature: Ceres CLONE 1371682-F
  misc_feature (42)..(130): Pfam Name: Mito_carr Pfam Description: Mitochondrial carrier protein
  misc_feature (116)..(116): Xaa is any aa, unknown, or other
MASEDVVGKSRGDTAVTTIVNLAEEAKLAREGVKAPGHQILTICKSLVAGGVAGGVSRTAVAPLERLKILLQVQNPHSIKYNGTVQGLKYIWRTEGLRGLFKGNGTNWCKDCSKFXPVKFFSYEQASKGNSVGLPSKELG

SEQ ID NO: 12529 - DNA, 637 bp, Zea mays
  misc_feature: Ceres CLONE 1371705-F
  misc_feature (399)..(399): n is a, c, t, g, unknown, or other
  misc_feature (483)..(483): n is a, c, t, g, unknown, or other
aaagctggagctccccgcggtggcggccgctctagaactagtggatcccccgggctgcaggaattcgcacgagaccattacctagaacatcctaatcaaaaacagagagagagagagaaaaaaaaaccctcgtttggtcgccggcacacaagacggtagtaggcggcgatcgatcggtggacgacggacggaactcagctaagcaatctcgcctcgtcttctccggcggcgacacacacgcgccccttctacgtcgagaaatcagttccccatcctccatcatccattccgattctccatctatcgctggtgcggcaggatcgcagtagctagcacgcgtccgtcgtctggggtcccgtccggcggcgcaatggccgcctgtgccggcgtaggaccggntgtggggaattagtgggtggtcccagattatcttttgcatttgtcaatatcttctataagctagcttgtgtcggacggcatggnatctgagggtactcatcgcctaccgctaccttttcggatcagccttcctcggcccgctcgcctacttcgtcgagaggaaaaccgaacgaatgactggggaggggggggggtcttggctttcgcgtgtggcctctcaggggcacgatggcgcaga

SEQ ID NO: 12530 - DNA, 651 bp, Zea mays
  misc_feature: Ceres CLONE 1371709-F
  misc_feature: Encodes the peptide sequence at SEQ ID NO. 12531
tggagctccccgcggtggcggccgctctagaactagtggatcccccgggctgcaggaattcgcacgagaccattacctagaacatcctaatcgaaaaaagatccaccaccccaccaaccaactactctcacagtctcacctcccgctcctgccccctccctctcgttctcttcctaaatggcggccgagtccgccagggcgccctcgccgccgcgcgactccggctgccccgcgggcgcgggagactccaccagctcccagatgaccgcgacctacctcggcgtcagcttcgcgctcttcctcgccacgctcccgtcgggcaccgcggcgcgccacgtggcctcgctccagtcgcggggccgcctcctcgcctcgcgcctgctggacgccgaggaccaagtgcgtgaaatgcgtcgcgcgccaacgaaaggacgcccgagacgacgtccgcgtgacataaattctgacgacgcacccttacaccaggatggagatggacagcttcctgcagggccgcgacgacctcgtcggggtcaaggccgcctcgctccgaacgaaactctgcgactataaggccgaggacactgacacggcttgcccgccccaagagactcgagggtgacgcctgcaattggtatgacctgatcatct

SEQ ID NO: 12531 - protein, 44 aa, Zea mays
  misc_feature: Ceres CLONE 1371709-F
MEMDSFLQGRDDLVGVKAASLRTKLCDYKAEDTDTACPPQETRG

SEQ ID NO: 12532 - DNA, 649 bp, Zea mays
  misc_feature: Ceres CLONE 1371713-F
  misc_feature: Encodes the peptide sequence at SEQ ID NO. 12533
  misc_feature (271)..(271): n is a, c, t, g, unknown, or other
  misc_feature (314)..(314): n is a, c, t, g, unknown, or other
  misc_feature (315)..(315): n is a, c, t, g, unknown, or other
  misc_feature (554)..(554): n is a, c, t, g, unknown, or other
aaagctggagctccccgcggtggcggccgctctagaactagtggatcccccgggctgcaggaattcgcacgagaccattacctagaacatcctaatcaaaaaaaacccgaatcccaaacggaggagggcactcggcgaggcaggtggcgattctgcgattctcctgtcaccttccgtcgtctccatccccttccatttccggcgagggtcaaagcaggcctcttgctctttgggggtggtttgagagagggagagaacatggccgcggcgngcggtgttggtggtgctcacggtgtcagcgctggcgggggcanncggccggcggtgatatcgtccaccacgatgacgaggcacccaagatccctggatgctccaacgattttatcctggtaaaaggtgcaaagctgggtcatggcaaagaggggtggcgagttttgttggcgtcggtggcttcggtttggtccaaaaatcgtctccaaggagaagcacgcaaaccgaactaaactcacgctggcagaacctatggactgctgctctcctccgaaaataaggtnccctggagatgttcttttagtcaaaaggggaaagtgcaattcacaagaaagcaaagtttgctgaaagctgctggtgcttctgctatagaatcata

SEQ ID NO: 12533 - protein, 68 aa, Zea mays
  misc_feature: Ceres CLONE 1371713-F
  misc_feature (48)..(48): Xaa is any aa, unknown, or other
MAKRGGEFCWRRWLRFGPKIVSKEKHANRTKLTLAEPMDCCSPPKIRXPGDVLLVKRGKCNSQESKVC

SEQ ID NO: 12534 - DNA, 698 bp, Zea mays
  misc_feature: Ceres CLONE 1371721-F
  misc_feature: Encodes the peptide sequence at SEQ ID NO. 12535
  misc_feature (449)..(449): n is a, c, t, g, unknown, or other
  misc_feature (460)..(460): n is a, c, t, g, unknown, or other
  misc_feature (479)..(479): n is a, c, t, g, unknown, or other
  misc_feature (484)..(484): n is a, c, t, g, unknown, or other
  misc_feature (506)..(506): n is a, c, t, g, unknown, or other
  misc_feature (507)..(507): n is a, c, t, g, unknown, or other
  misc_feature (631)..(631): n is a, c, t, g, unknown, or other
  misc_feature (633)..(633): n is a, c, t, g, unknown, or other
acaagctggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggaggggggggaaatcggggaaggaggaggtggagggaagtattgagagcgacattgaggaagcttggaggagcttgctttctaagctgaaccctcgcgcggnaggagtccccngtgccgcagtcccgcccgnccggntggggaaacggcggcggctccnnccgcctttcggccgacgcggcccccgtgttccgtgggccggccgggcgatcgaactaactaacgcgcgccaccaccagcttccccgccgccgcagctttctgcagcagcagcagccgatgacgngnctttgaaatttggtggtggcgccccggcgggtgggcatgggtggcggccccgggggtatggactc

SEQ ID NO: 12535 - protein, 64 aa, Zea mays
  misc_feature: Ceres CLONE 1371721-F
MVAVAVDGLIRGADAVPAAEREAVRAAAAEAAAKGGGGGNRGRRRWREVLRATLRKLGGACFLS

SEQ ID NO: 12536 - DNA, 646 bp, Zea mays
  misc_feature: Ceres CLONE 1371723-F
  misc_feature: Encodes the peptide sequence at SEQ ID NO. 12537
  misc_feature (172)..(172): n is a, c, t, g, unknown, or other
  misc_feature (309)..(309): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
gctggagctccccgcggtggcggccgctctagaactagtggatcccccgggctgcaggaattcgcacgagaccattacctagaacatcctaatcgaaaactccttgctctgccgagaagccggcgatgaggggccgcaagaggcagcaggtgagcgccagctcggccgccgncgctggtgaaggggagggagagcaccaaacagaaggagaaagaagctaggaaggagaaggaggcgagggaagccggcagggagccggcggcgaaggagaggctgatgaggcgcaaggcggaaaggaagacgggtggnagaggggaaggagcgcnnnaaaggagggtgaggggagagggcaagcagaacgacacgcaggagaaggcgaaggccaacgtctgcccgcagttcttcaaggtcttcttccccgagcagtccacggagcggctgagaatcccaaccatgttcaaccagcacctcaaggagcagcagcaaaccggagcagtttccctgagaggcccgagcggcaacagatggcaggcagcgctcgcttccgagtccgagtcggaggccgcgtggtgctttcgaccaggctgggaaggagtttgtcacggaccactccctcaggctaggccacttcctggtctcaacgcgc

SEQ ID NO: 12537 - protein, 123 aa, Zea mays
  misc_feature: Ceres CLONE 1371723-F
  misc_feature (17)..(17): Xaa is any aa, unknown, or other
  misc_feature (18)..(18): Xaa is any aa, unknown, or other
MRRKAERKTGGRGEGAXXRRVRGEGKQNDTQEKAKANVCPQFFKVFFPEQSTERLRIPTMFNQHLKEQQQTGAVSLRGPSGNRWQAALASESESEAAWCFRPGWEGVCHGPLPQARPLPGLNA

SEQ ID NO: 12538 - DNA, 597 bp, Zea mays
  misc_feature: Ceres CLONE 1371728-F
  misc_feature: Encodes the peptide sequence at SEQ ID NO. 12539
  misc_feature (47)..(47): n is a, c, t, g, unknown, or other
  misc_feature (80)..(80): n is a, c, t, g, unknown, or other
  misc_feature (257)..(257): n is a, c, t, g, unknown, or other
  misc_feature (343)..(343): n is a, c, t, g, unknown, or other
  misc_feature (355)..(355): n is a, c, t, g, unknown, or other
  misc_feature (356)..(356): n is a, c, t, g, unknown, or other
  misc_feature (388)..(388): n is a, c, t, g, unknown, or other
tggagctccccgcggtggcggccgctctagaactagtggatcccccngggctgcaggaattcgcacgagaccattacctnagaacatcctaatcgaaaagagaagagcggcggcgcgggcggacaaggagcaggcggaggaggagctgtgccaagccacaatgggtatctcgcgtgactcgatgcacaagcgccgggccaccggtggaaagcagaaggcctggaggaagaagcgaaagtatgagcttggtcgccagncagccccacaccaaagttgtcaagcaataagacagtgaggaggggtccgtggtcgtgggagtaatgtgaaatggagggctcttcgncctgaatctggnnactacctcatgggaaattgaacctgttacccnaaaaaccggacctccaacgggcctacaatggctcaacaatggggtttgggaggaaccaaaccctttggaaaaagggcctttggcaaattgaaccttgccctttttaggagggggacccctccccccattgggggtgtaccttggggaaaaaaaaaaaaccccccttttcaaaaaaaaattatatgttgggggcaaaaaaagttgtggga

SEQ ID NO: 12539 - protein, 44 aa, Zea mays
  misc_feature: Ceres CLONE 1371728-F
  misc_feature (33)..(33): Xaa is any aa, unknown, or other
MGISRDSMHKRRATGGKQKAWRKKRKYELGRQXAPHQSCQAIRQ

SEQ ID NO: 12540 - DNA, 654 bp, Zea mays
  misc_feature: Ceres CLONE 1371735-F
  misc_feature (643)..(643): n is a, c, t, g, unknown, or other
aagctggagctccccgcggtggcggccgctctagaactagtggatcccccgggctgcaggaattcgcacgagaccattacctaacatcctaatcgaaaagtctcgcgccggccccccgtgggaaactagaactgactccctcgatcccagcggcagcggcggaagcgaacggtgaccgcgacctcccctgaggctgcatatactcggatcgggtttcacatctccggttttggattggttggttgcccgcggcgatgggaggagagctgtggtggtatccataggggatcctcggttgcatccttgtgcgatggcttcgacctccgttcctgagttaaccgcggacaagaaatgcgacaaagccatcgcggatacggcggcaccacttacttctcagggacactccgaagaaccgactgggaaaatcagcacactagtgcctgcttttgccggttgtaattgcagcaggcgatggggctgcatcccagtggggtgatagaaaacagaaatggcatggacaatttctgctgatggttctttgaagcgggatgaaaccagtgaagggtgctgagaagagctcgctggccgggggagcgtcaggaaaaaaaaccttcggtgtcggcttaattgcagttgacagggncgagcagcctg

SEQ ID NO: 12541 - DNA, 751 bp, Zea mays
  misc_feature: Ceres CLONE 1371735-R
  misc_feature: Pfam Name: Pyr_redox_dim Pfam Description: Pyridine nucleotide-disulphide oxidoreductase, dimerisation domain
  misc_feature: SWISSPROT Homolog: EC 1.8.1.7 Glutathione-disulfide reductase
cgattgggtaccgggccccccctcgaggtcgacggtatcgataagcttttttttttttttttttcaagaaaatccatggtgctcattatttcacggtgtgttgccatgaaaaaaaaaattattccttcaatatacatggattccagttccaatgacgttgaaattaccaacgtgtatgaaaccagtgtatttgtccggtgtaacattcccccaaaacaccaatttcttgcttacaagttcgtctttggattggatgtctggctcaagcgccttgacgcggtgcgcatggtcacgaactcttcaccaacgaaagggtggattcccacagtgctgtcgaactcttgctttggtggctccacatttaaccgcaatagcgatgccctgtataatttcaggtgcgtctggtccacacttggatgcaccaagtactttgtcagtttcagcatcaaataccagtttcatgatagtcttctcctggcgcttggacatgctgtacttcattgggttgaatgaccacatgaaaactccattgtcaccattggcttcctccaaggcctgttcatcgctgaggcccactacagatcgtggtagaatgtagaacacatccaaggaacatctatgtgatcatgcttaacttgctggccaccaaacacatttttagcagagcaagttgcctccattaatgcagcaggtgttcacttaatcctgcttggtacatcacctacatgcctgtcactaagagcataagtct

SEQ ID NO: 12542 - DNA, 628 bp, Zea mays
  misc_feature: Ceres CLONE 1371738-F
  misc_feature: Encodes the peptide sequence at SEQ ID NO. 12543
tggagctccccgcggtggcggccgctctagaactagtggatcccccgggctgcaggaattcgcacgagaccattacctagaacatcctaatcgaaaaaccaaaggtatcttgcaatcacaacgaacaaaagctctcgatctcaccgacaccgaggaagaagagatcaatggcgtccgagcagggagtcgtgatcgcgtgccacagcaagggtgagtttgacgcccacatgaccaaggcccaggaagccggcaagctggtggtcatcgacttcactgccgcctggtgcggtccatgccgcgccatcgccccactgttcgtcgaacacgccaagaagctcactcaggtcgtcttcctagaggtggacgtgtacgaagtgaatgcagtcaccgcggtctacgaagtcgaggcgatgccgaccattcacttcgtcaagaacgacaagacggtcgcgaccatcgtgggctgcatgaaggacgagctcctgatcctgatcgaaaacatgccgcggctgcgcctgcgactggcgctgcctaaatgagacagatcagtcgtcgccgccaatagggccagcagaatggctgaaaatggtaccgtatcagttttggctttgcctttgggggccatttg

SEQ ID NO: 12543 - protein, 123 aa, Zea mays
  misc_feature: Ceres CLONE 1371738-F
  misc_feature (8)..(111): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASEQGVVIACHSKGEFDAHMTKAQEAGKLVVIDFTAAWCGPCRAIAPLFVEHAKKLTQVVFLEVDVYEVNAVTAVYEVEAMPTIHFVKNDKTVATIVGCMKDELLILIENMPRLRLRLALPK

SEQ ID NO: 12544 - DNA, 637 bp, Zea mays
  misc_feature: Ceres CLONE 1371743-F
  misc_feature: Encodes the peptide sequence at SEQ ID NO. 12545
  misc_feature (229)..(229): n is a, c, t, g, unknown, or other
  misc_feature (605)..(605): n is a, c, t, g, unknown, or other
aaagctggagctccccgcggtggcggccgctctagaactagtggatcccccgggctgcaggaattcgcacgagaccattacctagaacatcctaatccgaaaactcctctcgctcgcgtccgcacaaatcccgtgctcccccgtctgaaaaccctccccacctccggcggcggcggcggcgctggcgaccgggtgtcttctccggcgagtctcccccctagtaacaaanaaatatggatgtacctgttgatgaccctgtggagaacctcactggaagtcctagtacccttgcaatgaggaagaagccactacttatgctaatgtgcaagatcagtccaaggaagaaccagaaaagctttacgaggaacccaaagacccaatgcaagacgagttgggtaaccaagggcatgtgagcatgacaatgaagatgtgggaggccagcaaagtggaccaagctacccccacagaagcacggcgaggaagctggggtgaagcagcatgatgctacagttcctgatgacaagaaatggcctgggtggctgggaagagagtgtgtttccgtatactggttctaccacaaaggggtgggtgccgtcattgggcgncaaaggggatttcatcaaagaaaatgtgtgaa

SEQ ID NO: 12545 - protein, 40 aa, Zea mays
  misc_feature: Ceres CLONE 1371743-F
MQDELGNQGHVSMTMKMWEASKVDQATPTEARRGSWGEAA

SEQ ID NO: 12546 - DNA, 654 bp, Zea mays
  misc_feature: Ceres CLONE 1371744-F
  misc_feature: Encodes the peptide sequence at SEQ ID NO. 12547
  misc_feature (280)..(280): n is a, c, t, g, unknown, or other
  misc_feature (349)..(349): n is a, c, t, g, unknown, or other
  misc_feature (487)..(487): n is a, c, t, g, unknown, or other
  misc_feature (494)..(494): n is a, c, t, g, unknown, or other
  misc_feature (495)..(495): n is a, c, t, g, unknown, or other
  misc_feature (612)..(612): n is a, c, t, g, unknown, or other
  misc_feature (613)..(613): n is a, c, t, g, unknown, or other
  misc_feature (615)..(615): n is a, c, t, g, unknown, or other
  misc_feature (616)..(616): n is a, c, t, g, unknown, or other
  misc_feature (654)..(654): n is a, c, t, g, unknown, or other
caaagctggagctccccgcggtggcggccgctctagaactagtggatcccccgggctgcaggaattcgcacgagaccattacctagaacatcttaatcaaaaaagcaccgctacttgtgctcccccaacgctactaccgccgctagctggttcaagtgcggcgagcggagccggagaccggtagaggaaattaagaggcgtcgatcgggcatggggtgcgacgacaagtgcgggtgcgccgtgccgtgccccggcggcaaagactgcaggtgcacgtcgngggagcggcgggcagcgggagcacacgacttggcggctgcggggagcactgcgagtgcagccggtgcancgtgtgggccgggccacgatgccgtccggccggcgagaacaggagggctaactgctccctggcggggcgtcctgcaactgcgcatcctgcgcctcggcctgatccatgcgcctcgccctcgtgctaccgcgctgcctntggggannggggagttgtctagtgaggctctggagacgaagcaactagcactacttctattaaaaggggcttgtgtcatgctcgccagacgcatcacgcgctgatcctgcatcgtgtatcggggnnannaagtttgtgtatgaataaacactaccactttatgtctn

SEQ ID NO: 12547 - protein, 126 aa, Zea mays
  misc_feature: Ceres CLONE 1371744-F
  misc_feature (2)..(59): Pfam Name: Metallothio_PEC Pfam Description: Plant PEC family metallothionein
  misc_feature (24)..(24): Xaa is any aa, unknown, or other
  misc_feature (47)..(47): Xaa is any aa, unknown, or other
  misc_feature (93)..(93): Xaa is any aa, unknown, or other
  misc_feature (95)..(95): Xaa is any aa, unknown, or other
MGCDDKCGCAVPCPGGKDCRCTSXERRAAGAHDLAAAGSTASAAGAXCGPGHDAVRPARTGGLTAPWRGVLQLRILRLGLIHAPRPRATALPXGXGELSSEALETKQLALLLLKGACVMLARRITR

SEQ ID NO: 12548 - DNA, 662 bp, Zea mays
  misc_feature: Ceres CLONE 1371747-F
  misc_feature: Encodes the peptide sequence at SEQ ID NO. 12549
  misc_feature (513)..(513): n is a, c, t, g, unknown, or other
  misc_feature (514)..(514): n is a, c, t, g, unknown, or other
  misc_feature (546)..(546): n is a, c, t, g, unknown, or other
aaagctggagctccccgcggtggcggccgctctagaactagtggatcccccgggctgcaggaattcgcacgagaccattacctagaacatcctaatcgaaaagttcccctttccctcctgcgcacccgtcttctcctccccgcgtcaaaccccagcacaaaaagcaaccgcccgccgcctcctcgctcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccggcaactacgtcaaggcgttccctctctacatgaacgcgctcgagtacttcaaaacccacctcaagtacgagaagaaccccaagatcaaggaggccatcaccgccaagttcaccgagtacctccgccgcgccgaggagaatccgggcggcctccgatgggggnntggcgcagggcggggccccccaacgggtgccnggacgcagcttgtcgccacgcgccccaagaccagggggcaagggacgggggacggaggccacgcggaggggatgaactccgagcagtccaaggcttggaggggcggggctcaactc

SEQ ID NO: 12549 - protein, 126 aa, Zea mays
  misc_feature: Ceres CLONE 1371747-F
  misc_feature (5)..(73): Pfam Name: MIT Pfam Description: MIT (microtubule interacting and transport) domain
  misc_feature: SWISSPROT Homolog: EC 2.7.11.1 Non-specific serine/threonine protein kinase
  misc_feature (77)..(77): Xaa is any aa, unknown, or other
  misc_feature (88)..(88): Xaa is any aa, unknown, or other
MYSNFKEQAIEYVKQAVQEDNAGNYVKAFPLYMNALEYFKTHLKYEKNPKIKEAITAKFTEYLRRAEENPGGLRWGXGAGRGPPTGAXTQLVATRPKTRGQGTGDGGHAEGMNSEQSKAWRGGAQL

SEQ ID NO: 12550 - DNA, 650 bp, Zea mays
  misc_feature: Ceres CLONE 1371755-F
  misc_feature (248)..(248): n is a, c, t, g, unknown, or other
  misc_feature (329)..(329): n is a, c, t, g, unknown, or other
  misc_feature (331)..(331): n is a, c, t, g, unknown, or other
  misc_feature (334)..(334): n is a, c, t, g, unknown, or other
  misc_feature (337)..(337): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (370)..(370): n is a, c, t, g, unknown, or other
  misc_feature (393)..(393): n is a, c, t, g, unknown, or other
  misc_feature (428)..(428): n is a, c, t, g, unknown, or other
aaagctggagctcaccgcggtggcggccgctctagaactagtggatcccccgggctgcaggaattcgcacgagaccattacctagaacatcctaatcgaaaaagcctccgccatttcttcatctccaatctccatccttccatcttccgctccctcccctgcttgcgctcgtcgcgcaggcgacctcggcggcgctcgggctcggcctctcagcgacggcgtcagcggcttcccctcctgcctctcgncagtcccctcggctctggtcctctgcgcaacgggcggtggaccctgcgtgcgtgggctctttctctctctctctccctctncnctnaanaaaaaaaannnaaaaaaaannnnnnnnacaaancccccaacattttataaaaaaancaacaaatttccccccccctaaaaaataaaacccncgaacggggctgaagagggaaggggaaatccaagggacgcgtgctccaaccaaggagggtcgagggcgcgttatctgaggccttaagggtgggatgggccccaacggtaaaccggtacccccacaaacttaacgctttcagggttaaagggcccgtttttttggaaacccgggaaaatagggcaggatttcaggttaacagggtataggggaactccttcga

SEQ ID NO: 12551 - DNA, 663 bp, Zea mays
  misc_feature: Ceres CLONE 1371762-F
  misc_feature: Pfam Name: UAA Pfam Description: UAA transporter family
  misc_feature (256)..(256): n is a, c, t, g, unknown, or other
  misc_feature (362)..(362): n is a, c, t, g, unknown, or other
  misc_feature (446)..(446): n is a, c, t, g, unknown, or other
aaagctggagctccccgcggtggcggccgctctagaactagtggatcccccgggctgcaggaattcgcacgagaccattacctagaacatcctaatcgaaaaaccacacacagagaaagagaaagagccacgcattgcacttggcttgcacaagcccggaggagccccaaacgcggcggcggacggaatgcggctgcgcctgcctcagtgaacattctgctgtgatggcgaaggagtactacactacgagcagccnttgtggttgggtacgcgctgtgctcgagcctgctctcgatcatcaacaagtatgccgtgacaaaagttcggtttcccaggcctcctgaccgctctacagtactcgnacatccgctgctgggtgtctggatcctcggaaagctaggcttcctcacacatgaccccttcaacctggaaccccgcaaagaagntcgcgccgggcggctctcgtcttctacctagccatattcaccaacacgaacctcctctgccacgccaacgtcgacaccttcataagtcttcagatccctgaccccgctcctggtcgccacgcccgacacgaacgttccggaagcagccatgcccttcccagtttcacgtcctgggtccctcgtggcatcgttgggggcggaggggtcggtaacgtga

SEQ ID NO: 12552 - DNA, 586 bp, Zea mays
  misc_feature: Ceres CLONE 1371765-F
  misc_feature: Encodes the peptide sequence at SEQ ID NO. 12553
  misc_feature (426)..(426): n is a, c, t, g, unknown, or other
  misc_feature (586)..(586): n is a, c, t, g, unknown, or other
tccccgcggtggcggccgctctagaactagtggatcccccgggctgcaggaattcgcacgagaccattacctagaacatcctaatcgaaaactgaggtagtagagctcactccaccacttgactctcgtctcgtctctgcactggattggaggttggggccgtgaagggtaggtaggtcgcttgatagggacaaggggggagacggcgagaggcgtttcgccgagcagttcgcgtgctcccctccacaggccgacgcggcgacgccgctgtttcaggttctggaatttccagtgcgggtgcattaggctgctatgggcaagtcgccggggaagtggatcaaatcggtgcttttggggaagaaatctaccaagtcaggtcctaccaagtcgaatgaatctgctgacaacaacagatactcgaccggngaggaccgcacattgtctgagagttctcctgtgatttctgagccggtactagttaacatccacaagaacgtagctatcaatgggaaggctgcagatgccagtgatagggcacggcaacaagatccgcagagccaaaagcgtgttgagtccagatcatcgn

SEQ ID NO: 12553 - protein, 91 aa, Zea mays
  misc_feature: Ceres CLONE 1371765-F
MGKSPGKWIKSVLLGKKSTKSGPTKSNESADNNRYSTGEDRTLSESSPVISEPVLVNIHKNVAINGKAADASDRARQQDPQSQKRVESRSS

SEQ ID NO: 12554 - DNA, 672 bp, Zea mays
  misc_feature: Ceres CLONE 1371875-F
  misc_feature: Encodes the peptide sequence at SEQ ID NO. 12555
  misc_feature (514)..(514): n is a, c, t, g, unknown, or other
aaagctggagctcaccgcggtggcggccgctctagaactagtggatcccccgggctgcaggaattcgcacgagaccattacctagaacatcctaatcgaaaaacgcagcagcgacgcgacgcccccgccccgcgtcttctactcttcttcatcttcactgctcaccaacccatccatcccccagtcctcctcactgctcacccgtctcccatccccacaccaccaccaccaccatcttccggtcttcccctccccacacccggcgggatccccaccatccccgccccccgatggagctgttcgcgcgcgccaaggtggtgcggctcaagagccaccacgacaagttcctgtacgcggacgaggacgaggcgcacgtgacgcaggagcgggacgggtcgtcggcgaaccgcgcggtgggcccgtggagccggcgccgcacaacccgggcgccatccgcctgcggagccggtacggccactacctcaccgcctcccggggagccgttcctgctggnggatgacggggccggaaagtggacgcagacggcgcccgccgcgccccgcccgccaacgcggtcccgtggactgggaagcccggtgcgggacggcttccaggcgcgcctccgcaccagggcgggccacttcctcgggggccaaacggggggctccccgc

SEQ ID NO: 12555 - protein, 127 aa, Zea mays
  misc_feature: Ceres CLONE 1371875-F
  misc_feature (1)..(127): Pfam Name: DUF569 Pfam Description: Protein of unknown function (DUF569)
  misc_feature (75)..(75): Xaa is any aa, unknown, or other
MELFARAKVVRLKSHHDKFLYADEDEAHVTQERDGSSANRAVGPWSRRRTTRAPSACGAGTATTSPPPGEPFLLXDDGAGKWTQTAPAAPRPPTRSRGLGSPVRDGFQARLRTRAGHFLGGQTGGSP

SEQ ID NO: 12556 - DNA, 746 bp, Zea mays
  misc_feature: Ceres CLONE 1371878-R
  misc_feature: Translation starting site: 299
  misc_feature: Pfam Name: Cupin_4 Pfam Description: Cupin superfamily protein
  misc_feature (746)..(746): n is a, c, t, g, unknown, or other
ccaattgggtaccgggccccccctcgaggtcgacggtatcgataagcttttttttttttttttttggtgccaatggataatcttaccagcagtcaaaagcagccatcgaacgatacatggcacaaccgtacaagtgtccagcacatacatgtcaggttttcctcgctaggagaaaagactagcctagccacgcaaccaccaccagaaaagcaaaacctttctctgtcacggcgaattctccacggctcagcctcagctcacgtgtgcacctgcaccgtgcaacgccagcatccccctcatgtactgggtcctagccattctgtacatctcgagcaaagtcccaaaggcctcgcacgcgtcctcgtacgcgacgcgccggcaaaaccctgacttgaaggccgtgaggccatccagggcctggccagggtcagagtcgaacgcctccacgagcgcctcgagggcgcccaagacattgcagaagtcgatgatgtagcctgcagctgttccttgctgcggcaggtgccggagccagctcatccactggaaggctccgtcgtctctctctctcaccgccgacacgatgcgctccagcgcttccttgatgctgcagctctgatcgatcttcctcagtatctcgtcgaaagttgacctctggctgcttcgaagagcctccaggtgagtcgttgtggatgtacaggaactggacgacgtcgctgcctttgctgcgacatgcacgccttactgan

SEQ ID NO: 12557 - DNA, 627 bp, Zea mays
  misc_feature: Ceres CLONE 1371878-F
  misc_feature: Encodes the peptide sequence at SEQ ID NO. 12558
ggagctccccgcggtggcggccgctctagaactagtggatcccccgggctgcaggaattcgcacgagaccattacctagaacatcctaatcgaaaagcatccgtcttcctcctggaatcagatctgaacccgcggagacagaaacaaacgctcggtcgatcggtccgtggccgttgattgctttccctgctccgcgatcttacctgacaggtttttcgccggacatgttgccggcggccgaatcacgacgcgtacgtgagaggatcctgctacccgaggagcacttgatgaccgcctgctgcttctcgggctctcgcgcttacacgcctgctgtgtgacctctgccgcaactaggtcctgggcttctcccactcgtagtgtgatccggattatctccgtgggctgctgtcgcctgcgatggggttgcaggagctgcactagcaagaacctcgtggataacctgaggcttgactaccacacggtgatccgttacatcctgatgatgaacctgcaagagagaaaccagagggtcttcgacgatgtccgcatcgacatagtggaggagctgctccccgtcgtctacacgcccaccagttgcgagtcatgctgataagacgaggacatcta

SEQ ID NO: 12558 - protein, 36 aa, Zea mays
  misc_feature: Ceres CLONE 1371878-F
  misc_feature: SWISSPROT Homolog: EC 1.1.1.40 Malate dehydrogenase (oxaloacetate-decarboxylating) (NADP(+))
MMNLQERNQRVFDDVRIDIVEELLPVVYTPTSCESC

SEQ ID NO: 12559 - DNA, 668 bp, Zea mays
  misc_feature: Ceres CLONE 1371884-F
  misc_feature: Translation starting site: 323
  misc_feature: SWISSPROT Homolog: EC 2.7.1.20 Adenosine kinase
aaagctggagctccccgcggtggcggccgctctagaactagtggatcccccgggctgcaggaattcgcacgagaccattacctagaacatcctaatcgaaaaacttcacacccagcgcactcgagctcgagtcctcggcctctcctcaaacacaagtctcatatttcagtcacctgcgccgccgcttcggtcgtggggaggggagaagagaggaaatggcggcgaccgagggtgtgctcctggggtatgggcaaccccctcctcgacatctccgccgacgtctatgacgccttcctgacaaagcatgacatcaagctgaacaatggtattctcgctgatgacaagcacttgcctatggatgacgaggtggctagcaagagcaatgatgaatatattgccggaggagctcacccagaactatataacggttgcacaatggatgcttcaaactcctggtgcaacaagttacatgggatgcattggaaaggacaagttgggtgaggaaatgaacaaaaacgctcaagctgcaggagatactgctcattactacgaggatgacactgctcctactggcacatgtgctgaatgtgatgctgtggtggaaaggacattgattgataatctgtcagcgtcaaactgttacaaatgtgagcatctaaagagaacaa

SEQ ID NO: 12560 - DNA, 668 bp, Zea mays
  misc_feature: Ceres CLONE 1371887-F
  misc_feature: Encodes the peptide sequence at SEQ ID NO. 12561
  misc_feature (388)..(388): n is a, c, t, g, unknown, or other
tggcggccgctctagaactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacnagaactcgccgtggatgggcgtctacaacatcgaccccaagcgcgccatggagcttcgggccaagtgcgggctcgccacgcccgccgactgctagcagtgtgctagccaaggccaaggcagcaagaaaggcccccgggatttgctaagctgaacggggctggggggggcttcttggacaaggggggaaggaaggggcccccaaaagaaacgggggccctttttccccccccccaccttgggcgcccggaacccttatttaaagggggggggtgggtcccc

SEQ ID NO: 12561 - protein, 115 aa, Zea mays
  misc_feature: Ceres CLONE 1371887-F
  misc_feature (41)..(115): Pfam Name: Tryp_alpha_amyl Pfam Description: Protease inhibitor/seed storage/LTP family
  misc_feature (85)..(85): Xaa is any aa, unknown, or other
MAATSSKSSSSSSSAQRAAAALLVAAAVAVSVLVVGAAAVCDMSNEQFMSCQPAAAKTTDPPAAPSQACCDALAGADLKCLCGYXNSPWMGVYNIDPKRAMELRAKCGLATPADC

SEQ ID NO: 12562 - DNA, 652 bp, Zea mays
  misc_feature: Ceres CLONE 1371897-F
  misc_feature: Encodes the peptide sequence at SEQ ID NO. 12563
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (589)..(589): n is a, c, t, g, unknown, or other
aagctggagctccccgcggtggcggccgctctagaactagtggatcccccgggctgcaggaattcgcacgagaccattacctagaacatcctaatcgaaaaaccgagaaacaaaaattgaaggaaattgaaggggccgcagtgcagcaggacgatggtcagaacagtgaagacgggtggacctggttcagtagacccagcgtgagtactctcgcgccactcgcctccgcgtccgccaccgccttctccaccacacgccccactgcgtacaggccttgcttggactggtactgcatccaaagcaatgttagtagaacacacacacacacacgcatatgtgtatccgttacgtgctagtagcatgcagtacagtacctgagaggtgtatcttggaacgacccacgtctcgagcttgagcttgtggagcctgttggcctcggacctgaaggcggtccgggtccggccgaggagcgcggccagcgggcacgccaccgccgccgccagaagcctgctgctgctgctgctgcaggcgccgtagcgggacgcgggcggcgccggcgcggcggcgagggaccgaagcaannnnncgnaggcggaggaaggaggccggcgtgttgaggtgcgtgaggtggacgacgtcgggcgcgtcctcc

SEQ ID NO: 12563 - protein, 117 aa, Zea mays
  misc_feature: Ceres CLONE 1371897-F
AGAPRGGGRSRTSGSPGLQEFARDHYLEHPNRKTEKQKLKEIEGAAVQQDDGQNSEDGWTWFSRPSVSTLAPLASASATAFSTTRPTAYRPCLDWYCIQSNVSRTHTHTRICVSVTC

SEQ ID NO: 12564 - DNA, 842 bp, Zea mays
  misc_feature: Ceres CLONE 1371901-R
  misc_feature (1)..(1): n is a, c, t, g, unknown, or other
  misc_feature (10)..(10): n is a, c, t, g, unknown, or other
  misc_feature (799)..(799): n is a, c, t, g, unknown, or other
nccaaaaggntaccgggccccccctcgaggtcgacggtatcgatattttttttttttttttttcacgtcaaagtcttattgttacagcccaataatctagtcaaaggtctcaatcttgtttacagcccaacaaacacactggctattttcagactaaattcagcattttctgattgttcgtatttaacagaacatccaacgttactttctaccttacataaattctatagtcggaagaattgagaattgcaattaggctgcacgttgtttctgcacccccggtataaacaagattgcagccatcctttttcagactccccaaaccacagcctactttttgaacctttgtaagaacaaaaaatggctcgataccgtgcttcctttcaatttgtactttatggtcaaacttcaaccctgctgactcatcagaatctcaatggcaacatttgggatccccatcagctgcagcaagagcaacttcagcctgagtcttttcaaatccccatttcaaccagcttcttaagttcttcatcaaatgtatcaacctgcctcaactgttcctgttggcatcaacctctgactgtggttcacagctgtaagctgtgataatcccttagtggggtcactttggagttgtgtttatcccaacaacctagcatgccaaatgcgcacttgccctccccttgcagtgagtttcatttccctacaaaaaccaagtggttcctgcctctcccaagaaaaaccttgtggtcttcctcctttccctgagcaattttgatatgtgtcctggctagggcantccctgtaagattatatttctctccaagaaaattttccatttt

SEQ ID NO: 12565 - DNA, 666 bp, Zea mays
  misc_feature: Ceres CLONE 1371923-F
  misc_feature: Encodes the peptide sequence at SEQ ID NO. 12566
aaagctggagctccccgcggtggcggccgctctagaactagtggatcccccgggctgcaggaattcgcacgagaccattacctagaacatcctaatcgaaaaagaattcgatttcttcaacatgtcttacgcttatctcttcaagtatatcatcatcggcgatactggagtagggaaatcatgccttctgcttcagttcacggacaagaggtttcagccggtgcatgatctcaccatcggtgttgagtttggggcgaggatgatcaccatcgacaacaagcccctcaaactccagatctgggataccgctggtcaagaatcatttaggtctattacaagatcctactatagaggtgctgctggggctttgcttgtctacgatatcactaggagggagacgtttaaccatctagctagctggttagaggatgcaaggcagcatgcaaatgctaatatgactattatgctcattgggaataagtgtgatcttgctcacaggagggctgtcaccactgaggaaggtgagcagtttgcaaaggagcacggtcttattttcatggaagcctctgccaagactgctcagaatgtcgaagaggcattcattaagacagcggcaacgatatacaaaagatacaaagatggtgtggttcgatggtgtcgaatgag

SEQ ID NO: 12566 - protein, 181 aa, Zea mays
  misc_feature: Ceres CLONE 1371923-F
  misc_feature (8)..(169): Pfam Name: Ras Pfam Description: Ras family
  misc_feature (8)..(122): Pfam Name: Miro Pfam Description: Miro-like protein
  misc_feature: SWISSPROT Homolog: EC 2.7.11.1 Non-specific serine/threonine protein kinase
MSYAYLFKYIIIGDTGVGKSCLLLQFTDKRFQPVHDLTIGVEFGARMITIDNKPLKLQIWDTAGQESFRSITRSYYRGAAGALLVYDITRRETFNHLASWLEDARQHANANMTIMLIGNKCDLAHRRAVTTEEGEQFAKEHGLIFMEASAKTAQNVEEAFIKTAATIYKRYKDGVVRWCRM

SEQ ID NO: 12567 - DNA, 650 bp, Zea mays
  misc_feature: Ceres CLONE 1371929-F
  misc_feature: Encodes the peptide sequence at SEQ ID NO. 12568
  misc_feature (650)..(650): n is a, c, t, g, unknown, or other
tggagctccccgcggtggcggccgctctataactagtggatcccccgggctgcaggaattcgcacgagaccattacctagaacatcctaatcgaaaaatcagacggactcacagctcgcagcacctgcaccacttgacaaccagccagctagctaaccaaccggcggagccaagaacaagcaagagacaacttgccccgtccaggcagcatgttcaactccaacgtcaagtccgcgggcgtcgcccagatcgacggccgcccggtgctgcagccggcgggcaaccgcgtggcggcgccggacgccgcccgcccgctcaagaagtccctgcacaagtccttctccatgccgccttcctacgacaacaatgccaccgtgcccgcccgtcccgcccctgccgagaacacccgtgcggcgccggagccggcttctctgctgcctcctacgacgccggccccggtcccggccgccgcgagggcgaccaaggcgacggacgccgtgcccgcggagaatcccaagtccaagggcatcaagcccggtgccgagctgccggaggagacgttcgcggtgccagaggtagttcgagccgaaggagagcatcgtcgcgttgcggctgcagcatgccgcacaggtgcaggcgcaccgcaagan

SEQ ID NO: 12568 - protein, 146 aa, Zea mays
  misc_feature: Ceres CLONE 1371929-F
MFNSNVKSAGVAQIDGRPVLQPAGNRVAAPDAARPLKKSLHKSFSMPPSYDNNATVPARPAPAENTRAAPEPASLLPPTTPAPVPAAARATKATDAVPAENPKSKGIKPGAELPEETFAVPEVVRAEGEHRRVAAAACRTGAGAPQ

SEQ ID NO: 12569 - DNA, 564 bp, Zea mays
  misc_feature: Ceres CLONE 1371934-F
  misc_feature: Encodes the peptide sequence at SEQ ID NO. 12570
  misc_feature (454)..(454): n is a, c, t, g, unknown, or other
  misc_feature (455)..(455): n is a, c, t, g, unknown, or other
  misc_feature (470)..(470): n is a, c, t, g, unknown, or other
  misc_feature (475)..(475): n is a, c, t, g, unknown, or other
  misc_feature (476)..(476): n is a, c, t, g, unknown, or other
  misc_feature (483)..(483): n is a, c, t, g, unknown, or other
aaagctggagctccccgcggtggcggccgctctagaactagtggatcccccgggctgcaggaattcgcacgagaccattacctagaacatcctaatcgaaaaatcctttccatcaaaactgagcaaacccctcatcctattctcgcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagaagatcggcgttgatgaggagatcttcgtggtcgacctcaagaagggcgaggtcaccaaagggccgtaccagggaaagccggatgccactttctccttcacgnnacacgatttccttgnaatcnngcacggncagacgaatccgcagattgcattcatcccgagggcgattaaatcaaggggagcatcagtgcggcgcagaaagtcacccctg

SEQ ID NO: 12570 - protein, 113 aa, Zea mays
  misc_feature: Ceres CLONE 1371934-F
  misc_feature: SWISSPROT Homolog: EC 2.3.1.176 Propanoyl-CoA C-acyltransferase
  misc_feature (77)..(77): Xaa is any aa, unknown, or other
  misc_feature (82)..(82): Xaa is any aa, unknown, or other
  misc_feature (84)..(84): Xaa is any aa, unknown, or other
MDSSSLKSAQLLELMRQHLATDAGKEVTKKVGLVYQLNIAPKKIGVDEEIFVVDLKKGEVTKGPYQGKPDATFSFTXHDFLXIXHGQTNPQIAFIPRAIKSRGASVRRRKSPL

SEQ ID NO: 12571 - DNA, 672 bp, Zea mays
  misc_feature: Ceres CLONE 1371940-F
  misc_feature (1)..(1): n is a, c, t, g, unknown, or other
  misc_feature (493)..(493): n is a, c, t, g, unknown, or other
  misc_feature (495)..(495): n is a, c, t, g, unknown, or other
  misc_feature (498)..(498): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (547)..(547): n is a, c, t, g, unknown, or other
  misc_feature (585)..(585): n is a, c, t, g, unknown, or other
  misc_feature (595)..(595): n is a, c, t, g, unknown, or other
  misc_feature (596)..(596): n is a, c, t, g, unknown, or other
  misc_feature (642)..(642): n is a, c, t, g, unknown, or other
  misc_feature (643)..(643): n is a, c, t, g, unknown, or other
naaagctggagctccccgcggtggcggccgctctagaactagtggatcccccgggctgcaggaattcgcacgagaccattacctagaacatcctaatcgaaaaccccgtccgtccgtccgtccctcacctcggcccgcctccctcatcaggtagccgtagcgagcagtatagcacgcacagccgccgccctgccctgccctgctcggcgtaggcacaggcacagcccagagcgagcgagacagagggaaagagacagagccagccaggtaaaaggcaaaagcacagcacattaaaagagaggccggaagcagcggcagagcggagagagagagagagaactagaagcatatatggcgatgccctttgcctccctgtctccggcagccgaccaccgcccctcctccctcctcccctactgccgcgccgcccctctctccgcggtgggagaggacgccgccgcgcaggcgcaggcgcagcagcagcacagttggncnggnaggtggggggggnnnnggggagcccgccggcgctctcaacgaggggcgncagtaacgaggagcttggagcaccaggcgctcatatanagtacctccnntcgcccggcgtgccccgtcccgccggacctcctcctccccctacgnncgaggcttcgtctaccaccaacccgcccg

SEQ ID NO: 12572 - DNA, 628 bp, Zea mays
  misc_feature: Ceres CLONE 1371941-F
  misc_feature: Encodes the peptide sequence at SEQ ID NO. 12573
  misc_feature (515)..(515): n is a, c, t, g, unknown, or other
tggagctccccgcggtggcggccgctctagaactagtggatcccccgggctgcaggaattcgcacgagaccattacctagaacatcctaatcgaaaaataatggcataaatccaattttctctacaggaaacacggaatcctcgctgacgccggagaagccgaagctaccagttcgcccgtcggagccgcagcacaggcgcttgcaaacgcgatggggagcgcggacctggtgctcaagatggattgcgagggctgcggcaacacgtcggatctctacggtacggggggcaagcacaccactctctgcagtgactgcgggaagtcgcatggcacgctcccgtgcccgctgcctcgtctgctccgcgcccatcaccaggctcatccgggaatataatgtacgagctaattctgttatggataagacatactctattggacgatttgtcactggtttacctcctttctcgaaaaagaagaatgccgagaacaagtggtctctccataaggagggtcntgcaaggccgtcagatagccgagaatatgcgggaaaaaacaacagaaaccatgtattttggaagacgaacaggccaataccagtatgaaggtcaaatggaaggatcacagtca

SEQ ID NO: 12573 - protein, 91 aa, Zea mays
  misc_feature: Ceres CLONE 1371941-F
  misc_feature (63)..(63): Xaa is any aa, unknown, or other
MARSRARCLVCSAPITRLIREYNVRANSVMDKTYSIGRFVTGLPPFSKKKNAENKWSLHKEGXARPSDSREYAGKNNRNHVFWKTNRPIPV

SEQ ID NO: 12574 - DNA, 585 bp, Zea mays
  misc_feature: Ceres CLONE 1371947-F
  misc_feature (585)..(585): n is a, c, t, g, unknown, or other
aaagctggagctccccgcggtggcggccgctctagaactagtggatcccccgggctgcaggaattcgcacgagaccattacctagaacatcctaatcaaaaaaatctctcgcacgcaaacgactagtgcaggtgcattgaacaccccctctcgctcgcggacgcggaacggcggcggcgatccaccgcggctcgctgtcttcgccagtgatctggtctcttcgagtcccggcatcagataatcatccacagcccctcccctcctctcccagacccctcccttccccttccggtgaatcggcgaggagaggatgccgtcccggcggggcagcagcagttgcgtgctctgcgagggatccaacctgccgtcttgatgcgcctcgtgcgcaacgcgagggctggtcgagtaccacacgacgctgcgcatgatgagggagctccgcgactccctccacgggcgaatcgccgcacgcctcgaagccatgagaaaaaccatgagcagcggatctggagaacagcaaagaacaggatatcatggcagttgaggaatcggctcactgaattgaagagaaaaactgccgtaacn

SEQ ID NO: 12575 - DNA, 722 bp, Zea mays
  misc_feature: Ceres CLONE 1371949-R
  misc_feature: Encodes the peptide sequence at SEQ ID NO. 12576
  misc_feature (560)..(560): n is a, c, t, g, unknown, or other
ccgattgggtaccgggccccccctcgaggtcgacggtatcgataagcttttttttttttttttttggttaaagagctgtggattcgtcaacgtcacagttaacacaagcacaagttcattggatcaccagttcaccgctggctgtgcaaggagcaaagcaaacaagcacacatagctgcacgcgagacaccaaaccaatcacaccacgctgttgtagtcgagacaccacgccgtcaatcaggacaccctgaggcactgctgcttgaacatcttgctcgtctgctgcccgctcgccgagtcctccacggtgaggccctgcgcgccaaagcagatgttgatgagcctcccgttgccgcacccgtgcttcggggccgcgctctctgccgtcccgggcgcacagccgtcgtccatggacgagttgttggagcacgaggggtcctccatggcgtcgtcactatccttcagccctgcggcgggcgcgtcaccatggagatctcgtcgtcgaggaaatgtccttcagcttcccaggcgctgcgggttaacgataccccagaactcangaaagtgtccgtccggacccggaccgcccctaaatggccccagctgtggatggcctccatgagcccgggaagaacctccggttgagctcctccttggggataagaaccccgggtgagaaccttacccccagggtccccttgcctttaacccccccccttgga

SEQ ID NO: 12576 - protein, 52 aa, Zea mays
  misc_feature: Ceres CLONE 1371949-R
  misc_feature (25)..(25): Xaa is any aa, unknown, or other
MEISSSRKCPSASQALRVNDTPELXKVSVRTRTAPKWPQLWMASMSPGRTSG

SEQ ID NO: 12577 - DNA, 616 bp, Zea mays
  misc_feature: Ceres CLONE 1371955-F
  misc_feature: Encodes the peptide sequence at SEQ ID NO. 12578
  misc_feature (469)..(469): n is a, c, t, g, unknown, or other
  misc_feature (492)..(492): n is a, c, t, g, unknown, or other
tggagctccccgcggtggcggccgctctagaactagtggatcccccgggctgcaggaattcgcacgagaccattacctagaacatcctaatcgaaaagcagatcagagagaccgaggcgcccgcggttctgctttccttccttgccccgttcacgagagaattttctggagtcttcgactcgagcagggttccgatggcgctgcaatggatgatcctggcgtgcgtggtggcggtggaagctgcggtggctgcgctggtcacgctcccggtgccccgcgctgtgcggggccagatcgtcgcgctcacgtccttgttcctgcagcccctgtccagtgtgatacccttcgccgcttcagatcctcgatctctactggaagaggagacagactgatgtgcactcggagattgcacgccgagagcgattcgctcgagaaatctatgttaagctcagagaatgtcatttcttgngttcagcatgtctcctttatggntgcatttatcgtattgtaaaattgaacaggataattaaggcttttggaagagaccgagaagcggcctccagggagaggagatctattggggtttaaagggggctggtggcctgctcccgggctt

SEQ ID NO: 12578 - protein, 65 aa, Zea mays
  misc_feature: Ceres CLONE 1371955-F
MALQWMILACVVAVEAAVAALVTLPVPRAVRGQIVALTSLFLQPLSSVIPFAASDPRSLLEEETD

SEQ ID NO: 12579 - DNA, 641 bp, Zea mays
  misc_feature: Ceres CLONE 1371961-F
  misc_feature: Encodes the peptide sequence at SEQ ID NO. 12580
  misc_feature (417)..(417): n is a, c, t, g, unknown, or other
  misc_feature (534)..(534): n is a, c, t, g, unknown, or other
  misc_feature (568)..(568): n is a, c, t, g, unknown, or other
  misc_feature (625)..(625): n is a, c, t, g, unknown, or other
tccccgcggtggcggccgctctagaactagtggatcccccgggctgcaggaattcgcacgagaccattacctagaacatcctaatcgaaaaaaaaaaacgcacggggagcttggagacttcacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccggcgtgcgcgtgctcggcaggggcgccgcgcgcgtgacgccgcgaccgtgggcggctgtcggcggcaggagacgctcccccgtggcgggatgtccgtcgcgaccaccgaggccaccaccaccatttcggccgtgggngggcctcggaggacccaggcgctggaggctaggaactccaaggacgggtgggtggcggcaatccctcggcgggtggcgccgggaccaggctcttcccgcttaccagacgcagggccnaagcccgcggtgccaattgggcggcgcgtacggnctcatcgaacgtgccgatgagcaactgcataaaacagcgggatcaacaaggtctaanttcctcacgcagttca

SEQ ID NO: 12580 - protein, 133 aa, Zea mays
  misc_feature: Ceres CLONE 1371961-F
  misc_feature (59)..(59): Xaa is any aa, unknown, or other
  misc_feature (98)..(98): Xaa is any aa, unknown, or other
  misc_feature (128)..(128): Xaa is any aa, unknown, or other
MGLRVAATAPAPAGVRVLGRGAARVTPRPWAAVGGRRRSPVAGCPSRPPRPPPPFRPWXGLGGPRRWRLGTPRTGGWRQSLGGWRRDQALPAYQTQGXSPRCQLGGAYGLIERADEQLHKTAGSTRSXFLTQF

SEQ ID NO: 12581 - DNA, 646 bp, Zea mays
  misc_feature: Ceres CLONE 1371962-F
  misc_feature: Encodes the peptide sequence at SEQ ID NO. 12582
  misc_feature (531)..(531): n is a, c, t, g, unknown, or other
  misc_feature (532)..(532): n is a, c, t, g, unknown, or other
tggagctccccgcggtggcggccgctctagaactagtggatcccccgggctgcaggaattcgcacgagaccattacctagaacatcctaatcgaaaaaacaccaaacttcgacgactgcgccggccgtcggccgtcgctgccgccctattttgaccccatcgccggcgacgataatcgccagtttgtggataagggtcttttaagtcttcatatgaaactatccttttgatatacagctgaaggacaataactatcatggatgctactgcaaattcagatgtgcaaagggctgaggaatttaaacttaaggcgaatgatgccttcaaggcaaacaagttctcgcaggctatagagctttacagtcaagccattgagctgaatagttcaaatgcagtttactgggcaaaccgtgcatttgcacacacaaaattagaaaaatacggaagtgctgtgcaggatgctacaaaagccatcgaaattgattctagatattcaaaaggttattatagacgaggcgcagcttatcttgnncatgggaaagttcaaggaagcccctgaaggatttttcagcaggttaaaaaaatctggcccaaatgatccagaatgctacagaaaggttgaaagaagtgcgagaagctgtcccca

SEQ ID NO: 12582 - protein, 100 aa, Zea mays
  misc_feature: Ceres CLONE 1371962-F
  misc_feature (12)..(45): Pfam Name: TPR_1 Pfam Description: Tetratricopeptide repeat
  misc_feature (46)..(79): Pfam Name: TPR_1 Pfam Description: Tetratricopeptide repeat
  misc_feature: SWISSPROT Homolog: EC 3.1.3.16 Phosphoprotein phosphatase
  misc_feature (92)..(92): Xaa is any aa, unknown, or other
MDATANSDVQRAEEFKLKANDAFKANKFSQAIELYSQAIELNSSNAVYWANRAFAHTKLEKYGSAVQDATKAIEIDSRYSKGYYRRGAAYLXHGKVQGSP

SEQ ID NO: 12583 - DNA, 635 bp, Zea mays
  misc_feature: Ceres CLONE 1371972-F
  misc_feature: Translation starting site: 405
  misc_feature: SWISSPROT Homolog: EC 1.2.1.3 Aldehyde dehydrogenase (NAD(+))
  misc_feature (235)..(235): n is a, c, t, g, unknown, or other
  misc_feature (236)..(236): n is a, c, t, g, unknown, or other
  misc_feature (243)..(243): n is a, c, t, g, unknown, or other
aaagctggagctccccgcggtggcggccgctctagaactagtggatcccccgggctgcaggaattcgcacgagaccattacctagaacatcctaatcgaaaaccaacccaacccaacgacgcagctagcgcgcatctccgatctgcactgcaccttcgtctccgaagaacgtcgatcgtactcgtacaccatgaaggcagtcgtcgcgggacgtgcttctgctggggggggtggnnggacganccgacagtggagagtgcaaatcaccgtgatggcgacggacatcacgaacggcgcgaacgcgggcggagttggtcggtcccagctgcctcctggcgaggggccctgccggcgagccgtctgctgccccctctgcgccgcgcaggacagtgcctgcatatgggatgcacaggctgttgccaggtgtccttcagagggtcagcactgcagcagcagtagaggagcccatcgcgccgtcagtccatgtgaactacacaaagctcctcattaatgggaactttgttgattccgcatccggcaagaccttcccaactctggaccctcgtacagggggaggggattgctcatgtggctgagggcggagcagagggaattaaccgggcagtagctgcggg

SEQ ID NO: 12584 - DNA, 742 bp, Zea mays
  misc_feature: Ceres CLONE 1371977-R
  misc_feature: SWISSPROT Homolog: EC 4.1.3.4 Hydroxymethylglutaryl-CoA lyase
caattgggtaccgggccccccctcgaggtcgacggtatcgataagcttttttttttttttttttggttttttttttttttttttttttttttgaaacttaatttgccccgtactatcaagtaatagatttccctttcacatccagtcttaatcaaactcgcaacgataccacaaaagatttcttttactcggtcttcttctacttggctgattgccgagtcctggtaatgaagggatctatgcgcctccagagaacattgtgggctacaccaaccttctcaacaagctcatcctgggacttctcatagagcggtggaacccacagagagagcattacaccaatgtaaatgaacgtaaggaagttgaagaacattctaatgaatgaaaccccccacaaaaacaatatccccttttgcatcccggagaacaaggataaggaagagcacacataattagaattagatataccatagtctgagaaactaacaatctcccataaatatagacctttatagaaactttcccatctctcttgaaggcaatgtcatggtcaacagcctgcagcttaatgatccataccagagagtgatctgcaactgaggtacccattttggagatacaaaactcattgcctccacaacatgtaacccggatgtggccaatcttcgtataagctcaccctttacaggagttcgtacgatgtccttctcattatgtagacatcaaatggacctactgcacc

SEQ ID NO: 12585 - DNA, 613 bp, Zea mays
  misc_feature: Ceres CLONE 1371977-F
  misc_feature: Encodes the peptide sequence at SEQ ID NO. 12586
tggagctccccgcggtggcggccgctctagaactagtggatcccccgggctgcaggaattcgcacgagaccattacctagaacatcctaatcaaaaaaaccccctttgctttgaagctgcagcgctagcaccttaactgcgctctgagctgaggtgctgtactagatagttagccccgcaccaagaggaaagaatatcccgtctgaccgtgagggcgccgaacccctgacgaccacatcaggcggattgaggggacaggtatgcccctaacgctaagatgccgctgcctcacctgtgttacccgcgcatgtacttcatcacccaggccgtcttcaaccacatcctctccccctacgtgtacctcacctaccgccatctgactcgtcgccgacctcatctggcccttcgcatactacctggagaaggtgctgaggcctagaatgacgctacatgctgttcgttgagatattcccggtctcccttctcggactgagcttaactctgaacatgtacttcgcgcactctgaatgacacgtccccaacgatcgtcaccttccgtggtgaacaccatcggctcgatgacgctcgtcgatcgccatcatcctctgccgac

SEQ ID NO: 12586 - protein, 53 aa, Zea mays
  misc_feature: Ceres CLONE 1371977-F
MPLPHLCYPRMYFITQAVFNHILSPYVYLTYRHLTRRRPHLALRILPGEGAEA

SEQ ID NO: 12587 - DNA, 617 bp, Zea mays
  misc_feature: Ceres CLONE 1372074-F
  misc_feature: Encodes the peptide sequence at SEQ ID NO. 12588
  misc_feature (600)..(600): n is a, c, t, g, unknown, or other
ggcggccgctctagaactagtggatcccccgggctgcaggaattcgcacgagaccattacctagaacatcctaatcgaaaaactacacacaaacacccatggctccagaataggatgctcctcggcgtctgtgccgtgctgatggtggtcggcgtcacgaacgcgtcggagggccaggtggcgtcagtcgtcctgcgcctggcgaggtgcgccgaccgcacgaggaagaacatgaaggctgaggccggtttcaagggtcttcatgtggcgatcaagtgcaagaacagcaacggcgagtacgagacaaaggacgtgagtgagatccatagctccggagccttcagcgtcccactcgtcgccgacctccacggagccgactgacacgcgcagctccacagcgacgtcaataacgcgacttgtcctgtgcacgagcacgccaggatcgcgatcatgtacggcgagaccttcgtcgtcatgactggcaagatgcactacccgtacgcggagtaggaggtctgcgtatctctgctccccattaacaaacacgttgatagaatacatctccaacgtacccctgccgggggtcgcagaccacctcgntggctgaccccacctag

SEQ ID NO: 12588 - protein, 88 aa, Zea mays
  misc_feature: Ceres CLONE 1372074-F
MLLGVCAVLMVVGVTNASEGQVASVVLRLARCADRTRKNMKAEAGFKGLHVAIKCKNSNGEYETKDVSEIHSSGAFSVPLVADLHGAD

SEQ ID NO: 12589 - DNA, 595 bp, Zea mays
  misc_feature: Ceres CLONE 1372075-F
  misc_feature: Encodes the peptide sequence at SEQ ID NO. 12590
  misc_feature (500)..(500): n is a, c, t, g, unknown, or other
tggagctccccgcggtggcggccgctctagaactagtggatcccccgggctgcaggaattcgcacgagaccattacctagaacatcctaatcgaaaaacacacgcgaatcctcaaatctgcccttgccgccgccaccgcccgatccaggtctgcagactgctccctcctcctctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcacggagctgctcatccgcaagctccccttccagcgcctcgtccgcgagatcgcgcaggacttcaagacggacctgcggttccagtcctcggccgtggcggcgctgcaggaggccgcggagggcgtaccctggtggggctcttncgaagaacacaaacttctggggccttccccggcaaagaggggcccccattattggccccaagggaaatctcccggtgcccgccccccccgctttt

SEQ ID NO: 12590 - protein, 137 aa, Zea mays
  misc_feature: Ceres CLONE 1372075-F
  misc_feature (106)..(106): Xaa is any aa, unknown, or other
MARTKQTARKSTGGKAPRKQLATKAARKSAPATGGVKKPHRFRPGTVALREIRKYQKSTELLIRKLPFQRLVREIAQDFKTDLRFQSSAVAALQEAAEGVPWWGSXEEHKLLGPSPAKRGPHYWPQGKSPGARPPRF

SEQ ID NO: 12591 - DNA, 657 bp, Zea mays
  misc_feature: Ceres CLONE 1372093-F
  misc_feature: Encodes the peptide sequence at SEQ ID NO. 12592
gctggagctccccgcggtggcggccgctctagaactagtggatcccccgggctgcaggaattcgcacgagaccattacctagaacatcctaatcgaaaactcgccagttcacctccgcctccgctcctcccctccccctcccgtcctgccatggccaccgcagcacgcgccctcgtcgccgcacgcccggcacggccgctgctgccgtctcggcgcctcccgtcctcctcttccatccgtcccgcgcggcaacgtgctggcgtcgggtgcgtccgctgcatggctcggcggccggattccacctattccccgctgcgttcgggccagggcggtgaccgtgcaccgactgaaatggcgcctctgttccctggctgcgactacgagcactggctcatcgtcatggacaagcccgggggcgagggcgccaccaagcagcaaatgatagattgttacatccagacccttgcccaggtgggtaggagtgaaagagaggcgaagaaaaagatatataatgtgtcctgcgaacgctaatttgcgattcggatgccgaattggacgaggagacctcccacaaactccaaaggccttccagggggttctttttggtggttcccggactcttacgttggagcctgaaaacaaaggattatgggtgct

SEQ ID NO: 12592 - protein, 126 aa, Zea mays
  misc_feature: Ceres CLONE 1372093-F
MATAARALVAARPARPLLPSRRLPSSSSIRPARQRAGVGCVRCMARRPDSTYSPLRSGQGGDRAPTEMAPLFPGCDYEHWLIVMDKPGGEGATKQQMIDCYIQTLAQVGRSEREAKKKIYNVSCER

SEQ ID NO: 12593 - DNA, 632 bp, Zea mays
  misc_feature: Ceres CLONE 1372096-F
  misc_feature: Encodes the peptide sequence at SEQ ID NO. 12594
  misc_feature (632)..(632): n is a, c, t, g, unknown, or other
ctggagctccccgcggtggcggccgctctagaactagtggatcccccgggctgcaggaattcgcacgagaccattacctagaacatcctaatcgaaaagcaaaagtccggacaaagctcgcgccgcccaccgcacccgatccgcctcgcccaggcgtgctgccgtccgctcccttctcccgcgccgtcgcctccgcctacgcccgggccgacccgctggacccagcgtgcgccgctccactcggacgcgccgccgccctctcgggttgaggcggaggtgcttggggacccgcccccatggcgagcgccggcaacagcggcagcggggacgacgatgcaggagggaagctcctggcggatcgctaccagaagggcgaggtcctcggcgagggcacgtatggagtcgtcttcaaggccatcgacaccaaggtccccttaccacaccgatctcctaaagacctaaaccctcccttcctgatctgcgggcggccaccactcgagagttagagcttggctagtccgatcaatccagcttcgaccgtagacagatgcttgcggggtttagctttcggggttagagggttttgcacggcgtagctctggtgattggggtcattgagtggttggagcttn

SEQ ID NO: 12594 - protein, 69 aa, Zea mays
  misc_feature: Ceres CLONE 1372096-F
  misc_feature: SWISSPROT Homolog: EC 2.7.11.22 Cyclin-dependent kinase
MASAGNSGSGDDDAGGKLLADRYQKGEVLGEGTYGVVFKAIDTKVPLPHRSPKDLNPPFLICGRPPLES

SEQ ID NO: 12595 - DNA, 637 bp, Zea mays
  misc_feature: Ceres CLONE 1372098-F
  misc_feature: Encodes the peptide sequence at SEQ ID NO. 12596
tggagctccccgcggtggcggccgctctagaactagtggatcccccgggctgcaggaattcgcacgagaccattacctagaacatcctaatcgaaaaattctctcaccagagtacgaactacgaagacccgacaggccgacacccgctcgtctcccctggcacgtaagcggaggaggcgcaaccggaccccctccccctccagatcggtgctccgctgggagatctcctcgtgcaggcgccgaatctcttcgtcgactcttccaagcacggctgggagcacaatagatctgtttgcaagcattctttggcactacttcaaggctttgatgattgctttacagcgacgatatggcctcccgcccaaagctgtctggtattcagaaggaggttttggagctgtacaggcgattccttcggacagcacgtcttaaggcccctgaagagcgccacaggatcgagtctgttgtcttggcacagttccgtgacaaggcaaggagggctgaccgtaggaactttatacatatcgagtacttggtgaggagagggaagaatcagcttgagcagctcaagaatcctggcattactggacttgctacccttgcactaaagaaatgaggtccattcattgccagaaca

SEQ ID NO: 12596 - protein, 88 aa, Zea mays
  misc_feature: Ceres CLONE 1372098-F
  misc_feature (9)..(75): Pfam Name: Complex1_LYR Pfam Description: Complex 1 protein (LYR family)
MASRPKLSGIQKEVLELYRRFLRTARLKAPEERHRIESVVLAQFRDKARRADRRNFIHIEYLVRRGKNQLEQLKNPGITGLATLALKK

SEQ ID NO: 12597 - DNA, 647 bp, Zea mays
  misc_feature: Ceres CLONE 1372103-F
  misc_feature: Encodes the peptide sequence at SEQ ID NO. 12598
  misc_feature (290)..(290): n is a, c, t, g, unknown, or other
aaagctggagctccccgcggtggcggccgctctagaactagtggatcccccgggctgcaggaattcgcacgagaccattacctagaacatcctaatcgaaaaattattaagaagttgccaccagtatcatcggcagtagccatgggcatcctggaccacctgtcgcatctgtgcactatcacgtagaccaacgaggagctcaagctcacgaagaagcgaccgctgcagactgtgaacatcaaggtgaacatggactgcgaagggtgcgagcgccgcgtgaagagagcgcntaagtcgatgcgcgaagagacgagcgtgctggtgaacgccaagcatagtaagtgcacggagaccggtaacgtggagcccgacaaggtgctggagcgcgtcaaggtcaccggccagaacgccgagatgtggccctacgtgccctacgcgctcaccacctacccctacgtacggaggcgcctacgacaagaacgcgcccgcgttattcctccgcagcgcgccgaaggacatggcggaccccggcgcgccggagctcaagtacatgaacatgttcaacgactacaagcgtagacacgtgcacaagaatgtagatacttctcttcttctctgttcgccggatcgatcggatataccctgac

SEQ ID NO: 12598 - protein, 109 aa, Zea mays
  misc_feature: Ceres CLONE 1372103-F
  misc_feature (14)..(14): Xaa is any aa, unknown, or other
MDCEGCERRVKRAXKSMREETSVLVNAKHSKCTETGNVEPDKVLERVKVTGQNAEMWPYVPYALTTYPYVRRRLRQERARVIPPQRAEGHGGPRRAGAQVHEHVQRLQA

SEQ ID NO: 12599 - DNA, 636 bp, Zea mays
  misc_feature: Ceres CLONE 1372106-F
  misc_feature: Encodes the peptide sequence at SEQ ID NO. 12600
  misc_feature (602)..(602): n is a, c, t, g, unknown, or other
aaagctggagctccccgcggtggcggccgctctagaactagtggatcccccgggctgcaggaattcgcacgagaccattacctagaacatcctaatcgaaaagaagcatgccacgcctgaccgacccccttctcgcctaatcacccgcagcctgtctctgctcggcggcggccgtctcgactgcgggagaggggatcgccccttcgccgatctgatcgggagctgcaggccaaacggcgaggcgagcccatcaggaaccaccatggcagcggcagccgccgactccgatcccgccgcagctgtggccgacatgtccctgcgcccattgtcaacgagagatcccttcttcgaacatcgacttgcattctgtacattgtgcccgtaacctccaaaagtgccagcactgtggagaaatgattcctaggaaacttatggatgaacactatgatgcaaaccatgccccgatcagttgctctctttgcaaagaaacaatagaacgtgtgaggtgggatcttcataaagtcgaaaagtgcccacaaagaatcgtcgcttgtgaatattgcgagtttgaattgcctgcagttgatctccatgagcatcangatgtatgtggaaaccgaacagaactttgccaaa

SEQ ID NO: 12600 - protein, 74 aa, Zea mays
  misc_feature: Ceres CLONE 1372106-F
  misc_feature (10)..(62): Pfam Name: zf-TRAF Pfam Description: TRAF-type zinc finger
  misc_feature (63)..(63): Xaa is any aa, unknown, or other
MIPRKLMDEHYDANHAPISCSLCKETIERVRWDLHKVEKCPQRIVACEYCEFELPAVDLHEHXDVCGNRTELCQ

SEQ ID NO: 12601 - DNA, 629 bp, Zea mays
  misc_feature: Ceres CLONE 1372107-F
  misc_feature: Encodes the peptide sequence at SEQ ID NO. 12602
  misc_feature (518)..(518): n is a, c, t, g, unknown, or other
aagctggagctccccgcggtggcggccgctctagaactagtggatcccccgggctgcaggaattcgcacgagaccattacctagaacatcctaatcgaaaaaataacttgacactcgcgccgcgatgcgtctttcctcatgctaaccctacccgccgcgccgacacacctgacgttgctactgccccgtacctcccttgctttcccgtatgcgaaatgacgaagcgcaccaagaagaatgaaattagttggacatatggaaccaggtatgtcgctagcttgatgaggcaaatcctgaagatggaggaatctctgaacatcaagaacttcatggagtactgcgacgactgtgctgtccaggactatcagcagtctgcatcttgatcatcgaacgactgcatcgaagactagggtagcactgctcacaccatgagcactgatagtgcagacactgacacgagtgctactcgtaacttgacatcagcgactgactcctgtttatcttagctaaatcacggnccatccttaactggggcccctcctaagggttcactcggcttgcagaatacccgggattggttaaaatttgtgaaacctaaaatttgcaaggtgggtaccggaattgaaatt

SEQ ID NO: 12602 - protein, 55 aa, Zea mays
  misc_feature: Ceres CLONE 1372107-F
MTKRTKKNEISWTYGTRYVASLMRQILKMEESLNIKNFMEYCDDCAVQDYQQSAS

SEQ ID NO: 12603 - DNA, 621 bp, Zea mays
  misc_feature: Ceres CLONE 1372108-F
  misc_feature: Encodes the peptide sequence at SEQ ID NO. 12604
  misc_feature (428)..(428): n is a, c, t, g, unknown, or other
  misc_feature (429)..(429): n is a, c, t, g, unknown, or other
  misc_feature (518)..(518): n is a, c, t, g, unknown, or other
  misc_feature (521)..(521): n is a, c, t, g, unknown, or other
ggagctccccgcggtggcggccgctctagaactagtggatcccccgggctgcaggaattcgcacgagaccattacctagaacatcctaatcgaaaaagtgaaagagaggtaggtggccggacggtggtggcatcgccaattcaactccgcatctgaatcggcactcggcagcgcgccagctccataggaggagatggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaagtccattcagaagccacgggtggtgatcatgctcgtcaggnncggcgcgccagttgaccagaccatcgcgacgctcgcagctcacttggagcagggcgactgcatcatcgatgggggggaacgagtggacnaanaaccccgaaaggagggaaaggccatggagggacccggcctcctgaacttggcatgggtggtcccttgaggaaaagaggggggccccaaccggcccgccct

SEQ ID NO: 12604 - protein, 131 aa, Zea mays
  misc_feature: Ceres CLONE 1372108-F
  misc_feature (3)..(131): Pfam Name: NAD_binding_2 Pfam Description: NAD binding domain of 6-phosphogluconate dehydrogenase
  misc_feature: SWISSPROT Homolog: EC 1.1.1.44 Phosphogluconate dehydrogenase (decarboxylating)
  misc_feature (79)..(79): Xaa is any aa, unknown, or other
  misc_feature (109)..(109): Xaa is any aa, unknown, or other
  misc_feature (110)..(110): Xaa is any aa, unknown, or other
MALTRIGLAGLAVMGQNLALNIAEKGFPISVYNRTTSKVDETVQRAKAEGNLPVYGFHDPASFVKSIQKPRVVIMLVRXGAPVDQTIATLAAHLEQGDCIIDGGERVDXXPRKEGKAMEGPGLLNLAWVVP

SEQ ID NO: 12605 - DNA, 622 bp, Zea mays
  misc_feature: Ceres CLONE 1372111-F
  misc_feature: Encodes the peptide sequence at SEQ ID NO. 12606
  misc_feature (270)..(270): n is a, c, t, g, unknown, or other
  misc_feature (312)..(312): n is a, c, t, g, unknown, or other
  misc_feature (316)..(316): n is a, c, t, g, unknown, or other
  misc_feature (350)..(350): n is a, c, t, g, unknown, or other
tggagctccccgcggtggcggccgctctagaactagtggatcccccgggctgcaggaattcgcacgagaccattacctagaacatcctaatcgaaaaatctcctccacccagccgccgccgccgcctaaggagaagagggtccggccgtctccttgccccgatggcgtccgagaagaagcagtccaacccgatgcgggagatcaaggtgcagaagctggtcctcaacatatccgtaggggagagcggcgaccgcctcacccgcgccgccnaggtgctggagcagctcagcggccagacccccgtcttctccnaggntgggtgctgaggtctttgcggcccgctcccgttnctcgcgctccgctcacgatgcgtgcgtggcttttacctgctggtcttgctcttggggctgcagcgaggtaccggggcgctcgtttcgaatcccgggtaccgagagatcgcctgctacgtccgggcagggggcgacaaggcatgcagctgcttgggagcggcctcagggcaaggagtccagctggtcaggaggaattcacggaaccggttggtttgggttcggatccaaaagccctcaaccttgtttcaggtttgctcattaccgggctcttg

SEQ ID NO: 12606 - protein, 54 aa, Zea mays
  misc_feature: Ceres CLONE 1372111-F
  misc_feature (9)..(50): Pfam Name: Ribosomal_L5 Pfam Description: Ribosomal protein L5
  misc_feature (37)..(37): Xaa is any aa, unknown, or other
  misc_feature (51)..(51): Xaa is any aa, unknown, or other
  misc_feature (52)..(52): Xaa is any aa, unknown, or other
MASEKKQSNPMREIKVQKLVLNISVGESGDRLTRAAXVLEQLSGQTPVFSXXGC

SEQ ID NO: 12607 - DNA, 767 bp, Zea mays
  misc_feature: Ceres CLONE 1372113-F
  misc_feature: Encodes the peptide sequence at SEQ ID NO. 12608
  misc_feature (71)..(71): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
ggtggggggggccccttcccgcccgtctccccccccttcccactgacgcacacttaacggtttgtgggggncccttnnnnnnaaaaggtggtgctccccgcggtggcggccgctctattactagtggatcccccgggctgcaggaattcgcacgagaccattacctagaacatcctaatcgaaaaattcaccgtccacgttccatatggcttcctgcaggatggcactcctccttggcttgctgctgctagtagtagcttcgcccgcgatcgctgatgacgactccggtatctactaccagctgggtcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcaccaacaaagttccttacgaccctaaccctgattaccgggatccaaggcccgaatcagtactgggagcaaccttcgggtgcccccagtaacaacgggtcagaccaggtggtaaaaaaccccctgaaacagaggccgggccctggctcccggcctccctggagaaacaactaacttccgagaatggccctcctcctttccggagcccggaatcagaaccccacgccctttgcgcccccctaacccccaggggtattcgcagtcccgcgacttttccggggtttcctacgggcgccttcaaggggcgtaacccctcacggg

SEQ ID NO: 12608 - protein, 110 aa, Zea mays
  misc_feature: Ceres CLONE 1372113-F
  misc_feature: SWISSPROT Homolog: EC 3.1.27.1 Ribonuclease T(2)
MASCRMALLLGLLLLVVASPAIADDDSGIYYQLGLMWPGAYCEQTSAGCCKPTTGVSPARDFYITGFTVLNATTDAAVTGCTNKVPYDPNPDYRDPRPESVLGATFGCPQ

SEQ ID NO: 12609 - DNA, 628 bp, Zea mays
  misc_feature: Ceres CLONE 1372120-F
  misc_feature: Encodes the peptide sequence at SEQ ID NO. 12610
aaagctggagctccccgcggtggcggccgctctagaactagtggatcccccgggctgcaggaattcgcacgagaccattacctagaacatcctaatcgaaaaatctttcgctcgctctcggcgacagctgggcgaccgtcgtcgccgccgcccttctctaggtgcccaggtcttcgccggtccctttgccgcctcttcgccgccgatgagcaccagccaggaagaaaagaagttgaaccatggggaagagaaagtcagctgctaagccacctcctaagaagcggatggacaagcttgacactgtcttttcctgcccattctgcaaccacgggagtagtgttgagtgccaaattgacatgaagaatctgattggcgaagcatcttgtagaatctgtcaggaaaacttcagcacaactgttaatgatatagtgaatggattgacgagtgtgagcgtgtcaacactgttgaaggcgacgatgatgcgtgagcttgcccatgcgatgaaactggtaccctacaatcgtatgtaatgtgctggtattctcgaatgccatagcccatagtcagccatggctttggaataacggaagggctgactgatatgccagtaggactttatctagtacta

SEQ ID NO: 12610 - protein, 96 aa, Zea mays
  misc_feature: Ceres CLONE 1372120-F
  misc_feature (8)..(68): Pfam Name: Elf1 Pfam Description: Transcription elongation factor Elf1 like
MGKRKSAAKPPPKKRMDKLDTVFSCPFCNHGSSVECQIDMKNLIGEASCRICQENFSTTVNDIVNGLTSVSVSTLLKATMMRELAHAMKLVPYNRM

SEQ ID NO: 12611 - DNA, 636 bp, Zea mays
  misc_feature: Ceres CLONE 1372127-F
  misc_feature: Encodes the peptide sequence at SEQ ID NO. 12612
ggagctccccgcggtggcggccgctctataactagtggatcccccgggctgcaggaattcgcacgagaccattacctagaacatcctaatcgaaaaactcatacatttcgactctcaactcccaaggtcccttttttttttctcgatctggaagcgccgcagtagcagccatggacgtgagcggagcaggcggtaaggcgaagaagggcgcggcggggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgccgcaagggacaacaagaagacgcgcatcattccgcgccacgtgctcctcgccatccgcaacgacgaggaactcggcaagctgctgggcggcgtcaccatcgcccacgggggcgtcctcccccaaattcccactgtgcttctcccccagaaagtggccgaaaaggcggcaaaggagccccagaaaggcgcccaagtcccccagaaggcgtaaagtgatctcctcc

SEQ ID NO: 12612 - protein, 150 aa, Zea mays
  misc_feature: Ceres CLONE 1372127-F
  misc_feature (29)..(102): Pfam Name: Histone Pfam Description: Core histone H2A/H2B/H3/H4
MDVSGAGGKAKKGAAGRKAGGPTKKSVSRSSRAGLQFPVSRVGRYLKKGRYAQRVGTGAPVYLAAVLEYLAAEVLELAGNAARDNKKTRIIPRHVLLAIRNDEELGKLLGGVTIAHGGVLPQIPTVLLPQKVAEKAAKEPQKGAQVPQKA

SEQ ID NO: 12613 - DNA, 649 bp, Zea mays
  misc_feature: Ceres CLONE 1372132-F
  misc_feature: Encodes the peptide sequence at SEQ ID NO. 12614
  misc_feature (517)..(517): n is a, c, t, g, unknown, or other
aaagctggagctccccgcggtggcggccgctctagaactagtggatcccccgggctgcaggaattcgcacgagaccattacctagaacatcctaatcgaaaaattccgcttgcttgattgctccaggtacctccattcgcagtcggccgtgtcctcggagccgcgggagatggcggatcaggagaccgtagctgtggttgaggcaccaaccccggttcttggggaaccgatggacctgatgactgccctgcagctcgtcatgaagaagtcaggtgctcacgatggccttgtgaagggtcttcgtgaggctgccaaagccatcgagaagcatgccgctcagctctgcgtgcttgccgaggactgcgaccagcctgattatgtcaagctggtgaaggctctctgcgctgagcacaatgtccacctggttactgtgcctagcgccaaaactcttggagagtgggctgggctttgcaagatcgactctgagggcaaggcgaggaaggttgtaggctgctcnttgtgttgttgtcaaggactacggcgaagaatctgaaggccttaacatagtggcaggagtacgtcaaatcgcactagatacagtgtgtcggtatctgggaagttgtgttcaacactacatttttgccctgag

SEQ ID NO: 12614 - protein, 127 aa, Zea mays
  misc_feature: Ceres CLONE 1372132-F
  misc_feature (25)..(120): Pfam Name: Ribosomal_L7Ae Pfam Description: Ribosomal protein L7Ae/L30e/S12e/Gadd45 family
MADQETVAVVEAPTPVLGEPMDLMTALQLVMKKSGAHDGLVKGLREAAKAIEKHAAQLCVLAEDCDQPDYVKLVKALCAEHNVHLVTVPSAKTLGEWAGLCKIDSEGKARKVVGCSLCCCQGLRRRI

SEQ ID NO: 12615 - DNA, 620 bp, Zea mays
  misc_feature: Ceres CLONE 1372137-F
  misc_feature: Encodes the peptide sequence at SEQ ID NO. 12616
  misc_feature (423)..(423): n is a, c, t, g, unknown, or other
tggagctccccgcggtggcggccgctctagaactagtggatcccccgggctgcaggaattcgcacgagaccattacctagaacatcctaatcgaaaaagagtccagaccatagcctgcagccacgaactcccgttctccatttccagccatggcggtgtcgatcgagctcaccaaggagtacggctacgtcgtgctggtgctggtggcctatgtcttcctcaacctttggatgggcttccaggtcggcaaggcccgcagaaactacaaggtgttctaccccaccatgtacgccatcgagtcggagaacaaggacgccaagctctttcactgcgtgcagagggggcaccagaactctctagagtggatgcccggttttctcggcatactgctgctgggcgtctgcagcacccgaccatcgccgncgggtctgggcggcatctacatcgtcgcgagggtcttctactttcagggatacgccaccgggggtccgggacaaccgtttcaagaatgggggggctcactacttggggttgcgtggggtggatcttttggcaaggatttttcgggataaaccggttcattagggggaagggcctaaactttggggtttaattggggg

SEQ ID NO: 12616 - protein, 140 aa, Zea mays
  misc_feature: Ceres CLONE 1372137-F
  misc_feature (9)..(136): Pfam Name: MAPEG Pfam Description: MAPEG family
  misc_feature: SWISSPROT Homolog: EC 2.5.1.18 Glutathione transferase
  misc_feature (92)..(92): Xaa is any aa, unknown, or other
MAVSIELTKEYGYVVLVLVAYVFLNLWMGFQVGKARRNYKVFYPTMYAIESENKDAKLFHCVQRGHQNSLEWMPGFLGILLLGVCSTRPSPXGLGGIYIVARVFYFQGYATGGPGQPFQEWGGSLLGVAWGGSFGKDFSG

SEQ ID NO: 12617 - DNA, 640 bp, Zea mays
  misc_feature: Ceres CLONE 1372139-F
  misc_feature: Encodes the peptide sequence at SEQ ID NO. 12618
tggagctccccgcggtggcggccgctctagaactagtggatcccccgggctgcaggaattcgcacgagaccattacctagaacatcctaatcaaaaaacgatcacacaccactccacagcagtagcaagagggatagagcaaggccacacacacacacacaccactaggctaggttagccttttaatcgtcgtcgagaagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagccctaccggggttcagcttgcccggcagcggcagcatgcccctcttccgcggggggctccccgggccttcagcggcttccgcgggaatgcccggggtcgcccacccgtcgggcttcgttccccg

SEQ ID NO: 12618 - protein, 125 aa, Zea mays
  misc_feature: Ceres CLONE 1372139-F
MARSSKMMVAAALLALALAVSTAEARNIKTTTTEKKDDAVVQPQTFPPFDRLGGGASPAFGGLPGGSIPGSSIPGFSMPGSGSSPTGVQLARQRQHAPLPRGAPRAFSGFRGNARGRPPVGLRSP

SEQ ID NO: 12619 - DNA, 604 bp, Zea mays
  misc_feature: Ceres CLONE 1372140-F
  misc_feature: Translation starting site: 181
  misc_feature (591)..(591): n is a, c, t, g, unknown, or other
tggagctccccgcggtggcggccgctctagaactagtggatcccccgggctgcaggaattcgcacgagaccattacctagaacatcctaatcaaaaaattcaatccggccgggtccgcgcgcaaggggcagcgagcgagccacgtacgaagtagtacgtgctgccgccaagctagtgccaatggcgagggcggtggtgatgctcgtggccctggccctggtgctgatcgtggcggtgtcgagcgcggtgcggcgcggcggcgcagcagtgcagcgcggcgcagctggcggcgtgcgccccggcgatcatcagcggatcgccgcccacggcgtcgtgctgctccaacctgcgcgcgcaggagccgtgcttctgccagtacgcgcgcaacccggcgtacagcagctacatcgacaggcccaacgcccgccgcacgctcacctcctgtggcatcgccgtcccgagctgctagggcgctagctcgtgcctcgtggtgtgggtgaataaaaagatgcgtgtcgatctctgcttactgttatcgtatctgtagcacctcgtgtgatatgaacaatatgtattattaaccaacagcgncttgtgtaatgac

SEQ ID NO: 12620 - DNA, 659 bp, Zea mays
  misc_feature: Ceres CLONE 1372148-F
  misc_feature: Encodes the peptide sequence at SEQ ID NO. 12621
  misc_feature (350)..(350): n is a, c, t, g, unknown, or other
  misc_feature (388)..(388): n is a, c, t, g, unknown, or other
  misc_feature (397)..(397): n is a, c, t, g, unknown, or other
  misc_feature (461)..(461): n is a, c, t, g, unknown, or other
tggagctccccgcggtggcggccgctctagaactagtggatcccccgggctgcaggaattcgcacgagaccattacctagaacatcctaatcgaaaaatcgatggcatcggcgcctgccgattcctacgggtgcgcggcgtgcggcgcgcccctgaacctgtcggcggcgcacctgtacccggcggacttctacttcgaggccgggaacaagggcacgctgtccttctcgtgggtggacgagtcgcgcctgcggttcgcgcccgaggaccgcatccgccccttcttcgagaccctcaactactggggcatccagcggaagcgcacgcgcatcagctgcgacgcctgcggncacctgcttggccacgtctacgacgacggtccgccggncatgcaggnaaccgggcccagttcgggatgggggccagccaggtcatccggcggccggcccaggtacggcttncaggatcagggccatcgccggccggttccctcggacctgccggcgcccgctatggaaaaggagggcccaaaaaattccttcatccggttcgcgggcccggggggcttcccgggcttggggtccccggactcccgggaaatacacgagtttcccgggatttccggcccgggcggttttcctttaaaaaacgggggggtg

SEQ ID NO: 12621 - protein, 186 aa, Zea mays
  misc_feature: Ceres CLONE 1372148-F
  misc_feature: SWISSPROT Homolog: EC 1.8.4.12 Peptide-methionine (R)-S-oxide reductase
  misc_feature (96)..(96): Xaa is any aa, unknown, or other
  misc_feature (99)..(99): Xaa is any aa, unknown, or other
  misc_feature (120)..(120): Xaa is any aa, unknown, or other
MASAPADSYGCAACGAPLNLSAAHLYPADFYFEAGNKGTLSFSWVDESRLRFAPEDRIRPFFETLNYWGIQRKRTRISCDACGHLLGHVYDDGPPXMQXTGPSSGWGPARSSGGRPRYGXQDQGHRRPVPSDLPAPAMEKEGPKNSFIRFAGPGGFPGLGSPDSREIHEFPGISGPGGFPLKNGGV

SEQ ID NO: 12622 - DNA, 662 bp, Zea mays
  misc_feature: Ceres CLONE 1372152-F
  misc_feature: Encodes the peptide sequence at SEQ ID NO. 12623
  misc_feature (472)..(472): n is a, c, t, g, unknown, or other
  misc_feature (481)..(481): n is a, c, t, g, unknown, or other
  misc_feature (482)..(482): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaaacccttgagtccacacgctctggcgcacgcgcacggcgcacaccatggccgctgccttagcttcgcttctccacctcgcgaccccgacccagactcgctccactcacctcgccgtccgcctccccagcgcccagctgccgcgctggccgtcggggtcacgcatcgccgccgcgcagccgccgcgggcgtacaaggtgacgatcgagcacggcggcgagtcgcgggtggtggaggtggaggaggacgagacgatcctgtcccgcgcgctggacgagggcctggacgtgccgcacgactgcaagctcggcgtgtgcatgacgtgcccggcgcggctggtctccgggacggtggaccagagcgaggatgtcgnggacaccgnnccccccggggggggggggggcccccccttttttttgtgcccggtgtaacccggggcttcgaattgcaccattcgggggtcattccccggagggacgaggctggctcaaggtcccagctcggccacccgccgaacgactggacgccccccgccgaatggacccagcaggcatcnacccttc

SEQ ID NO: 12623 - protein, 127 aa, Zea mays
  misc_feature: Ceres CLONE 1372152-F
  misc_feature (53)..(115): Pfam Name: Fer2 Pfam Description: 2Fe-2S iron-sulfur cluster binding domain
  misc_feature: SWISSPROT Homolog: EC 1.14.13.7 Phenol 2-monooxygenase
  misc_feature (109)..(109): Xaa is any aa, unknown, or other
  misc_feature (112)..(112): Xaa is any aa, unknown, or other
MAAALASLLHLATPTQTRSTHLAVRLPSAQLPRWPSGSRIAAAQPPRAYKVTIEHGGESRVVEVEEDETILSRALDEGLDVPHDCKLGVCMTCPARLVSGTVDQSEDVXDTXPPGGGGGPPFFLCPV

SEQ ID NO: 12624 - DNA, 660 bp, Zea mays
  misc_feature: Ceres CLONE 1372156-F
ggagctccccgcggtggcggccgctctattactagtggatcccccgggctgcaggaattcgcacgagaccattacctagaacatcctaatcgaaaaagtatcagacggtcttgctgtcctcgcctcctctccctatcctccacgctccatcggagagtgatcggaaagagttgcgtcgctgagtcatgagggtctgtgcggaagaggctgaagtactgcaccaggacccttgttcgccgccgacgcctctgatctgcatgagggtgtcctgattcattccgtcggccatcgcattcgctacttcctgcacattgtaggcctctgttataacagcgtaggactaccagatagtggtgaagagcccttcgtctctaagcttcttcaggccagtgacaatggtccagggcttgacacccccaacaagatgaatgactaccgcctggatgtctacacgagcacctcgtcttggctgcatgcgtagagcacgagtttgacggtcaagacgacgcctacctccttgtagaaagccgacaatgccgcaaagggagctgtcaataatccggactctgtctgcgatttgcttcaaccggagcccgaaaaaaaatctagctggggtttgggtaggcctacccggttcggaaccccttccttggtggccag

SEQ ID NO: 12625 - DNA, 661 bp, Zea mays
  misc_feature: Ceres CLONE 1372165-F
  misc_feature: Encodes the peptide sequence at SEQ ID NO. 12626
  misc_feature (459)..(459): n is a, c, t, g, unknown, or other
  misc_feature (522)..(522): n is a, c, t, g, unknown, or other
  misc_feature (535)..(535): n is a, c, t, g, unknown, or other
  misc_feature (581)..(581): n is a, c, t, g, unknown, or other
  misc_feature (621)..(621): n is a, c, t, g, unknown, or other
  misc_feature (630)..(630): n is a, c, t, g, unknown, or other
aaagctggagctccccgcggtggcggccgctctagaactagtggatcccccgggctgcaggaattcgcacgagaccattacctagaacatcctaatcgaaaaatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcagnagcatgacgccccggttccccccggcggcgtcagcatgggccaacgccgccaacatccccggnaaagtgcgggcgntcttccgtcggcgtgcccatcagcccccaccgtcgactgcaccaangatcaactgatcgatggaaccccatagtggaggtagctcngctcgttgnatgggcagcgtacgtggccatcagcagcatt

SEQ ID NO: 12626 - protein, 129 aa, Zea mays
  misc_feature: Ceres CLONE 1372165-F
  misc_feature (36)..(115): Pfam Name: Tryp_alpha_amyl Pfam Description: Protease inhibitor/seed storage/LTP family
  misc_feature (86)..(86): Xaa is any aa, unknown, or other
  misc_feature (112)..(112): Xaa is any aa, unknown, or other
  misc_feature (127)..(127): Xaa is any aa, unknown, or other
MAARSSSQQLVAAAVLAAALLLLAAGAGTASAAVSCGEVTSSVAPCLGYAMGSAASPSAACCSGVRSLNSRASSAADRQATCNCLXSMTPRFPPAASAWANAANIPGKVRAXFRRRAHQPPPSTAPXIN

SEQ ID NO: 12627 - DNA, 635 bp, Zea mays
  misc_feature: Ceres CLONE 1372167-F
  misc_feature: Encodes the peptide sequence at SEQ ID NO. 12628
aaagctggagctccccgcggtggcggccgctctagaactagtggatcccccgggctgcaggaattcgcacgagaccattacctagaacatcctaatcgaaaatacacaattcactccactcatcttttctcgtttagaagctctaaaatttcccccactcgacagtcgacagcagcacctgtagcagtcatggacgccagcggagacggtagcaaggggaagaagggggcggacgagcgcgatgcaggcggccccaggaacaagacggtgacgcgggccgacaagggcggtctgcaggtccacgccggccggatcgggagctacctcaagaagggccggcacgcgcagcgcgtgagcactgaggcccccgtctacctcgccgccgtcctggagtacctcgccggcgagggtctggagttggcacgtaacgcggcgagagactactggaatacgtgcatcatcccgcgccacgtgctcctggcgatgaggaacgacgaggagctcgggaagatgatggccggaggcaccatcgcggagggaggcgtactccccagcatctactccgcgctcctgacctagaaggcggcggagaatgcggccagaggcgggagcaaggagcccaagtcccccaagaa

SEQ ID NO: 12628 - protein, 129 aa, Zea mays
  misc_feature: Ceres CLONE 1372167-F
  misc_feature (29)..(102): Pfam Name: Histone Pfam Description: Core histone H2A/H2B/H3/H4
MDASGDGSKGKKGADERDAGGPRNKTVTRADKGGLQVHAGRIGSYLKKGRHAQRVSTEAPVYLAAVLEYLAGEGLELARNAARDYWNTCIIPRHVLLAMRNDEELGKMMAGGTIAEGGVLPSIYSALLT

SEQ ID NO: 12629 - DNA, 625 bp, Zea mays
  misc_feature: Ceres CLONE 1372170-F
  misc_feature: Encodes the peptide sequence at SEQ ID NO. 12630
tggagctccccgcggtggcggccgctctattctagtggatcccccgggctgcaggaattcgcacgagaccattacctagaacatcctaatcgaaaagtggaacagtgcacacactcgtctcatcggagaaaaggagatccgggttagggttttagactgcgatgggtgcgtcgggcgacgagaaggctgcgatggctgcgtccgctgcagccgcgggggccggtgccgccgagggcgagggcgcggtggactccaaggaccttcagcagcagagcaaggcgctcgacaagctcactgatcatgtcgaggaccggcagctcgattcatcccgtgtccaatccgccatggcggtacttgcttcatccaaggaggctgactggaacgcgatgaggctgagggagaaagaattggctgctgtcaagatcaaccctgccgatgtcgaaattatcgctagtgagcttgagctggacaagaagatcgcggagagaacgctcctgagcaccagggtgatgccgtgactgcgattcgattcctgctgcgctagatccgagatatcgtcgccagcatcacatgttccccttcagttccacccaagaggtgatgatgtgaagcactagcactttta

SEQ ID NO: 12630 - protein, 118 aa, Zea mays
  misc_feature: Ceres CLONE 1372170-F
MGASGDEKAAMAASAAAAGAGAAEGEGAVDSKDLQQQSKALDKLTDHVEDRQLDSSRVQSAMAVLASSKEADWNAMRLREKELAAVKINPADVEIIASELELDKKIAERTLLSTRVMP

SEQ ID NO: 12631 - DNA, 627 bp, Zea mays
  misc_feature: Ceres CLONE 1372171-F
gctctgtactagtggatcccccgggctgcaggaattcgcacgagaccattacctagaacatcctaatcaaaagactcgatacggcaagatcgacagagagaccgacgcgccggctgatcccaagctcaccggagaggtggaagagggcgaccgaacgcggccatgggcttcatcatggacttcgcggccaatctgatcctccggctgatgcaggacccggacaagtgcgaccaggttcggcggtagcatgcctacaagatgaacgagccgtgcgactgctctaagggggcgtggaggctccctctgcgcccctacgggttgtggaccttctaccgcttcaactcgcagctctcctgggatccccagattagcccatgcccccgtgctttcgggacccctacgacgacctcatgcgcccgcactctgggtcgccgccgatttcctgaacaccccggtccaatctttggccattaggcctacttgccctgcaccaagaagggccttttccccccaaactggatggggggacccatccctcctccgggctgggaaaatggttggccccccaaactacccctaggtgcctggtccccagtttggccctggaaagtacttaaagtagggggc

SEQ ID NO: 12632 - DNA, 664 bp, Zea mays
  misc_feature: Ceres CLONE 1372182-F
  misc_feature: Encodes the peptide sequence at SEQ ID NO. 12633
  misc_feature (477)..(477): n is a, c, t, g, unknown, or other
  misc_feature (515)..(515): n is a, c, t, g, unknown, or other
  misc_feature (519)..(519): n is a, c, t, g, unknown, or other
aagctggagctccccgcggtggcggccgctctagtactagtggatcccccgggctgcaggaatttgcacgagaccattacctagaacatcctaatcgaaaagtgcttttcttagaggtgggttggcttctcctccccctccggttcgggttcgggttcgtgaggttctccggggttcggtttcgtgggtgagcggatcgagatggcggagtcggatgttgagtaccgctgcttcgtcgggggtctcgcctgggccacggacgaccactccctccacaacgccttcagcacctacggcgaggtcctcgagtccaagatcatcctcgatcggtagacgcagaggtcccgcgggttcggcttcgtcatcttctccacggaggaggtgatgcggaacgccatcgagggcatgaacggcaaggagctggacggacgtgatatcactgtaaatgagggccacccccgcggagggcgaggtcgngaagggcaaggggttacgacgaggtctgggaaggcggncganataggatcccgccagacgcaggggtaggccgggaaaaggtcggcgggtgggcaggaacaacggtacccaaggccggggcaaggcctggccggccgtcgaaggtcaaaagaatggcaggcgggcctgccccaacgtcaaaagaaat

SEQ ID NO: 12633 - protein, 43 aa, Zea mays
  misc_feature: Ceres CLONE 1372182-F
MAESDVEYRCFVGGLAWATDDHSLHNAFSTYGEVLESKIILDR

SEQ ID NO: 12634 - DNA, 608 bp, Zea mays
  misc_feature: Ceres CLONE 1372195-F
aaactggactccccgtggtaggcggggtttacaaaagcgaatttttggagtgaggatcactccgacacattacctagaaatcctaatcgaaaacaatgcatcacaacacatttcaccagacatcgtcacactggtgagctctgcactctgcttatctccggggtgaagagccttcgttgtttgctccacagatcacacacacacacatccagctagctgcactggaccaatgatcgacaccaagaaccaggatcccgactggcgctcccatctaggatgctgcccaacttgccgccacctccgccgtctagaccccgaacgagaagacctctgctctcggcgaggagacctaatttctcctcgataaggagggggggccggtggaggccgaaactgacactgagaccactgacgccgatgacgttgctgaacccaccgatgtacaacccaaataaatcaagccggaggaccccccgccagcagaacatacggaggtccaagaagcatatacggaccacgccgcgacggcagaaaaaacttacgctgctgctggcccggccgaggctgctaatacggagataaccagcgagaccaaataggtagttgtt

SEQ ID NO: 12635 - DNA, 654 bp, Zea mays
  misc_feature: Ceres CLONE 1372195-R
ccgggccccccctcgaggtcgacggtatcgataagcttttttttttttttttttagcacacatacacattatttattcgaccaccacacataacgacgactcctgtactaggcggggcccgccgcgccacggaggacacaacgtgaaccccaacacaaaagcaggtttttcctagcgacctatgccggcgccatgccgtgctgttgccatggcagtggcaccatcgcggcgcaccccagtcgacaggtgacaagctgacgcagcgagatagatctgcctccgtccggagctgggctggactcactcgaccgacttctctaatgctgcctcgggagcaggggccgccgcttcctcctcagtcgctacgaccaggagtggcaacaacagcaggcgctgcctcctcctcctcgctcgttagcctccacagacgccaactctttggacacggcggctatctccagctcaacatcctcgaccggggaagcagcagcctccgtctctgatgccggcgcggcggactcattctctgcttccttgacctccgtctctgctgccggcgcggcggactccggatctgcttccttgggctctgcctcggtcggctcagcaacggcctcggcctccttggtctcagtctcagtctcggcctccacc

SEQ ID NO: 12636 - DNA, 662 bp, Zea mays
  misc_feature: Ceres CLONE 1372197-F
  misc_feature: Encodes the peptide sequence at SEQ ID NO. 12637
aaagctggagctccccgcggtggcggccgctctagaactagtggatcccccgggctgcaggaattcgcacgagaccattacctaagaacatcctaatcgaaaattcaccaatcgccttcctgtcgccctcccgctcggctcggcgaacgcgatctgttccccaacctccgcagccgctccaccgtcctccactccggctgccgaatcgacccgccccgatccagatcaggagctgagggatggacgcgaacaggcgccagagtgggatccagcagttgctggctgcggagcaggaggctcagcaaattgtgaatgccgctagagctgccaagtcagcgaggctcaggcaagcaaaagaggaggctgagcgggaaatagccgaataccgtgcccagatggaggctgagtttcagaggaaggttgcagagagcagcggcgactccggtgcaaacgtcaagcgtctcgaggaagaaacggcggcgaagatcgagcaactcacccagcaggccgcaagcatctccccggatgtcattcagatgcttctgcggcatgtcaccaccgcagaaaactggaggatgctggtccccgactatgctcgcagactggtaccgtcgatttatttatttttggcaaaagtggaaggggtgaagaaaaatatgccc

SEQ ID NO: 12637 - protein, 141 aa, Zea mays
  misc_feature: Ceres CLONE 1372197-F
  misc_feature (5)..(109): Pfam Name: V-ATPase_G Pfam Description: Vacuolar (H+)-ATPase G subunit
  misc_feature: SWISSPROT Homolog: EC 3.6.3.14 H(+)-transporting two-sector ATPase
MDANRRQSGIQQLLAAEQEAQQIVNAARAAKSARLRQAKEEAEREIAEYRAQMEAEFQRKVAESSGDSGANVKRLEEETAAKIEQLTQQAASISPDVIQMLLRHVTTAENWRMLVPDYARRLVPSIYLFLAKVEGVKKNMP

SEQ ID NO: 12638 - DNA, 619 bp, Zea mays
  misc_feature: Ceres CLONE 1372207-F
  misc_feature: Encodes the peptide sequence at SEQ ID NO. 12639
  misc_feature (488)..(488): n is a, c, t, g, unknown, or other
  misc_feature (489)..(489): n is a, c, t, g, unknown, or other
tggagctccccgcggtggcggccgctctagaactagtggatcccccgggctgcaggaattcgcacgagaccattacctagaacatcctaatcgaaaaagtactcgctcatcttgctccgccttctgcttctgcgcatcctccaaggatcgtgatggccatggccacgcaagcctccgcggccacgcgccacctggtggccgccgccgcttccgcctgggcgccgtcggcgaagccgcggcagctaagctcacagctcgcgctgccgccgtcgtcctcccgcgcgccggccccgctccgcgcgaccgccggggaggcggtgaccgaggaggcgcccaaggggttcgtggccccgcagctggaccccagcacgccgtccccgatctttcgcggcagcacgggcgggctgctccgcaaggcgcaggtggaggagttctacgtcatcacgtgggtgtccccccaaggagcagtgttcgagatgcccaccggnncgcgcgccatcatggcggagggggcccacctcctgaagctggcgcgcaggagcattgcctccgctcgggaccaggctggggtccaagaaaagatcacctaccagtttaccggctcccccacagggggggg

SEQ ID NO: 12639 - protein, 155 aa, Zea mays
  misc_feature: Ceres CLONE 1372207-F
  misc_feature (67)..(155): Pfam Name: PsaD Pfam Description: PsaD
  misc_feature (113)..(113): Xaa is any aa, unknown, or other
MAMATQASAATRHLVAAAASAWAPSAKPRQLSSQLALPPSSSRAPAPLRATAGEAVTEEAPKGFVAPQLDPSTPSPIFRGSTGGLLRKAQVEEFYVITWVSPQGAVFEMPTGXRAIMAEGAHLLKLARRSIASARDQAGVQEKITYQFTGSPTGG

SEQ ID NO: 12640 - DNA, 657 bp, Zea mays
  misc_feature: Ceres CLONE 1372208-F
  misc_feature: Encodes the peptide sequence at SEQ ID NO. 12641
aaagctggagctccccgcggtggcggccgctctagaactagtggatcccccgggctgcaggaattcgcacgagaccattacctagaacatcctaatcgaaaatccactcgccctcccacacagaaaaccctagccgccgccaccgaagcggcctcccaggtaagcaggagcgtccaccccgccgccgtcatgaagcgcaatccccgcgtcacgagctcccgccggaagtgccgcaaggcgcactttacggccccgtcctccgtccgccgcgttctcatgtccgccgggctgtcgacggagctccgccacaagtacaacgtgcgctccatcccgatccgcaaggacgacgaggtgcaggtcgtgcgcggcacctacaagggccgcgaggggaaggtggtgcaggtctaccgccgccgctgggtcatccacgtcgagcggatcacccgcgagaaggtgaacggctccaccgtgaacgtgggcatccacccctccaaggtgatcgtcactaagctgaagctcgacaaggaccgcaaggcgctcctggaccgcaaggcccggggccgcgccgccgacaaggctaagggcaagtttactgccgacgacgtcgctgccgcccgccgctgggtggcgccgccaccggcgcctctctccaggaga

SEQ ID NO: 12641 - protein, 156 aa, Zea mays
  misc_feature: Ceres CLONE 1372208-F
  misc_feature (51)..(82): Pfam Name: KOW Pfam Description: KOW motif
MKRNPRVTSSRRKCRKAHFTAPSSVRRVLMSAGLSTELRHKYNVRSIPIRKDDEVQVVRGTYKGREGKVVQVYRRRWVIHVERITREKVNGSTVNVGIHPSKVIVTKLKLDKDRKALLDRKARGRAADKAKGKFTADDVAAARRWVAPPPAPLSRR

SEQ ID NO: 12642 - DNA, 649 bp, Zea mays
  misc_feature: Ceres CLONE 1372219-F
  misc_feature: Encodes the peptide sequence at SEQ ID NO. 12643
  misc_feature (425)..(425): n is a, c, t, g, unknown, or other
  misc_feature (491)..(491): n is a, c, t, g, unknown, or other
  misc_feature (535)..(535): n is a, c, t, g, unknown, or other
  misc_feature (541)..(541): n is a, c, t, g, unknown, or other
  misc_feature (547)..(547): n is a, c, t, g, unknown, or other
  misc_feature (597)..(597): n is a, c, t, g, unknown, or other
  misc_feature (603)..(603): n is a, c, t, g, unknown, or other
tggagctccccgcggtggcggccgctctagaactagtggatcccccgggctgcaggaattcgcacgagaccattacctagaacatcctaatcgaaaaaaacgacgcagctagcgcgcatctcccgatcagctgcactgcaccttcgtcgaacgtcgatcgtactcgtacaccatgaaggcagtcgtcgcggcgacgatgcttctgctggtgctggtggccgcggtgacggtggcgagcgcagaccaccgtgacgacgggcaccaccaccagcgccaccgcggccagagctggcaccgccacagtggcgccggccgagatggccgccggacgacccctctggcggccctgacgcagtgcgtgacaagctgcggggctggggtcacctcctgcatgctggattgatagcagccgctggtcgacctgnaccccgtggagctggccgtctgcctcctccagtggaccaacgtggccatgggtctgtgccaccggntgccccgaccccggggaacgggcagcttgctattccctagcccntccttntccccntctgtctcatgggcctcctagaaaataaaccccgccatggatatcctttncttggncgccggaaccaccccaggggggttactccaaccatacacaggaatg

SEQ ID NO: 12643 - protein, 76 aa, Zea mays
  misc_feature: Ceres CLONE 1372219-F
MKAVVAATMLLLVLVAAVTVASADHRDDGHHHQRHRGQSWHRHSGAGRDGRRTTPLAALTQCVTSCGAGVTSCMLD

SEQ ID NO: 12644 - DNA, 606 bp, Zea mays
  misc_feature: Ceres CLONE 1372223-F
  misc_feature: Encodes the peptide sequence at SEQ ID NO. 12645
  misc_feature (346)..(346): n is a, c, t, g, unknown, or other
  misc_feature (362)..(362): n is a, c, t, g, unknown, or other
  misc_feature (373)..(373): n is a, c, t, g, unknown, or other
  misc_feature (392)..(392): n is a, c, t, g, unknown, or other
  misc_feature (394)..(394): n is a, c, t, g, unknown, or other
  misc_feature (395)..(395): n is a, c, t, g, unknown, or other
gctggagctccccgcggtggcggccgctctagaactagtggatcccccgggctgcaggaattcgcacgagaccattacctagaacatcctaatcgaaaaaccccagccgccgccgccgccaccgccaccgccaccgccacctgccccagcgcgccgccgccgcagccaccatgggtcgcgtccgcaccaagaccgtgaagaagacctccaggcaggtgatcgataagtactactcccgcatgaccctcgacttccacaccaacaagaaggtgctggaggaggtctcgattctgccctcgaagcgcctccgcaacaaggtggctggcttcagtacccacctgatgcngcgcatccagcgcggnccagtccgcgncatctcgctcaagctgcangnnagagagcgcgaagcgcccatggacttcgtgcccgagaagtcgcgctcgaggtcgaaaagatcgcggcgacaaggaaacatggaaatgctccctgccctcgggatggccgacctggccggggttgaccgcccgcttaaggttccaaagcccccgctaaggccgcccggagtacggggtccccggccggaccgggttaaaattccgcgggggt

SEQ ID NO: 12645 - protein, 145 aa, Zea mays
  misc_feature: Ceres CLONE 1372223-F
  misc_feature (1)..(121): Pfam Name: Ribosomal_S17e Pfam Description: Ribosomal S17
  misc_feature (59)..(59): Xaa is any aa, unknown, or other
  misc_feature (68)..(68): Xaa is any aa, unknown, or other
  misc_feature (74)..(74): Xaa is any aa, unknown, or other
  misc_feature (75)..(75): Xaa is any aa, unknown, or other
MGRVRTKTVKKTSRQVIDKYYSRMTLDFHTNKKVLEEVSILPSKRLRNKVAGFSTHLMXRIQRGPVRXISLKLXXREREAPMDFVPEKSRSRSKRSRRQGNMEMLPALGMADLAGVDRPLKVPKPPLRPPGVRGPRPDRVKIPRG

SEQ ID NO: 12646 - DNA, 628 bp, Zea mays
  misc_feature: Ceres CLONE 1372225-F
caccgcggtggcggccgctctagaactagtggatcccccgggctgcaggaattcgcacgagaccattacctagaacatcctaatcaaaaaatctcagctagttatcatatacacaaataatctcttcttcaactcactaacaccactagcaactctttctctcctgtaataatggtcgctcgactcctcctcctcccagtcgcatctgagtcgcggtgccatggggcctgaaagcatgactccgtgctgctggggtggcggggcaagacgccgtgcgctgcgctggacctgctcccgaggtgaccgcgctgtgcggcgccgagactccgcgactcacatggcttagcgctgcatccccctccgcggggggactgcattgggctgcgttcacacaacagactctcattggaagaaggagaacagaatgacacctgccactgactacaagaacatgacgaagagcgctactcggttcgagacatcatggtcaacagcgtcaaacatacgcgattagtgtgtgcgtcaccgatggctgcgttcatcggcgccaccagtcgactgcaccaattagcaactggatcttagggaccatagaagagaccagataagctcgctcaatgaacagcaa

SEQ ID NO: 12647 - DNA, 652 bp, Zea mays
  misc_feature: Ceres CLONE 1372228-F
  misc_feature: Encodes the peptide sequence at SEQ ID NO. 12648
tggagctccccgcggtggcggccgctctagaactagtggatcccccgggctgcaggaattcgcacgagaccattacctagaacatcctaatcgaaaaattttcatcagcagcattacccatcgctcgccaacgtgcagactaaggaagcactgaccggccggtcatggcgaggatccacctctacgtcgtcgccgcggcctgcgccgtcgccctcgcgctcgccggcgacccggacatgctccaggacgtctgcgtggctgactacgcttccccggtcaagctgaacgggttcccgtgcaaggcgaacatctcggcggacgacttcttcttcgacgggctgaggagcccgggcaacaccaacaacccggcgggctccgcggtgacggcggccaacgtggacaagttcccgggggtgaacacgctgggcgtctccatggcgcgcatcgactacgcgccgggcggccagaacccgccgcacacgcacccgcgcgccaccgagatcatcttcgtcctcgagggcacgctcgaggtcggcttcctcaccaccgccaacaggctcctcagcaagaccgtcgccacgggggacgtcttcgtctttccccgcggcctcgtccacttccagcagaacagggggcacggcccccgccgccg

SEQ ID NO: 12648 - protein, 162 aa, Zea mays
  misc_feature: Ceres CLONE 1372228-F
  misc_feature (57)..(162): Pfam Name: Cupin_1 Pfam Description: Cupin
  misc_feature: SWISSPROT Homolog: EC 1.15.1.1 Superoxide dismutase
MARIHLYVVAAACAVALALAGDPDMLQDVCVADYASPVKLNGFPCKANISADDFFFDGLRSPGNTNNPAGSAVTAANVDKFPGVNTLGVSMARIDYAPGGQNPPHTHPRATEIIFVLEGTLEVGFLTTANRLLSKTVATGDVFVFPRGLVHFQQNRGHGPRR

SEQ ID NO: 12649 - DNA, 626 bp, Zea mays
  misc_feature: Ceres CLONE 1372237-F
  misc_feature: Translation starting site: 171
tggagctccccgcggtggcggccgctctagaactagtggatcccccgggctgcaggaattcgcacgagaccattacctagaacatcctaatcgaaaactccaaaccctagcccagagcagccgcatcgaactctacctgcctttctctcgtccctggcggcggcggcaggatggcggcttctactgcgaggacggtgaaggatgtgaacccccacgagtttgtcaagggctactccgcccatctcaaacgctccggcaagatggagcttcctgagtggcctgacattgtgaagactgcgaggttccaggagctccctccttatgaccctgactggtactacatcagggctgcatctgtagcacaggaatgatctacttgagacaaggcattggtgttggtgggcttccagaacatttatggaggccgccagaggaatggctcacgcccacctcacttcgtgcgagagcagtggagccatttcacgcaacatcctccagcatctgcaggagatgggcatcatttatgtcgatcccaagggtggacggcgcatcgcctcccaaggaaggcgtgatctgcaccatgtggctggaacgcgtgctgctgaagcttgagcaatctcatattt

SEQ ID NO: 12650 - DNA, 614 bp, Zea mays
  misc_feature: Ceres CLONE 1372240-F
  misc_feature: Encodes the peptide sequence at SEQ ID NO. 12651
aagctggagctccccgcggtggcggccgctctagaactagtggatcccccgggctgcaggaattcgcacgagaccattacctagaacatcctaatcgaaaaaacgcacatctccaccggcgtccgccgccggctaatgacggaaggagaagagggtatggccgtctactcggacctatgggacacgataagaagctgtccaacccgatgcggcagatcaaagtgcacaagctcgccctcaatatctccgtaagacagagcgacgaccgactcacccgcggcgaagaggtggtcgaggagctcatcgtccagacccgcgtcttctccaagagaggtacacaggagcgccgttcggcgtgcggagcaacgagatcatcgtctgctacgtcgctgagaggggggacacgacatgcagatgcttgcgagggcctgacgtcatggagtactacctgatcacgagttactcagctgcccgggtggtctgcttcctggatccggaacacatcaccttgcattcagtacgagtcttcaaagcttctacggatggacttccagggaaggttgaaaggcgggctttcgggggggaacccgaaggggggcaattccccgtcagga

SEQ ID NO: 12651 - protein, 91 aa, Zea mays
  misc_feature: Ceres CLONE 1372240-F
MGHDKKLSNPMRQIKVHKLALNISVRQSDDRLTRGEEVVEELIVQTRVFSKRGTQERRSACGATRSSSATSLRGGTRHADACEGLTSWSTT

SEQ ID NO: 12652 - DNA, 644 bp, Zea mays
  misc_feature: Ceres CLONE 1372241-F
  misc_feature: Encodes the peptide sequence at SEQ ID NO. 12653
aagctggagctccccgcggtggcggccgctctagaactagtggatcccccgggctgcaggaattcgcacgagaccattacctagaacatcctaatcaaaaaatcttgctctgaacgcattcctcccatctcccaagacctcctcagacccgagaagcgcagctgcggccatggacgccaccggcactggatctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccgggtcctgctggccaaagaagacggcgggaaagggcgtccagccggcgggagcaagtaagccaaagtcgccccaagaaggccgcccaagtccccc

SEQ ID NO: 12653 - protein, 158 aa, Zea mays
  misc_feature: Ceres CLONE 1372241-F
  misc_feature (31)..(104): Pfam Name: Histone Pfam Description: Core histone H2A/H2B/H3/H4
MDATGTGSGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLTGVTIAHGGVLPNINPGPAGQRRRRERASSRREQVSQSRPKKAAQVP

SEQ ID NO: 12654 - DNA, 651 bp, Zea mays
  misc_feature: Ceres CLONE 1372258-F
  misc_feature: Encodes the peptide sequence at SEQ ID NO. 12655
aaagctggagctccccgcggtggcggccgctctagaactagtggatcccccgggctgcaggaattcgcacgagaccattacctagaacatcctaatcgaaaaatgatttgacagaggcatctcatcccctctccacctaacgagcttccgccgcctcacccccacctcgtccctccgcgccgacgtcgccatgtcctcctcctcggccgcgggcgccgccccgaaccagcacttcgtgctctgcaacgtccgcccggagaaggggggctccttcgccgaggccgacatggtctcctcgctgcaggaactgaacacgatcgtgccgaggctggcctacatccacgtacgagcagcggtccgcctacgattaccgagcgcggaggcagtgtgacccacgcaactcctccacacccgctacgccagcaaggacgagctgaagacatacgcggttcacccggcgcacgtggccgccgtgctacgtatacctcgctcccaacgagctcgagatcaacgccattcgactgggtgaacgcagcgacgctccctgcacccgaggcccacgtgagatccctgcggctcacgctggcaaaggtgaaggaaagtacgtaggtcgcgcaaataatgagaaaggtgaccacacccacccagacc

SEQ ID NO: 12655 - protein, 66 aa, Zea mays
  misc_feature: Ceres CLONE 1372258-F
MSSSSAAGAAPNQHFVLCNVRPEKGGSFAEADMVSSLQELNTIVPRLAYIHVRAAVRLRLPSAEAV

SEQ ID NO: 12656 - DNA, 637 bp, Zea mays
  misc_feature: Ceres CLONE 1372261-F
  misc_feature: Encodes the peptide sequence at SEQ ID NO. 12657
  misc_feature (398)..(398): n is a, c, t, g, unknown, or other
  misc_feature (403)..(403): n is a, c, t, g, unknown, or other
  misc_feature (410)..(410): n is a, c, t, g, unknown, or other
  misc_feature (499)..(499): n is a, c, t, g, unknown, or other
  misc_feature (500)..(500): n is a, c, t, g, unknown, or other
tggagctccccgcggtggcggccgctctagaactagtggatcccccgggctgcaggaattcgcacgagaccattacctagaacatcctaatcaaaaaaaaaattctctgtgatgatgtgaacgaaggtctgaaaaaatcacagaactcactcgaacgacggtgccgccgcttgcctcgccggaccatggccgctgtgccgtcggggttcctcctcatcactggcccgccgggcgtggggaagacgacgctggtcatgcgggtgtttgaaaccctcagaggctcccacccgaacctcaacattcgcggattctatacccgagaggtgagagagggcggagaaaggatagggttcgaggttgtcacgctcgacggtagaactggaccactttcctcatgncaggnttccagnccggagtctgttagatggcctacccgtcggaaatacaaagtagacgtagcatccttggaatcattagcagtacctgagctgcaggtaanngaagaaacagatctcttcatcattgacgaagtggtaaaatggagctggtcagttcagcattttccctgcggaatggagaggtattgatccaataaacaggggttggccccatacccatccataggaggccgggaaat

SEQ ID NO: 12657 - protein, 133 aa, Zea mays
  misc_feature: Ceres CLONE 1372261-F
  misc_feature: SWISSPROT Homolog: EC 2.7.4.8 Guanylate kinase
  misc_feature (71)..(71): Xaa is any aa, unknown, or other
  misc_feature (73)..(73): Xaa is any aa, unknown, or other
  misc_feature (75)..(75): Xaa is any aa, unknown, or other
  misc_feature (105)..(105): Xaa is any aa, unknown, or other
MAAVPSGFLLITGPPGVGKTTLVMRVFETLRGSHPNLNIRGFYTREVREGGERIGFEVVTLDGRTGPLSSXQXSXPESVRWPTRRKYKVDVASLESLAVPELQVXEETDLFIIDEVVKWSWSVQHFPCGMERY

SEQ ID NO: 12658 - DNA, 631 bp, Zea mays
  misc_feature: Ceres CLONE 1372271-F
  misc_feature (462)..(462): n is a, c, t, g, unknown, or other
  misc_feature (465)..(465): n is a, c, t, g, unknown, or other
  misc_feature (467)..(467): n is a, c, t, g, unknown, or other
  misc_feature (469)..(469): n is a, c, t, g, unknown, or other
  misc_feature (501)..(501): n is a, c, t, g, unknown, or other
tggagctccccgcggtggcggccgctctagaactagtggatcccccgggctgcaggaattcgcacgagaccattacctagaacatcctaatcgaaaaagttctacggcggcgatacccccctccactccccaccctgtcacccccacaaaataagttctgcggcggcgatggcgctctcctcctcccggccgaagcacctcctgcgccccatcctgcggggtttccacgcctcggcgggccctggcgcgggtggagccgcacgagttctccaagcccagcgagtacctgggcagctgggagcccgcggcggagcctcgggaggcgtgggcgcggctggaccggctgcgcaaggggtacgcgagcgaggtgcgggagctgcggcggcagtacgcctacgaggtgcagctgttgcaggccgagcggcagcggaagggcgacgccagagccgaggccgcccgcgncgncnancaggagcgcaagggccgcaagctcgccgccgnccaaaacgcgcgccgccgagcgccgggcgttcgaggaagacttccgcccaaccctcttgaaaaaaagaactctgaaaaactggaaaactgggggaaaaagggaaaaccgcaaaaagggaaaaaagggcaa

SEQ ID NO: 12659 - DNA, 692 bp, Zea mays
  misc_feature: Ceres CLONE 1372273-F
  misc_feature (365)..(365): n is a, c, t, g, unknown, or other
  misc_feature (390)..(390): n is a, c, t, g, unknown, or other
  misc_feature (417)..(417): n is a, c, t, g, unknown, or other
  misc_feature (431)..(431): n is a, c, t, g, unknown, or other
  misc_feature (450)..(450): n is a, c, t, g, unknown, or other
  misc_feature (489)..(489): n is a, c, t, g, unknown, or other
  misc_feature (490)..(490): n is a, c, t, g, unknown, or other
  misc_feature (517)..(517): n is a, c, t, g, unknown, or other
  misc_feature (521)..(521): n is a, c, t, g, unknown, or other
  misc_feature (537)..(537): n is a, c, t, g, unknown, or other
  misc_feature (548)..(548): n is a, c, t, g, unknown, or other
  misc_feature (569)..(569): n is a, c, t, g, unknown, or other
  misc_feature (581)..(581): n is a, c, t, g, unknown, or other
  misc_feature (587)..(587): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (615)..(615): n is a, c, t, g, unknown, or other
  misc_feature (617)..(617): n is a, c, t, g, unknown, or other
  misc_feature (635)..(635): n is a, c, t, g, unknown, or other
  misc_feature (644)..(644): n is a, c, t, g, unknown, or other
  misc_feature (657)..(657): n is a, c, t, g, unknown, or other
tggagctccccgcggtggcggccgctctagaactagtggatcccccgggctgcaggaattcgcacgagaccattacctagaacatcctaatcgaaaaagttctacggcggtgatacccccctccactccccaccctgtcacccccacaaaataagttctgcggcggcgatggcgctctcctcctcccggccgaagcacctcctgcgccccatcctgcggggtttccacgccctcggggcccctggcgcgggtgtagacgcacgagttctccaagccccagcgagcacccgggcagctgggagcccgcggcggcccctccggaggcgggggcgcgggtgcaccggctgcccaggggtcacccaacncatttgccggagttggggggggcgnacggctacgagggggcagctgttcgcnggggccggcgtcgngggaagggccggacgcccnagcccgggggcgccccggcaccgcgcccccccggggggnnagggccccaaagttaggcaaccccccnaaangggggccccccaaggngcaagcccctncggcgcggcccctcgcgcccnccacccccggtnaaagcnggnnnncaaaaagcccgcatctaagcgngngaaacattctacccccancaacagganaactatgcctctntaaataagggaacttttccagcaaaataacaaaca

SEQ ID NO: 12660 - DNA, 658 bp, Zea mays
  misc_feature: Ceres CLONE 1372275-F
  misc_feature: Encodes the peptide sequence at SEQ ID NO. 12661
aaagctggagctccccgcggtggcggccgctctagaactagtggatcccccgggctgcaggaattcgcacgagaccattacctagaacatcctaatcaaaaaaaaatttcccaaacgcaaaaccgcatcctctcatcagcttccttccacattcgtctcgagatctcgccccgtcgccatggacgcgatcgacagcgtggtggatcccttccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgttaagctcatcttcatccccatcaacaacatcatcgtcggttccggctaggcttacaggagtacagggcgactagcatgggagtagtgcaatacttttgtgagcaatagataacgaggatcctgatctttcgaattgtattggtatgaaatttttcgggtcgggtgggtttctaatgaaatcgttggactggagaaacttcttgaaaccgggatcctgagaaacccttgaatccttggagggatcaccaactcccgaaaaggaagtttcgaatttttgggggtccccgtaaaaaaaaaaaaaaaaggggggcggaatcca

SEQ ID NO: 12661 - protein, 69 aa, Zea mays
  misc_feature: Ceres CLONE 1372275-F
  misc_feature (10)..(66): Pfam Name: SecE Pfam Description: SecE/Sec61-gamma subunits of protein translocation complex
MDAIDSVVDPFRDFAKDSVRLVKRCHKPDRKEFTKVAARTAIGFVVMGFVGFFVKLIFIPINNIIVGSG

SEQ ID NO: 12662 - DNA, 631 bp, Zea mays
  misc_feature: Ceres CLONE 1372278-F
  misc_feature: Encodes the peptide sequence at SEQ ID NO. 12663
  misc_feature (418)..(418): n is a, c, t, g, unknown, or other
aagctggagctccccgcggtggcggccgctctagaactagtggatcccccgggctgcaggaattcgcacgagaccattacctagaacatcctaatcgaaaacgggctacgttaaaatctctccatcccggcgacgactggcgacagccgctgccggactactccaggtccccaggtctacgtcggacccttcggcggagagcaccaccagatggcgagcacggggcggtcgatgctgctgtcactgctcctcttcgcaatgacgctgtcgctgctgaagatgtacagggccaagttcgcctcgtctgagctcatgaccatcgacggtggattcggctgctccctcctatgcatgctactcctcacctttattcgaagctatcaagaagctagtggacatacatctggggagggtgcanggggtgcaccacaacttggagcctttattggacccgggtactggcaccgggggtgaattacaaaatgcttcagggttcccggtggaaccctttacaaggttaacaacttctgggaaaaacctttgggaaggggtttaaagggggagggggtcttaacaataaaccttccaaaagaaaaaaaccccgccttttttttaaaaccccccttttggt

SEQ ID NO: 12663 - protein, 87 aa, Zea mays
  misc_feature: Ceres CLONE 1372278-F
  misc_feature (70)..(70): Xaa is any aa, unknown, or other
MASTGRSMLLSLLLFAMTLSLLKMYRAKFASSELMTIDGGFGCSLLCMLLLTFIRSYQEASGHTSGEGAXGAPQLGAFIGPGYWHRG

SEQ ID NO: 12664 - DNA, 657 bp, Zea mays
  misc_feature: Ceres CLONE 1372287-F
  misc_feature: Translation starting site: 203
  misc_feature: SWISSPROT Homolog: EC 3.1.27.1 Ribonuclease T(2)
  misc_feature (394)..(394): n is a, c, t, g, unknown, or other
aaagctggagctccccgcggtggcggccgctctagaactagtggatcccccgggctgcaggaattcgcacgagaccattacctagaacatcctaataaaactcccacctcgatccctgcgctgcaagcaacaaagttctactctgtccacccgtccatctagctcccaagaaccaacccgtaccagcgctatccggccggccatggaggcggagcgccggttctccctgcccctcgtcctgctggacgtcctggacgtcgccgggcgcgcggcgacgcaggactacgacttcttctacctcgtgctgcagaggccggaggcctactgcgacaccaagcagaggtgctgctaccccaatgcaggcaagccggcggcgtacttcgggatccacggnctctgggccaaccgcgacgacagcacgtacccgcagaactgcagcaccgacacgtcctcgaaccgacgaacgtgagcgacctgctgagcaacatccgcggccagggttcgagctggtggtgcccgcccacgacgggatggctttctggggccaccaatggaaagattacggaacctggttaacctaacttttccaacaaaaaggttatttccggacggggttgccccccaaaaaaagtggaaatccctcgggggttaaacaaa

SEQ ID NO: 12665 - DNA, 647 bp, Zea mays
  misc_feature: Ceres CLONE 1372291-F
  misc_feature: Encodes the peptide sequence at SEQ ID NO. 12666
  misc_feature (269)..(269): n is a, c, t, g, unknown, or other
  misc_feature (319)..(319): n is a, c, t, g, unknown, or other
  misc_feature (338)..(338): n is a, c, t, g, unknown, or other
  misc_feature (347)..(347): n is a, c, t, g, unknown, or other
  misc_feature (348)..(348): n is a, c, t, g, unknown, or other
tggagctccccgcggtggcggccgctctagaactagtggatcccccgggctgcaggaattcgcacgagaccattacctagaacatcctaatcgaaaagaaacccgtctcgcaccacaagcgagcgagggacccggggcggaagaagagagagaagacgtctctctcctctcggcgtccccgttccccaacctctcgtctgctgcctgcctgcctgcctgcctgcaaaaaggagtttgtcatggcgtctaagcgcatccctcaggagctngaggacctgcagaaagaccccccacatcatgcagtgcaggtcctgctggntgagacatgtttcattggncagccacanntatgggacccactgacagtccctatgctggcggggtttttctaagggacattcatttcccggcagaatacccccttcaacctcccaaggttccttccaagaaaaaggccctcacttcctaatttcaccgcaaggggagtttttgcctttgaatttccaaaagaaaagggacccctgctttgaaatttttaaggggcggggctccccttggggcccggggggagagccccacccggggaaacccctttggcccggggatttgcccccctttaaaaaaagggccgggccaaaataaaaccc

SEQ ID NO: 12666 - protein, 47 aa, Zea mays
  misc_feature: Ceres CLONE 1372291-F
  misc_feature: SWISSPROT Homolog: EC 6.3.2.19 Ubiquitin--protein ligase
  misc_feature (5)..(5): Xaa is any aa, unknown, or other
  misc_feature (8)..(8): Xaa is any aa, unknown, or other
MFHWXATXMGPTDSPYAGGVFLRDIHFPAEYPLQPPKVPSKKKALTS

SEQ ID NO: 12667 - DNA, 642 bp, Zea mays
  misc_feature: Ceres CLONE 1372302-F
  misc_feature: Encodes the peptide sequence at SEQ ID NO. 12668
  misc_feature (612)..(612): n is a, c, t, g, unknown, or other
aagctggagctccccgcggtggcggccgctctagaactagtggatcccccgggctgcaggaattcgcacgagaccattacctagaacatcctaatcgaaaaatgtcccatagctcagctcagcttcttagcgtctctgcttgtattttatcgagcggtcacgacgagcgacccaatggggatcgaggtggtggactctctgcccttcatcttcctctccatcctcctcgcgttcggatgctacttcctcgcaaagcaaaggggccgacgaggagatgcggaccggcgttggagcgcacatctacgggacgccgctgccgccggccgaaggcgtcggagcctcctcgccggcgcctgagccgctccacataaataaacaacggtccgaagctgcgcgactgagattcacacgactctccatccatccattctactaatactacttatatgtcttgcagctgacgcaggatttatatgctttcttctttaatttcgacctgcgtgacttgatagtgtagattgaccatcaaatatgtgcttgtgctgcatgatgtgataccattgctatcgcactttatatcttctgtaatcaagcacaaaccactgcgttgcngtgcccaagtcccccaagaagggcgccaag

SEQ ID NO: 12668 - protein, 60 aa, Zea mays
  misc_feature: Ceres CLONE 1372302-F
MGIEVVDSLPFIFLSILLAFGCYFLAKQRGRRGDADRRWSAHLRDAAAAGRRRRSLLAGA

SEQ ID NO: 12669 - DNA, 645 bp, Zea mays
  misc_feature: Ceres CLONE 1372308-F
  misc_feature: Encodes the peptide sequence at SEQ ID NO. 12670
  misc_feature (401)..(401): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (557)..(557): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (576)..(576): n is a, c, t, g, unknown, or other
  misc_feature (577)..(577): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (588)..(588): n is a, c, t, g, unknown, or other
  misc_feature (589)..(589): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (609)..(609): n is a, c, t, g, unknown, or other
  misc_feature (610)..(610): n is a, c, t, g, unknown, or other
  misc_feature (612)..(612): n is a, c, t, g, unknown, or other
  misc_feature (622)..(622): n is a, c, t, g, unknown, or other
  misc_feature (623)..(623): n is a, c, t, g, unknown, or other
tggagctccccgcggtggcggccgctctagaactagtggatcccccgggctgcaggaattcgcacgagaccattacctagaacatcctaatcgaaaaaggacctgtgcctcttcggtcaaaaatatccttgtacctgcatctcgacctcaccggcgaccggcggtgatatcactatggtggcgttgctgggccggcggatcggggtggctgcggcagctgccgcgttcatcgccctcgcggcgttcggatccgcctcatcctcgcccaagtccttcgtgaagagcaccgtctccgcccacgacgtcgtcatcttctccaagtcatactgcccgtactgcaaaagagcaaaggtcgtgttctagagatcttgagttgaagaaagagccatatgtgtgcggangattgatctagcgcagaggatgggctccgcaggattccgggatggcctttaccttcgggaaaaaggtggggcgggggggggaacccggggcccccccacaaagtttttttttcccccccgggggggggggccccctccggtggggttnnnntcttntctcnnncnnnnnnnaaannaannnnaaaanncnnnannnnnaggagcggcnntncgaggcgggnncccgcccatgtcttcctccgcg

SEQ ID NO: 12670 - protein, 62 aa, Zea mays
  misc_feature: Ceres CLONE 1372308-F
MVALLGRRIGVAAAAAAFIALAAFGSASSSPKSFVKSTVSAHDVVIFSKSYCPYCKRAKVVF

SEQ ID NO: 12671 - DNA, 632 bp, Zea mays
  misc_feature: Ceres CLONE 1372322-F
  misc_feature: Encodes the peptide sequence at SEQ ID NO. 12672
aagctggagctccccgcggtggcggccgctctagaactagtggatcccccgggctgcaggaattcgcacgagaccattacctagaacatcctaatcgaaaaatcatcttgctccgaacgcattcctcccatctcccaagacctcctcatacccgagaacggcagctgcggccatggatgccaccaggactggagctggagggaaagacaagaagggagcggccggtcgcaaggccggcggacgcgaggcaacaagaagaagacgaggaccgggacaggccgggctccagctgcccgtcgcccgcatcgggcgctacctctagaagggccgctacgcgcagcgggacagcaggggtgccgccgcctacctcgcggtcgccgtggaggagctctacgctgacgtcctggagctcgacgggaacggtgacaaggacaacagagaacacgaagatcggcccccgccacgtgcatcgctggtgcatccgcaacgacaacgagcatcgagaagctgaatgaccgtgcgtgaccatcaacacacgtgcggccgtcgatgtccaacagtcaacaccgcgcctcttgtgctccatgacagacgaacggtagaaggacgtccatgcggcatgcgagcgaagg

SEQ ID NO: 12672 - protein, 49 aa, Zea mays
  misc_feature: Ceres CLONE 1372322-F
MDATRTGAGGKDKKGAAGRKAGGREATRRRRGPGQAGLQLPVARIGRYL

SEQ ID NO: 12673 - DNA, 635 bp, Zea mays
  misc_feature: Ceres CLONE 1372328-F
  misc_feature: Encodes the peptide sequence at SEQ ID NO. 12674
tggagctccccgcggtggcggccgctctagaactagtggatcccccgggctgcaggaattcgcacgagaccattacctagaacatcctaatcgaaaaatcttccaccgcgcttcgcccactcgctccagccgcttcaccgcgccgccaccgccaccgcgaggatgccgttcaagaggttcgtggagatcgggcgcgtggccctggtgaactacggggaggactatggccgtctcgttgtcatcgtcgatgtggtcgaccagaacagggcacttgtggatgcccctgatatggtcaggtgccaggtgaacttcaagcggctctcacttactgacatcaagattgacatcaaacgtgtccccaagaagacagccctgatcaaggcgatggaggaagctgatgtgaagaccaagtgggagaacagctcatggggcaagaagctgattgtccagaagaggagagcatcgctcaatgactttgataggttcaaagtcatgctggcgaagattaagaggggcggtgctatcaggcaagagctcgccaagctgaagaaggcgtccacggcttaaggagtctctttccgtgaatgtcatgttagagtttttggttatgagttggatcagcaattcgattgagc

SEQ ID NO: 12674 - protein, 134 aa, Zea mays
  misc_feature: Ceres CLONE 1372328-F
  misc_feature (44)..(120): Pfam Name: Ribosomal_L14e Pfam Description: Ribosomal protein L14
MPFKRFVEIGRVALVNYGEDYGRLVVIVDVVDQNRALVDAPDMVRCQVNFKRLSLTDIKIDIKRVPKKTALIKAMEEADVKTKWENSSWGKKLIVQKRRASLNDFDRFKVMLAKIKRGGAIRQELAKLKKASTA

SEQ ID NO: 12675 - DNA, 639 bp, Zea mays
  misc_feature: Ceres CLONE 1372333-F
  misc_feature: Encodes the peptide sequence at SEQ ID NO. 12676
  misc_feature (639)..(639): n is a, c, t, g, unknown, or other
aagctggagctccccgcggtggcggccgctctagaactagtggatcccccgggctgcaggaattcgcacgagaccattacctagaacatcctaatcgaaaaattcacatcagagcggcgccggcctacaaccgttttcgtgctcacacacccataccttagtcgcgatcaggccccaaggactctaggatgatctagagggaacggtccaccgccggagactcctggctctcggtgaggaagacctaggctgagaacgacccaaacaagccctagaggactccgagcgcgttcttcgtcttcatggaggagctcaggaaggactacaaggagaagcaccccaatgtgaagcaagtctccctgattgacaacgctgttgctgacaagtggaactccctgtctgatgccgagaatgctccctacgtgccgaagggatagaagctcaaggctgagtacaccaagaatatcgacgcttactacaactagcagtctggagaccccacgacgtctggcgattccgacaagtccaagtccgacgtcaacgacgagtactaggagagtgacgagcggtgtatgacgcatgaaactctgtccaagtgtttgcaggcggggaaaaaatctcggcgttgtcggcctaacn

SEQ ID NO: 12676 - protein, 44 aa, Zea mays
  misc_feature: Ceres CLONE 1372333-F
MEELRKDYKEKHPNVKQVSLIDNAVADKWNSLSDAENAPYVPKG

SEQ ID NO: 12677 - DNA, 612 bp, Zea mays
  misc_feature: Ceres CLONE 1372334-F
  misc_feature: Translation starting site: 201
tggagctccccgcggtggcggccgctctagaactagtggatcccccgggctgcaggaattcgcacgagaccattacctagaacatcctaatcgaaaaacacaccgcctcaactcgcgctgcccgtcgcccccaagcctcggttccgccggcgcgcgaggggattcgagctgagtcttgggtagcctctcaccgtctcacgatgccgacagcacccaagtccggcgacgccctcttcgccagcgtggatcgcggcaatgcggagctgttcacgctcacgtacggtgccatcgtgcggcagttgctcacggatctggaggaggtcgaggaggtcaacaagcagctcgatcagatgggttacaacattgcaacacgattggctgatgagttcttagcaaagtcaaatgtatcaaggagtgttgacttcaaggagactgccgatgttattgcgaagcttgaattcaaatggtcttgggcgtgactgcaaccgagaccaattgcgatgctgacggtacaagttgcagccttgtcctgtaagacaaccctcttgtagatttcggtgagctccctgacacttgccagggccttcagtattgcaacttgttaagtggagg

SEQ ID NO: 12678 - DNA, 538 bp, Zea mays
  misc_feature: Ceres CLONE 1372335-F
aaagctggagctccaccggcggtggcggccgctctagaactagtggatcccccgggctgcaggaattcgcacgagaccattacctagaacatcctaatcgaaaaagttgccatctcgcaaagtcgcaataacttgtcttctcgaatcggctgcaaccccaccccagaccccaccgccgccgccgctagggttttggggtgaggatcgccgatgtcgacggctcccaggcgtcccttccgaggccgcggcgccatgccctcgggcaccggctacgtccgccgcggccccgccccagggctccgccgacggcgccaaggcccctggcgcaagccccgtcttcaccaaccgtcgaacaggcttcggcccccagacacacgggccacacttcttcacagccccgcggtcatttgccggcccgggacgggtcccttcaaaaaagccccttccaagggaacctttggggccgggaacccgggggttcgccccaaaaggggccctcccgccccggagagaaaagggaaccccggggaaccccgtg

SEQ ID NO: 12679 - DNA, 636 bp, Zea mays
  misc_feature: Ceres CLONE 1372336-F
  misc_feature: Encodes the peptide sequence at SEQ ID NO. 12680
aaagctggagctccccgcggtggcggccgctctagaactagtggatcccccgggctgcaggaattcgcacgagaccattacctagaacatcctaatcgaaaaatccctacggagggccagtcgacctctctgctcgcgaaaaatggcggcggcagcggaaggtttggctgcctacagggcggtgctgcgggcggcgcggcggacgttcgcgggcgaccagctgatgctgaaggagtctgcggtggagatccggcgccgctttgaggaccaccgtggtctaaccccgggctccgacgatgcagcgcgtgccctcgccgacgcccgcgaggcggcgcacttcatcacccatatgatagtccaggccacacgcgcaccctccggatccttcgttgtgaagcctgagagtgttcatgctggagctacactggaagttccttccgaggagatcctttcaaagttgaagtaggtcactagcattgctgaagtaggtcaccatctgcatgctagtaaaataagaccagtttgcaacggttgattcttgtgttgcatactggttcacttagtagcttcacacttttgcttttattattattattattattattattattattattattattattattattatta

SEQ ID NO: 12680 - protein, 107 aa, Zea mays
  misc_feature: Ceres CLONE 1372336-F
  misc_feature (2)..(69): Pfam Name: Complex1_LYR Pfam Description: Complex 1 protein (LYR family)
MAAAAEGLAAYRAVLRAARRTFAGDQLMLKESAVEIRRRFEDHRGLTPGSDDAARALADAREAAHFITHMIVQATRAPSGSFVVKPESVHAGATLEVPSEEILSKLK

SEQ ID NO: 12681 - DNA, 630 bp, Zea mays
  misc_feature: Ceres CLONE 1372343-F
  misc_feature: Encodes the peptide sequence at SEQ ID NO. 12682
tggagctccccgcggtggcggccgctctagaactagtggatcccccgggctgcaggaattcgcacgagaccattacctagaacatcctaatcgaaaaattcgcccacacgagcctacccaaagagcccagagcctgggaggttacttcgctgcctgaggagtccccggcaccggaggtcttgctaccggatggcggcttcttcttccgttcctccccaaggcctcttcccggaggaatcatgatcgtctgcgtcgccgttgtcggccaccagagcttcacggaggcggacgacgccctcaagctccaccacatcgtccactgctctctcgacgtcatcgacgagcgagtgagcaatcctaagaggagtgcacctacattgaatgagacatttttgtgtcttctatacccaactgagaactacacagtgtatggttatttgagcaacacaaaggcctaatttatcatggtcacgactgatcttgatgtcgaagatgcagatgccccgaatttttttcggcaggtccatgctgcatatgtagatgccgactcgaacccgttccatgtcccagggaataagatctgcttcacgagctttggcgcaagagtagccaccatcttaaatccttccg

SEQ ID NO: 12682 - protein, 72 aa, Zea mays
  misc_feature: Ceres CLONE 1372343-F
  misc_feature (7)..(72): Pfam Name: Sedlin_N Pfam Description: Sedlin, N-terminal conserved region
MIVCVAVVGHQSFTEADDALKLHHIVHCSLDVIDERVSNPKRSAPTLNETFLCLLYPTENYTVYGYLSNTKA

SEQ ID NO: 12683 - DNA, 623 bp, Zea mays
  misc_feature: Ceres CLONE 1372350-F
  misc_feature: Encodes the peptide sequence at SEQ ID NO. 12684
tggagctccccgcggtggcggccgctctagaactagtggatcccccgggctgcaggaattcgcacgagaccattacctagaacatcctaatcaaaaatacctctgcctttccccggtcgtctccacttacaggcctccgcttcccatcccgatcaaactgccgcattgccgctccttccctccctctacccgtcggcgctgctgccatggacgaatccgtcacccagattttggagaactaatagctggtctgccgcgaaggcggtggaggacaacctcgaggaggacatcgccgagctcgaccgcctcaatccgaacgacatcgaggcgctccacgagcgccggatccaggagatgcaccacggctccgaggggcgggccaagtgccatgcgctggagcacgaggagtacaccgagatccccgagaaggacttcttctacatcgccaagggcagcgagcgggtcgactgccacttctaccgccagaactggacctgcaaggtggtgcacaagcacctgtcggctctggcaaaacaggaccgggactaacacatcaacggaggtccacgacaaggaagcccccttcatgagagagaagtgcacgataatcatcctctcgaccc

SEQ ID NO: 12684 - protein, 64 aa, Zea mays
  misc_feature: Ceres CLONE 1372350-F
MHHGSEGRAKCHALEHEEYTEIPEKDFFYIAKGSERVDCHFYRQNWTCKVVHKHLSALAKQDRD

SEQ ID NO: 12685 - DNA, 639 bp, Zea mays
  misc_feature: Ceres CLONE 1372356-F
  misc_feature: Encodes the peptide sequence at SEQ ID NO. 12686
  misc_feature (467)..(467): n is a, c, t, g, unknown, or other
  misc_feature (468)..(468): n is a, c, t, g, unknown, or other
tggagctccccgcggtggcggccgctctagaactagtggatcccccgggctgcaggaattcgcacgagaccattacctagaacatcctaatcaaaaaaccctagcgccgcaccctcccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctccggnncaccaggaaggagttccgcttgaggaaagccaagaatgaccagctcaaggcggatgccaaggccctgcggtgaggtgatcagcaccaagaggcagcctgtgggacccaaacctggcttcatgggttgagggtgctacactcgagacagtcactcctattccttatgatgtg

SEQ ID NO: 12686 - protein, 107 aa, Zea mays
  misc_feature: Ceres CLONE 1372356-F
  misc_feature (2)..(100): Pfam Name: Ribosomal_L21e Pfam Description: Ribosomal protein L21e
  misc_feature (101)..(101): Xaa is any aa, unknown, or other
MPAGHGLRSRTRDLFARPFRKKGYIPLTTYLRTYKIGDYVDVKVNGAVHKGMPHKFYHGRTGSVWNVTKRAIGVEINKQVNGRIIRKRIHVRVEHVQPSGXPGRSSA

SEQ ID NO: 12687 - DNA, 651 bp, Zea mays
  misc_feature: Ceres CLONE 1372360-F
  misc_feature: Encodes the peptide sequence at SEQ ID NO. 12688
aagctggagctccccgcggtggcggccgctctagaactagtggatcccccgggctgcaggaattcgcacgagaccattacctagaacatcctaatcgaaaaacacgcacaccgcgacccagtccatagccagtacgtgcgaagcagcacgcacgctgctggtccgcgtacgcgagacgacggtcaggtcggccggtgcttttcagtttggaataatgacggcgacgacgacgacagccgccggcggcggcaaggtgcagccgcgcggcctgcccgcggcgctgtccctgctgctgctcctggtgttggcagcggggctgggcggtggcgccgaggcgcagcagacgtgcgcggggcagctgcgcgggctggccccctgcttgcgctacagcgtgccaccccttgccgggcaggttccgccggcgcccgggccggagtgctgctcggcgctgggggccgtgtccagggactgcgcctgcggaacgttcagcatcatcaacagcctgccggcccagtgcgggctcccgccagtcagctgccagtaatgacctgatgattacccgtgccatggcctgggccaaaggccagggatcccaacaccgctggaaaaataaaaggccaccgggcgtccaatccaactggttggcctcct

SEQ ID NO: 12688 - protein, 109 aa, Zea mays
  misc_feature: Ceres CLONE 1372360-F
  misc_feature (45)..(108): Pfam Name: Tryp_alpha_amyl Pfam Description: Protease inhibitor/seed storage/LTP family
MTATTTTAAGGGKVQPRGLPAALSLLLLLVLAAGLGGGAEAQQTCAGQLRGLAPCLRYSVPPLAGQVPPAPGPECCSALGAVSRDCACGTFSIINSLPAQCGLPPVSCQ

SEQ ID NO: 12689 - DNA, 617 bp, Zea mays
  misc_feature: Ceres CLONE 1372365-F
tggagctccccgcggtggcggccgctctagaactagtggatcccccgggctgcaggaattcgcacgagaccattacctagaacatcctaatcaaaaacctaaccctttggccttcgttgcggacccgctactcaccgcttctcttgaccgcatctcttctctgcgccgccgctcgcctgcacttctacgtgcgaaacgcggccgcgcctatggcctgcccgtgcccagctgccccctctccacgcgagcctctctagggggcaagcgtgccattaagcaaccgtgggccccacccctcctcggctctctgcgtgagcacaagcacgtctctgcagcccatgttcaacggaagcgaaaggaaacagggcacccatcacattcgtcatgggcaattctctcatgccgggcagcccattaattccactgaagaaaacatagaatgtgcatcataatggcacagaaggactaaaatggtatagtgtgcgaccattgctcacgaggaggcagagagacgtgttgcctagtgccactggaccacatacgattgttgatggtacagaagatgtgaactttgcatcaccaaagcacctcggcttaattggcaacgaacagattat

SEQ ID NO: 12690 - DNA, 658 bp, Zea mays
  misc_feature: Ceres CLONE 1372371-F
  misc_feature: Encodes the peptide sequence at SEQ ID NO. 12691
  misc_feature (355)..(355): n is a, c, t, g, unknown, or other
  misc_feature (379)..(379): n is a, c, t, g, unknown, or other
  misc_feature (399)..(399): n is a, c, t, g, unknown, or other
  misc_feature (421)..(421): n is a, c, t, g, unknown, or other
  misc_feature (438)..(438): n is a, c, t, g, unknown, or other
  misc_feature (508)..(508): n is a, c, t, g, unknown, or other
  misc_feature (532)..(532): n is a, c, t, g, unknown, or other
aagctggagctccccgcggtggcggccgctctagaactagtggatcccccgggctgcaggaattcgcacgagaccattacctagaacatcctaatcgaaaatccgtcctgctccttgcgtcgcgtcggcgcgcgctgcgtgtatatatatagacccgcaaatagtcccggctcagcccaacccaacccaacgacgcagctagcgcgcatctccgatctgcactgcaccttcgtctccgaagaacgtcgatcgtactcgtacaccatgaaggcagtcgtcgcggcgacgatgcttctgctgggtgctggtggccgcggcgacggtggcgagcgcagaccaccgtgatgacgacggncaccaccacccagcgcaccgcggncagagctggcacgccacagncggcggcggccgagatggccgncggtcgacccctctggncgggctgacgcagtgcgggacagctgcgggtctggggtcacctcctgcatgctggactgctaccagccgntggtcgacctggaccccggggagntgcccgtctggctcctcaagggcaccaacgaaccatgggtttgggccaccggttggcccgtcccggggaaggtaaactagttggttaaactaacccatctttatttaaattcgggggccctttaat

SEQ ID NO: 12691 - protein, 41 aa, Zea mays
  misc_feature: Ceres CLONE 1372371-F
  misc_feature (8)..(8): Xaa is any aa, unknown, or other
  misc_feature (16)..(16): Xaa is any aa, unknown, or other
MLDCYQPXVDLDPGEXPVWLLKGTNEPWVWATGWPVPGKVN

SEQ ID NO: 12692 - DNA, 841 bp, Zea mays
  misc_feature: Ceres CLONE 1372380-R
tggttgttacgtggatttgtcgtaagacgttgatacgcacgggctaccgattagtattgatcatgtatcggctctccaggagccctccggtgttatggatccagcggtgtctgctaactacgttgcggacattccattctctcatacatggtgcggaaaagccacggatacggccccgtgggtcatccatacatagagtgctgcgaaaaaattttgacccaagcagccccactgtgtaaaggactactacctagctggtggtccaccctcacaaacacaaactgcacacgtggtcctgcacctccccatgctcgacatctagatccgcactccctctagcaagtcccatgtgtctgtctctatctctgctttgactgtgtctaacttttactgtaccgtatatgacactctcagcgtattacaactgcgattgagctccaagcaatgagatttccaggtttaatccagagcatttgctgagcatacttcctggaaggtttcttgcagctaaggatctcctgctctttgaggcggtgctcaaaccgtgccgagcgtcattttatgctcaccatacctgcagccttgcgcgaccgcggaaaactcagttgtatcacgtatttcgtgaataagatgactggctgatcaacctccgcaaaaaagtcatctccttcccacaaagtctcaatacctgggcgcgatctacgtgcggtgtaacgcaaatgaagtgctcctgcttcataaagccctgctttcaatgtcggacatacctccgcggaaacttcccttttcagaatagccctccaccacgctggaaacaaaatgccttgttcttttgttgggg

SEQ ID NO: 12693 - DNA, 658 bp, Zea mays
  misc_feature: Ceres CLONE 1372381-F
  misc_feature (232)..(232): n is a, c, t, g, unknown, or other
  misc_feature (236)..(236): n is a, c, t, g, unknown, or other
  misc_feature (241)..(241): n is a, c, t, g, unknown, or other
  misc_feature (249)..(249): n is a, c, t, g, unknown, or other
  misc_feature (259)..(259): n is a, c, t, g, unknown, or other
  misc_feature (273)..(273): n is a, c, t, g, unknown, or other
aaagctggagctccccgcggtggcggccgctctagaactagtggatcccccgggctgcaggaattcgcacgagaccattacctagaacatcctaatctcaaaaacaacaacaacaaccatctccaacgcagcaagcagacacagggacaggcaggcagcgagtgcaaccgcgagagcgatcagcgatgggctccttcttctcgaccttagtgacgcccccctccgcccgcgncgangaccngaactgcngcgtggtggncgcgcactccaggnccactacgacgagagtgggcgccccacagacaccacaagctgagggggaccaatttccccgggccggtgggggcccctgcctttattaaaacggctctaagaggggggccccccttttccggggccttttttaagggggccccccaaacccccggggcccaaaaattagaagaaaaaccgcccccccctcttccctaaaaaaaaaaaaaaaacccccctttttttaaaaaaaaagggggggggggaaaggtggggggccccccccccccccccccaaaaaaagagaacacccccccctctttttttttttttttgggggggggggggggggggggggtgctccccccctcctcccaaaaaaaaaaaaaaaagaaaaaaggggggg

SEQ ID NO: 12694 - DNA, 645 bp, Zea mays
  misc_feature: Ceres CLONE 1372386-F
aagctggagctccccgcggtggcggccgctctagaactagtggatcccccgggctgcaggaattcgcacgagaccattacctagaacatcctaatcgaaaaacagactccagtctcctctaggcgactcgcgcgcttcaccttccccaccccggcgtcgccatcgtacgcccgcagccgcatccgctatgggtgcgtacaagtacgtctcggagctatggcggacgaagcaagacgatgtgatgctcctcccgcaacgaatgcgctgttgatagtacagggagcatgcggtcatcgagcgtctcataaggcccactcgccctgacaaggtgcgccgtctcggctacaaggccaggcagggctatgctgcttaccgggcccgcgctacgcgtagtgccagaaagaggcctgggcctaaagggattgtctatgctcagccatagtaccatggtatcacccagctcaagtcccagaggaacaagaggtctggtgctgaggacagggctggactaaagcttggtggactcagggttctcaactcctactgggtgaatgaggatagcacctacgagtactttgatatcgttcttgctgatgaggcccacagtaccatccgacatgatccaaggatccactgactatgcaa

SEQ ID NO: 12695 - DNA, 638 bp, Zea mays
  misc_feature: Ceres CLONE 1372393-F
  misc_feature: Encodes the peptide sequence at SEQ ID NO. 12696
aaagctggagctccccgcggtggcggccgctctagaactagtggatcccccgggctgcaggaattcgcacgagaccattacctagaacatcctaatcgaaaaactcccagaggctcttctcctcctcgcctcctctccctagcctccacgacgcaagggagagtgacggaaagcgacgcggcgcgagcgaggagggccaagggagaagaggggaagcaccgcaccaggacccttgttcgccgccgccgcctctgatctccgcgaggttgtcaggattcaatatgtcgaccagcacattcgctacttcctgcacggtggtgggcaatgttagaacaacgcaggcctcccagacagcggagaagagcccttcgtctctaagcttcttcagccaagttacgaaggttccaagcctgaagacctccaagaaactggatgtctccgccatggctgtatacaaggagaagcttggcggtgctgaaggagaacagcacgagtatgatgctccagacgacgcctacatccttgacgcaggcgagactgccggtgtggagttgccatactcgtgccgtgctggggcttgctccacctgtgccggcaaaatcgagtctggttcggatgaccagtcggatgggtccttc

SEQ ID NO: 12696 - protein, 119 aa, Zea mays
  misc_feature: Ceres CLONE 1372393-F
  misc_feature (63)..(116): Pfam Name: Fer2 Pfam Description: 2Fe-2S iron-sulfur cluster binding domain
MSTSTFATSCTVVGNVRTTQASQTAEKSPSSLSFFSQVTKVPSLKTSKKLDVSAMAVYKEKLGGAEGEQHEYDAPDDAYILDAGETAGVELPYSCRAGACSTCAGKIESGSDDQSDGSF

SEQ ID NO: 12697 - DNA, 636 bp, Zea mays
  misc_feature: Ceres CLONE 1372394-F
  misc_feature: Translation starting site: 310
aagctggagctccccgcggtggcggccgctctagaactagtggatcccccgggctgcaggaattcgcacgagaccattacctagaacatcctaatcgaaaaattctgcagtatggctcgccgactctgacggctccctcgcctctttcccctcgcctcgtctgcatgcgcctccgccgccccaagacctcatcacctccccttcgccgtgaaccctaaccccgcgaccctcgccccctccttctcgacaacatcgacgcccgcttttccgggaccccatcgcctcttctcttccacgagaggatcaagcatggtggtagtggactccgcggactccttcaacagcatcttttccaaggtgcaagatgaaaatctaccacgatgtttttactacacagtggcgtggtgaggaccatgtagggcgatcgcacctttatgatcagagctgagaagccagcatcatcaagataccggtgtacaaagatgatattgaattggaatgactggaaaaccaactccgtgatctaaagatatgttcagtgtcgatgctccacttctatcacaagggggagagaattattgaaatcgtgagtgctgatgcagacaaaattgaagctaccatgtaaagtctccacaa

SEQ ID NO: 12698 - DNA, 647 bp, Zea mays
  misc_feature: Ceres CLONE 1372401-F
gctctagaactagtggatcccccgggctgcaggaattcgcacgagaccattacctagaacatcctaatcgaaaaatcaccaccaccccgcgggtgctggtcaccagctccgcacctcgccagagggagctaccacaccggccgccgtggatcccgtcagccgtctctccccgctgaggagcgtctccagggcgacccggtgcccgtcctgatggatgacgcgcggccagcacatctccgaggacgacgactgcgagcccccgttcctgcagctcaaggtccatagtgagcaccggtgcgtcatctaccgcatcgacgacaagaagaatatggcgggttctggatcaggggggtaaggccgggctcgtatacgagggattgtgagtgcgccttggcagtcaacgatggaaggggcccccgtcttgcgactaaaacttgctctccctgaggcacaaggtgaccctggaaatcgggaatctgcctcttggacggggccctcctgaccccgccccggcgcggcgggggctcggaggctccttacccccccccctctccaagagggtccctccggcaaggatgggacccccgctttccggagggggtctgtctagtttaagccgtccttctggcccaaatattttttgcttt

SEQ ID NO: 12699 - DNA, 644 bp, Zea mays
  misc_feature: Ceres CLONE 1372407-F
  misc_feature: Encodes the peptide sequence at SEQ ID NO. 12700
  misc_feature (342)..(342): n is a, c, t, g, unknown, or other
  misc_feature (361)..(361): n is a, c, t, g, unknown, or other
  misc_feature (393)..(393): n is a, c, t, g, unknown, or other
  misc_feature (404)..(404): n is a, c, t, g, unknown, or other
  misc_feature (405)..(405): n is a, c, t, g, unknown, or other
aagctggagctccccgcggtggcggccgctctagaactagtggatcccccgggctgcaggaattcgcacgagaccattacctagaacatcctaatcgaaaaagatcagatcacactcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactaacagggctccaccttnccacgcgtcatccccgagntcatgtgccagggcggggacttcacccgcggnaacgggaccgnnggggagtccatctacggggagaaagtccccgacaaaaagttcggtgcgcaggaacccggtcccggggggggtctcaatgggccaaggcggggccaaaaacaaaggggtcccagtttttaatttggaccggtggaacccctttggtttaagggaaaaaacctttccttttccgacaagttcccagggggagtgggccccttccaggggccctcaaagagggggggcccccccccccgccc

SEQ ID NO: 12700 - protein, 54 aa, Zea mays
  misc_feature: Ceres CLONE 1372407-F
  misc_feature: SWISSPROT Homolog: EC 5.2.1.8 Peptidylprolyl isomerase
MANPRVFFDMTVGGAPAGRIVMELYANEVPKTAENFRALCTGEKGVGKSGKPLH

SEQ ID NO: 12701 - DNA, 370 bp, Zea mays
  misc_feature: Ceres CLONE 1372413-F
  misc_feature: Encodes the peptide sequence at SEQ ID NO. 12702
  misc_feature (264)..(264): n is a, c, t, g, unknown, or other
  misc_feature (276)..(276): n is a, c, t, g, unknown, or other
  misc_feature (306)..(306): n is a, c, t, g, unknown, or other
  misc_feature (307)..(307): n is a, c, t, g, unknown, or other
aagctggagctccccgcggtggcggccgctctagaactagtggatcccccgggctgcaggaattcgcacgagaccattacctagaacatcctaatcgaaaacacccgcttcccccagccgcacgaaaccctaacgccgccgccgcttcacaggtaagccgccgtcatggtctccggttccggcgtatgcgcgaagcgcatcgtggtggacgcgcgccaccacatgctgggccgcctgtcgtcgattatcgccaaggaactgctncatgggcagaanggtggtcgtcgtcccgcttgcgaggagatnnctgtatgtcgggtgggacttcgtacgcccagaagaatgaaagtacctcccgcttttcctccgg

SEQ ID NO: 12702 - protein, 68 aa, Zea mays
  misc_feature: Ceres CLONE 1372413-F
  misc_feature (37)..(37): Xaa is any aa, unknown, or other
  misc_feature (47)..(47): Xaa is any aa, unknown, or other
  misc_feature (48)..(48): Xaa is any aa, unknown, or other
MVSGSGVCAKRIVVDARHHMLGRLSSIIAKELLHGQXGGRRPACEEXXVCRVGLRTPRRMKVPPAFPP

SEQ ID NO: 12703 - DNA, 647 bp, Zea mays
  misc_feature: Ceres CLONE 1372432-F
  misc_feature: Pfam Name: PAS Pfam Description: PAS fold
  misc_feature (448)..(448): n is a, c, t, g, unknown, or other
  misc_feature (459)..(459): n is a, c, t, g, unknown, or other
  misc_feature (474)..(474): n is a, c, t, g, unknown, or other
aagctggagctccccgcggtggcggccgctctagaactagtggatcccccgggctgcaggaattcgcacgagaccattacctagaacatcctaatcaaaagcacccttctccgaccacaaccctaccagcgtgccccggcatgggctagggttcccgcggtgatggagtgggatagtgattctgacggcagaggaggaggaagaggtctccccccggagcggggacgcggaagcgggcccggggttcgcgctggctatcgagggcgtgctgggcgcctgcggcatggtcgtctccgacgcgctcgagcccgacttccccaatccccatcatctacgtcaaccgcgggttcgaggacgccaccggataccgcgcggaggaggtgctcgggaggaactgccccggttctacatgcagaggactatttgctcagaggagacatccccttgntgatgcatcangtattactgggattncggagatgtttagaggaagggactgagtttcagggtgatctggtgaattttagaaagaatgttctcaatacatggcagggctgccaatacacccatatatggggtggtgagataataacccccttttggggccttcagtttttcagggttctaagggtaacttggggtccccc

SEQ ID NO: 12704 - DNA, 639 bp, Zea mays
  misc_feature: Ceres CLONE 1372435-F
  misc_feature: Encodes the peptide sequence at SEQ ID NO. 12705
  misc_feature (438)..(438): n is a, c, t, g, unknown, or other
  misc_feature (456)..(456): n is a, c, t, g, unknown, or other
  misc_feature (458)..(458): n is a, c, t, g, unknown, or other
gctggagctccccgcggtggcggccgctctagaactagtggatcccccgggctgcaggaattcgcacgagaccattacctagaacatcctaatcaaaacagctgaaagcagccaaaacgcagaagctgcactgcatacatcgagctaactatctgcagcgatgtctcgctcctgctgcgtcgccgtgtcggtgcttctcgctgtcgccgcgacagccagcgccaccgcgccggcatggctgcacgaggaggccatggccacgggcccgctggtcgcagagggtgcaagggtggcgccctccgcgtccacctgggctgccgacaaggcgtcgccggcgaggccgagcggcggcatggccacgcatggcgacgaccagagctcgtcgggcggcagtggcagcagcggtgagcacggcaaggagggaggcgagaagcaggncaagagctgcctcaccangnaggagtgccacagaaagagatgatctgcgggcagggctgcacgcttctcgcgcacagcaggtgcgccgccaagtgcaccaagtcctggggcccccacctgctaagacccaaggcccggactttgcggggggaaaaacctcaatcgaacgaagggctccacttccctccttggaaaagagct

SEQ ID NO: 12705 - protein, 106 aa, Zea mays
  misc_feature: Ceres CLONE 1372435-F
  misc_feature (93)..(93): Xaa is any aa, unknown, or other
  misc_feature (99)..(99): Xaa is any aa, unknown, or other
  misc_feature (100)..(100): Xaa is any aa, unknown, or other
MSRSCCVAVSVLLAVAATASATAPAWLHEEAMATGPLVAEGARVAPSASTWAADKASPARPSGGMATHGDDQSSSGGSGSSGEHGKEGGEKQXKSCLTXXECHRKR

SEQ ID NO: 12706 - DNA, 650 bp, Zea mays
  misc_feature: Ceres CLONE 1372438-F
  misc_feature: Encodes the peptide sequence at SEQ ID NO. 12707
aagctggagctccccgcggtggcggccgctctagaactagtggatcccccgggctgcaggaattcgcacgagaccattacctagaacatcctaatcgaaaaactacacacaaacaccctatggcgccagaaaggatgctcctcgacgcctgtgccgcgatgatggtggccggcgacaccaacgcggcggacggccaggtggcgtcggtcgccgccgacctggcgaggggcgccgacggcaccaccaacaacatgaaggatgaggccggattcaaggtgcttccagtggcgatcgagtgcaagaacagcaacgacgagtacgatactgaggccgtgagtgagatccaaagctccggagccttcagcgtcccactcgccgacgacctccacggtgccgactgccacgcgcagctccacagcgccggcaataacgcgccttggcctgggcaggagccgcccaggatcgcgcccatgaacaggaggtaccttcgacggcgtgcctggcaagatgcactacccgcccgcgcagcgagcaaccgcgtttctctgctccccgatctagaagcacttgttagatcacttccacaaggcactcgctgccggtgcctggactaccacccggtgcctgaccacagcaagccttcgatgacg

SEQ ID NO: 12707 - protein, 177 aa, Zea mays
  misc_feature: Ceres CLONE 1372438-F
  misc_feature (34)..(174): Pfam Name: DUF1210 Pfam Description: Protein of unknown function (DUF1210)
MAPERMLLDACAAMMVAGDTNAADGQVASVAADLARGADGTTNNMKDEAGFKVLPVAIECKNSNDEYDTEAVSEIQSSGAFSVPLADDLHGADCHAQLHSAGNNAPWPGQEPPRIAPMNRRYLRRRAWQDALPARAASNRVSLLPDLEALVRSLPQGTRCRCLDYHPVPDHSKPSMT

SEQ ID NO: 12708 - DNA, 641 bp, Zea mays
  misc_feature: Ceres CLONE 1372446-F
  misc_feature: Encodes the peptide sequence at SEQ ID NO. 12709
aaagctggagctccccgcggtggcggccgctctagaactagtggatcccccgggctgcaggaattcgcacgagaccattacctagaacatcctaatcgaaaaaaaacttctcctcttgaggaaggcagcccgagcgagcgcgctgcaatggcggactcgtcggcgccgacgagagtgatgatggcggtgaacgagtcgtcgctcaaggggtacccgcacccctccatcagctgtcgcaccgccttcgactggacgctctccaagctcgtccgctccaaccctgggggcttccacttcctcttcgtccacgttcatgtccccgacgaggacggatttgatgacatggatagcatctatgcttcgccggaggactttcaccaaatgaagcagagagacaagataagagggcttcatttgctcgagtactttgtaaaccaatgccatcagttagggataaaatgcgaggcatggatcagacatggagatccaaaggaggttatctgcagcgaagtgaagagagtccagcctgaccttctagttgtgggaaagtaggggtcttgggccatttcagaggaggacaagcctggtgcaatggtgagagctatctcgctgagtcaccggggtcgtgggttcgaggcaga

SEQ ID NO: 12709 - protein, 134 aa, Zea mays
  misc_feature: Ceres CLONE 1372446-F
MADSSAPTRVMMAVNESSLKGYPHPSISCRTAFDWTLSKLVRSNPGGFHFLFVHVHVPDEDGFDDMDSIYASPEDFHQMKQRDKIRGLHLLEYFVNQCHQLGIKCEAWIRHGDPKEVICSEVKRVQPDLLVVGK

SEQ ID NO: 12710 - DNA, 625 bp, Zea mays
  misc_feature: Ceres CLONE 1372447-F
  misc_feature: Encodes the peptide sequence at SEQ ID NO. 12711
  misc_feature (392)..(392): n is a, c, t, g, unknown, or other
  misc_feature (393)..(393): n is a, c, t, g, unknown, or other
tggagctccccgcggtggcggccgctctagaactagtggatcccccgggctgcaggaattcgcacgagaccattacctagaacatcctaatcgaaaagcaactaccccgataccattcccaaatcctccgtcgacccctctacaccggcgatcggcggcgaacgatggggtgggcgacgcggttcctggcggcggtgtgcttctttgctgcgggcgtcctcttcgtcccagaggctatcggttccccatccggcgcaggagccgtcaccgccgccaagctggcccacgtcctctcctttgccacctcctggggcgccgccctctgggccaccttcatcggcggcatcataatgttcaagaacctgccgaggcacatgttcggcaacttgcannagcagatgttccccgcctacttcacgcttatatctgcatgcgcagccatctccggcgccggcttcggggaccttcacccggggaaaacggcgtccactggtgagggctaccagttgggatccctctttccggggttgggtgaaaccctcccaacttttaagtttccctcccggccccccgggggtggaaaaagggccaaattcggggggcccctggtttccggggaaaaata

SEQ ID NO: 12711 - protein, 153 aa, Zea mays
  misc_feature: Ceres CLONE 1372447-F
  misc_feature (76)..(76): Xaa is any aa, unknown, or other
  misc_feature (77)..(77): Xaa is any aa, unknown, or other
MGWATRFLAAVCFFAAGVLFVPEAIGSPSGAGAVTAAKLAHVLSFATSWGAALWATFIGGIIMFKNLPRHMFGNLXXQMFPAYFTLISACAAISGAGFGDLHPGKTASTGEGYQLGSLFPGLGETLPTFKFPSRPPGGGKRAKFGGPLVSGEK

SEQ ID NO: 12712 - DNA, 651 bp, Zea mays
  misc_feature: Ceres CLONE 1372449-F
  misc_feature: Translation starting site: 170
  misc_feature: Pfam Name: Prefoldin_2 Pfam Description: Prefoldin subunit
  misc_feature (371)..(371): n is a, c, t, g, unknown, or other
  misc_feature (414)..(414): n is a, c, t, g, unknown, or other
  misc_feature (415)..(415): n is a, c, t, g, unknown, or other
  misc_feature (420)..(420): n is a, c, t, g, unknown, or other
  misc_feature (531)..(531): n is a, c, t, g, unknown, or other
aaagctggagctccccgcggtggcggccgctctagaactagtggatcccccgggctgcaggaattcgcacgagaccattacctagaacatcctaatcgaaaaatctacgttctactcccactcgcggtcgcggtagccggcggcggcggcggaggaaagcaggcaggccatggcgtcgtcgtcgtcgtcgaccccggcggccgtccgcgagatgcagaaggatctcgaggtccaggccaacgccctcagcaagatccagaaagacatcgccaagaaccaccaggtccgcaagcagtacaccatccaggtcggcgagaacgagctcgtcctcaaggagctggagctgctcagcgatggggccaacgtgtacnagctcatcggaccggtgctggtcaagcaggacctcgctgaggnncaggncacgtcaagaagcgcatcgagtacatctccgcaaagctgaagcggatggattcggcgctcaaagacttggagggaaagcaaaacggcagagggatcgattttcaagtgcancaaaagatgcaggctgaacagctaggcttaacaattggttggttgtttgcactagcccaagggcatggttcttttttcccatttccccccaggtttttttttggggggggaaatcggggg

SEQ ID NO: 12713 - DNA, 631 bp, Zea mays
  misc_feature: Ceres CLONE 1372451-F
  misc_feature: Encodes the peptide sequence at SEQ ID NO. 12714
  misc_feature (631)..(631): n is a, c, t, g, unknown, or other
tggagctccccgcggtggcggccgctctagaactagtggatcccccgggctgcaggaattcgcacgagaccattacctagaacatcctaatcgaaaactgggtcaccgagggtgtgttccctgtctgcaatttcgggcaaggctaggggcccaagcggaaaaggtaagccgactccggcggcggcggcggagatcatggccgcgcagagggagaagtccgcggtcgtggtggtcgccccagaacacggcgccgcggattcggggtctccttctccttcttcctcatacggaggaccggcagtgtcggcgtcctcgtcgggagaccggtggtgcgccgcgatcggtaaccttgaggagctcggcgccaacgtggacgcgctgcagaagctgctcgggcggaaagccgacttcgtagacgatgacatcttctccaaggcctccctcgccgccgatcaggcccgcaccattaaggttcttgaccagagggtgcagtctctggaacgtgaactccatgctgccatttcagcagctgctctagctcgtgtagagaaacgtcaggcgcaagctgcgcaacgagctgcatagttacgcacacgggaggtcacataagaactgcagaacactgctagtn

SEQ ID NO: 12714 - protein, 129 aa, Zea mays
  misc_feature: Ceres CLONE 1372451-F
MAAQREKSAVVVVAPEHGAADSGSPSPSSSYGGPAVSASSSGDRWCAAIGNLEELGANVDALQKLLGRKADFVDDDIFSKASLAADQARTIKVLDQRVQSLERELHAAISAAALARVEKRQAQAAQRAA

SEQ ID NO: 12715 - DNA, 624 bp, Zea mays
  misc_feature: Ceres CLONE 1372455-F
  misc_feature: Encodes the peptide sequence at SEQ ID NO. 12716
tggagctccccgcggtggcggccgctctagaactagtggatcccccgggctgcaggaattcgcacgagaccattacctagaacatcctaatcgaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatggggaacgccatcgagggcatgaacggcaaggagctggacggtcgcaacatcaccgtcaacgaggcccagtcccgcggcggccgtggaggcgtcggcggtggctacagtggtggccgtgtaggcggcggctacggcggtggcggatgccgtgatggcggcggcggctacggtggtggcggcggcggctacggtgacggcggcggctacggtggtggtggcggcggctacggaggtggcaacga

SEQ ID NO: 12716 - protein, 142 aa, Zea mays
  misc_feature: Ceres CLONE 1372455-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMGNAIEGMNGKELDGRNITVNEAQSRGGRGGVGGGYSGGRVGGGYGGGGCRDGGGGYGGGGGGYGDGGGYGGGGGGYGGGN

SEQ ID NO: 12717 - DNA, 739 bp, Zea mays
  misc_feature: Ceres CLONE 1372459-F
  misc_feature: Encodes the peptide sequence at SEQ ID NO. 12718
  misc_feature (627)..(627): n is a, c, t, g, unknown, or other
  misc_feature (646)..(646): n is a, c, t, g, unknown, or other
  misc_feature (662)..(662): n is a, c, t, g, unknown, or other
  misc_feature (672)..(672): n is a, c, t, g, unknown, or other
  misc_feature (695)..(695): n is a, c, t, g, unknown, or other
ggagctccccgcggtggcggccgctctagaactagtggatcccccgggctgcaggaattcgcacgagaccattacctagaacatcctaatcaaaagaaaacacaccatctccacctcgccgccgccgctcggatttccctctacctcaccctgtccgccgtcaaggagcagcaaggccaaggccgccgcggcgtcggcggccgtggtcgtggacgacatagccgagctgcaggggatgctagagcgcctgcggctggagaaggagaaggcggaggagatggttagggagcgggatgaggtcatccggaagaaggaggaggagatcgagaccagagacaaggagcaggagcgtctccaggccgagctcaggaaggcgcaacgcgccaaggagttcaagcctaccgtgagcttccccctcgtcaagtcgttgctggagaaagagcaagaagcagacgacaagggaaagaagaagaaggggaagggcggccacgagaggaagaagccgtgcccggcgtacgtgctctggctcaaggaccagtggaccgaggtcaagaaggagaaccctgaggccgacttcaaggaggtgtccaacacgctgggcgccaagtggaaggctctgggcgccgnagagaagcagccctatgangatcgataccgccagnagaaggaggnctacccctgcagtgttggccagnagaagcgcgaggccgaagcgatgaagcttctcgaggagcagcaa

SEQ ID NO: 12718 - protein, 168 aa, Zea mays
  misc_feature: Ceres CLONE 1372459-F
  misc_feature (88)..(155): Pfam Name: HMG_box Pfam Description: HMG (high mobility group) box
  misc_feature (131)..(131): Xaa is any aa, unknown, or other
  misc_feature (137)..(137): Xaa is any aa, unknown, or other
  misc_feature (143)..(143): Xaa is any aa, unknown, or other
  misc_feature (146)..(146): Xaa is any aa, unknown, or other
  misc_feature (154)..(154): Xaa is any aa, unknown, or other
MLERLRLEKEKAEEMVRERDEVIRKKEEEIETRDKEQERLQAELRKAQRAKEFKPTVSFPLVKSLLEKEQEADDKGKKKKGKGGHERKKPCPAYVLWLKDQWTEVKKENPEADFKEVSNTLGAKWKALGAXEKQPYXDRYRQXKEXYPCSVGQXKREAEAMKLLEEQQ

SEQ ID NO: 12719 - DNA, 703 bp, Zea mays
  misc_feature: Ceres CLONE 1372460-F
  misc_feature: Encodes the peptide sequence at SEQ ID NO. 12720
tccccgcggtggcggccgctctagaactagtggatcccccgggctgcaggaattcgcacgagaccattacctagaacatcctaatcgaaaaaatgccactgtgagtctgtgaccacaccaaacgccggcggagtcgtcagtcgtgcgtgcccgtcccgttctgcccccacctcccctcccccgactccctcactcttcctcttccgttccatttcaagatccctgcagccgtccgtccatccatccatccatccatccgttaagaggagaggggaagccggccggccggccggccggtggagcggagatgagggggcagacagagacaggccggtggcgaggaggcgacggagctgcggcgtggtgggtggccgtggtggacctgcagctgggccattcactgagccgcgcgcggtcggagctgctggagtccaacccgggcctggcctacaacttctaccagagcagctgccccagcgcggagtccatcgtccgcagcgtcacctgggcgcatgtcgccgccgaccccgcgttcccggtccgtctcctccgtctccacttcaatgactgcttcggcaagggttgggacgcgtcgatcctgctggacaacgcttaaagcgagaatacggcggtaccgaacctgtcgtgtgatgagaactatgagatcgactgcatcaccgggataggggacaacgtagggccg

SEQ ID NO: 12720 - protein, 102 aa, Zea mays
  misc_feature: Ceres CLONE 1372460-F
  misc_feature: SWISSPROT Homolog: EC 1.11.1.7 Peroxidase
MRGQTETGRWRGGDGAAAWWVAVVDLQLGHSLSRARSELLESNPGLAYNFYQSSCPSAESIVRSVTWAHVAADPAFPVRLLRLHFNDCFGKGWDASILLDNA

SEQ ID NO: 12721 - DNA, 727 bp, Zea mays
  misc_feature: Ceres CLONE 1372465-F
  misc_feature: Translation starting site: 165
  misc_feature: Pfam Name: GATase Pfam Description: Glutamine amidotransferase class-I
  misc_feature: SWISSPROT Homolog: EC 4.1.3.27 Anthranilate synthase
  misc_feature (370)..(370): n is a, c, t, g, unknown, or other
  misc_feature (383)..(383): n is a, c, t, g, unknown, or other
  misc_feature (391)..(391): n is a, c, t, g, unknown, or other
  misc_feature (487)..(487): n is a, c, t, g, unknown, or other
tccccgcggtggcggccgctctagaactagtggatcccccgggctgcaggaattcgcacgagaccattacctagaacatcctaatcgaaaaaaaaacctcgcccactctacaaacacgtgacacctccacccaccctcgccccctccctaccggcaccgcccagatggcctgctcccacatcgtcgccgccgcgggggtctcctcccccgccgcagcggcggctcgttccccggcgcattctcccgcttccgccttcgcgcgcctccggtcgacgcctcgtttcgcgagcgctggcttgtcggttaagggaaacggagcggcgttcccgttggtcgccgccgcggggccggccgcggcggcaccggtggncgacctggacggncgcccggncacggagaagcagcccatcatcgtcatcgacaactacgacagcttcacatacaacctctggcagtatatgggggagcttggattgaacttcgaagnaacggcaatgagtgactgacccataaagatggggaaaggaagaacccaaggggaaatactattttctccagacctggtggaacccaagaatcgggaaaacattggaaaatgtttcttgattaaggcccaccatccccatttttggagtttgcatgggccccgcaagcttgggaaaggcattggaggaaaaaatcccggcctcctttggggggggggcggggaaaaccccccccttttatt

SEQ ID NO: 12722 - DNA, 726 bp, Zea mays
  misc_feature: Ceres CLONE 1372468-F
  misc_feature: Translation starting site: 466
  misc_feature (522)..(522): n is a, c, t, g, unknown, or other
  misc_feature (523)..(523): n is a, c, t, g, unknown, or other
  misc_feature (601)..(601): n is a, c, t, g, unknown, or other
  misc_feature (607)..(607): n is a, c, t, g, unknown, or other
  misc_feature (608)..(608): n is a, c, t, g, unknown, or other
  misc_feature (660)..(660): n is a, c, t, g, unknown, or other
  misc_feature (707)..(707): n is a, c, t, g, unknown, or other
  misc_feature (708)..(708): n is a, c, t, g, unknown, or other
aagctggagctccccgcggtggcggccgctctagaactagtggatcccccgggctgcaggaattcgcacgagaccattacctagaacatcctaatcgaaaacaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgcccacagccgcatccaagcccgtggcagctgcagggaacctgcggcgnntgcagcaccccgatcctggggcagtgcgtcgagttcctgaggcatcagtgcagcccgacggcgacgccctactgctcngctcanntgcagtcgttgcggcagcagtgttgcagcagctcaggcaggtggagccgcancaccggtaacaggcgatcttcgggtgggccctccagccatcctggannaaaagcccgaaggggccc

SEQ ID NO: 12723 - DNA, 641 bp, Zea mays
  misc_feature: Ceres CLONE 1372471-F
gctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggccaccgactcctcctcctcctcctcctcctcgccggcggcggcgccgctgtcctccatcgggcgctccatccgctcgctccgccgtgaccagaaacaggatcccactctttcccgccggcggcagacggcacagaagccttccagggccggggccgcccaactcttgggcgaactcccggaaggcggagacgtcctctccctcgcccgggacggggccccctcctcgaatccttcctccttcggccccgagggaggtccggggccctggttcttcgggtccgggggaatcggccggttgggtcgggcccccgttcgaacggccttgtgggccgaatttttcccgaaggggggcgggaaaggggggtttcaaccccttggaaag

SEQ ID NO: 12724 - DNA, 678 bp, Zea mays
  misc_feature: Ceres CLONE 1372472-F
  misc_feature: Encodes the peptide sequence at SEQ ID NO. 12725
tggagctccccgcggtggcggccgctctagaactagtggatcccccgggctgcaggaattcgcacgagaccattacctagaacatcctaatcgaaaaaacaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgttttcaacaaatcgccaagcccctatcttttggtgcagtcatttggtacaaaccatccagggcacagcaggctgcagccaactcgttgctaccctgtgatcaaccaaggtagctctgggcaaacctttctccctactctcagcaaacaacattttcttccattcaacccaatggtctacattggaccgtgctgcttatttgcagcaacacttattacatttcagccgctaggtactgcctactctcagaaaaacaacttcttccatttaacaattgggcggactgaccccgctgtta

SEQ ID NO: 12725 - protein, 104 aa, Zea mays
  misc_feature: Ceres CLONE 1372472-F
MATKIFSLLMLLALSACVANATIFPQCSQAPIASLLPPYLPSMIASVCENPALQPYRLQQAIAASNIPLSPLFSTNRQAPIFWCSHLVQTIQGTAGCSQLVATL

SEQ ID NO: 12726 - DNA, 699 bp, Zea mays
  misc_feature: Ceres CLONE 1372473-F
  misc_feature: Encodes the peptide sequence at SEQ ID NO. 12727
  misc_feature (597)..(597): n is a, c, t, g, unknown, or other
  misc_feature (651)..(651): n is a, c, t, g, unknown, or other
  misc_feature (663)..(663): n is a, c, t, g, unknown, or other
tccccgcggtggcggccgctctagaactagtggatcccccgggctgcaggaattcgcacgagaccattacctagaacatcctaatcgaaaaccattttctctcctctctccgtcgccgcctcgggccaaaccctacgcagggagttgattgatcgattgcagccatgagtaagttgcattccgagcttctcaaggattgcatctcccagatagttcaggatgccaagaagaataggaagttcactgagactgttgagcttcagattagtctgaagaattatgatccacaaaaggacaagcgtttcagtggctctgttaagttgcctcacatccctcgtccaaagatgaaggtgtgcatgcttggtgatgcccagcacgttgaggaggctgagaagatgggacttgactacatggatgttgaggccctcaagaaaatgaacaagaacaagaagcttgttaagaagcttgccaagaagtaccatgcttttttggcatcagagaccatcatcaagcaaattcccccgtctccttggtcctggtctcacaagggcagcaagttccccactctggtcactcaccaggatccctggaatcaangtgaatgaaacgaggctacagtcaagtttcactggagaaagtcttttgcatggntgtcccggccgnaacctgtctatggaggaaaacagatccaacggaact

SEQ ID NO: 12727 - protein, 146 aa, Zea mays
  misc_feature: Ceres CLONE 1372473-F
  misc_feature (9)..(143): Pfam Name: Ribosomal_L1 Pfam Description: Ribosomal protein L1p/L10e family
  misc_feature (145)..(145): Xaa is any aa, unknown, or other
MSKLHSELLKDCISQIVQDAKKNRKFTETVELQISLKNYDPQKDKRFSGSVKLPHIPRPKMKVCMLGDAQHVEEAEKMGLDYMDVEALKKMNKNKKLVKKLAKKYHAFLASETIIKQIPPSPWSWSHKGSKFPTLVTHQDPWNQXE

SEQ ID NO: 12728 - DNA, 685 bp, Zea mays
  misc_feature: Ceres CLONE 1372474-F
  misc_feature (405)..(405): n is a, c, t, g, unknown, or other
  misc_feature (406)..(406): n is a, c, t, g, unknown, or other
  misc_feature (487)..(487): n is a, c, t, g, unknown, or other
  misc_feature (685)..(685): n is a, c, t, g, unknown, or other
aaagctggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtaaacgcgcagcagcacttcgacccggtcggccacggcctgccccctanngcgttgacatccaagatccatctcgctccgatctacattcgagaaagttgtctccgacatcgattccccagtctgaatcgntgtcgacgtcttctttgggtggaccgtcgaagtcacgcgcacgcacatcccacactttgtcctccccccgcgtgcattcagcaacactgtctttcttctcggtgtcgagcacctcggggcccagggcggacccgtgaacgacgttctttcggggtgcacgatctccggtcgcagttcgatgctctcccatcaaacggn

SEQ ID NO: 12729 - DNA, 788 bp, Zea mays
  misc_feature: Ceres CLONE 1372475-F
  misc_feature: Encodes the peptide sequence at SEQ ID NO. 12730
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (20)..(20): n is a, c, t, g, unknown, or other
  misc_feature (21)..(21): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (101)..(101): n is a, c, t, g, unknown, or other
  misc_feature (128)..(128): n is a, c, t, g, unknown, or other
  misc_feature (282)..(282): n is a, c, t, g, unknown, or other
  misc_feature (788)..(788): n is a, c, t, g, unknown, or other
nnnnaaggnnnctttccttnnacctgggagaaatagaggggnnnccaaactggagctccccgcgggggggggcgcgcgttttcggtccccccgggcggggngcagttttccccacgcgaccaggaccnagaacatcctaaccgaaaaaccgcatccgaggttggaccatcgacaaaaaccctgggtctctccttcgaggcttcaacctaaaccgcggctcgcctccttcagtccatcccctcaaccccggcggccaaaagccggcgcaccgaagcggcgggncggcggcaagcggtggccatggcggagctaaagcggctgtcagagagctgggacctgacgcggatcgagcgcatcggcgcgcactcccacatccgggggctagggctggactcctccatggtagcccaccaccccgcgggagacgggggcgggcagctgcccgcgcgccgcgccgcggggctcatactccagctcatccggcagggcaagatcgccggccgcgccgttctcctcgcgggccaccccggcaccggcaagaccgcgctcgccatgggcaaccgccaagtcggctcggggcggagaacggcccatcgcctcccggcgcccgcctcggggagctcttcgtcggatcgaccccctccaaggaggggagggcggctcaacggaggggccttcccggccgggggccattcgggggggggcgcaatccaaagggagggaaaaacgggaaacacccattccaaggggcgcgaagaggccccggggcacaaactcctcggaaaccn

SEQ ID NO: 12730 - protein, 162 aa, Zea mays
  misc_feature: Ceres CLONE 1372475-F
MAELKRLSESWDLTRIERIGAHSHIRGLGLDSSMVAHHPAGDGGGQLPARRAAGLILQLIRQGKIAGRAVLLAGHPGTGKTALAMGNRQVGSGRRTAHRLPAPASGSSSSDRPPPRRGGRLNGGAFPAGGHSGGGAIQREGKTGNTHSKGREEAPGHKLLGN

SEQ ID NO: 12731 - DNA, 682 bp, Zea mays
  misc_feature: Ceres CLONE 1372484-F
  misc_feature: Encodes the peptide sequence at SEQ ID NO. 12732
  misc_feature (665)..(665): n is a, c, t, g, unknown, or other
tacccgcggtggcggccgctctagaactagtggatcccccgggctgcaggaattcgcacgagaccattacctagaacatcctaatcgaaaaaccagtctcgtcgtgtccgttcgcgatcgggcaaacctgcaaccctttcctcttcgtccccccgctatctcgttgccccaagccggagtacggagtacggcagtcgcacccccgtcgtcccgttccttgctcgccccaacttcgccgccgcatccccctcggctgctcgctcctcgtctgcccctagtgatgtctggtggtaacgcgtggtcgccgctcccttcgcacggatttgacgacgactcctgcttgctcttttttattttgctcgtgtcgtcggatcgtggcttgattgatctccgcatcccgcagatccgactccggcggcatggggagccgcgcaggcgagcctgtggcgaggaccaacagcggcggcggcagcagcagcaaggattcgggcagcttcgagtgcaacatctgtctggacctggcgcaggatcccgtggtcaccctctgcggccacctcttctgctggccatgcctctacgagtggctccacgtgcacgcgcactcccaggagtgtcccgtctgcaaggccgtcgtcgaggaggggaagctcgtccctctctacggncgtggtggcaactccac

SEQ ID NO: 12732 - protein, 87 aa, Zea mays
  misc_feature: Ceres CLONE 1372484-F
  misc_feature (28)..(68): Pfam Name: zf-C3HC4 Pfam Description: Zinc finger, C3HC4 type (RING finger)
  misc_feature: The sequence is a functional homolog of SEQ ID NO 2644 in the 10/374,780 US patent application
  misc_feature: The sequence is a functional homolog of SEQ ID NO 78 in the 11/375,241 US patent application
  misc_feature: The sequence is a functional homolog of SEQ ID NO 906 in the 10/225,066 US patent application
MGSRAGEPVARTNSGGGSSSKDSGSFECNICLDLAQDPVVTLCGHLFCWPCLYEWLHVHAHSQECPVCKAVVEEGKLVPLYGRGGNS

SEQ ID NO: 12733 - DNA, 739 bp, Zea mays
  misc_feature: Ceres CLONE 1372484-R
  misc_feature: Encodes the peptide sequence at SEQ ID NO. 12734
  misc_feature (14)..(14): n is a, c, t, g, unknown, or other
gtttttcgggccgnccgccgtctctattaaaattaatatattattaaattttttgtctttctattggtgtccgggccccccctcgaggtcgacggtatcgataagcttttttttttttttttttgcaggcaaatttcttggaagaaacatgaacatggagaatgttcaacgcaagaacacaacaaatgcacctataattttcgatagcaactttacacaatgaataccagctgccaccaattatcacaacttgtctacttatctccacgctgacatcaaactttgggagctatctaagatgcaatgatgctagaactatggtacacaccaacggatcagcaatatcgccagccttacataatttaaaatgcgatcaggctggcaattacaagcacaccaactaccagtagaagcacctttaagtacgcatcaacctgctggccttgtggtgcctggcgcgggaagccatagccatgtccatgccacccatggaaagaatggccgtatccatagggaaaccctgcagcaggcccataggccgacacctgcgggaatccatgcacctggaagctcaccaacgggaacaaccctccaatggccgccaagaaagtgtaattcccccaccgaccaccatccacaggggggggcgcccagccacccatgaaaccaggggttcctcggtggcggggaaaataattacacgaggatctgggcttccgtgggtcaaaaagaaagggcc

SEQ ID NO: 12734 - protein, 98 aa, Zea mays
  misc_feature: Ceres CLONE 1372484-R
MRSGWQLQAHQLPVEAPLSTHQPAGLVVPGAGSHSHVHATHGKNGRIHRETLQQAHRPTPAGIHAPGSSPTGTTLQWPPRKCNSPTDHHPQGGAPSHP

SEQ ID NO: 12735 - DNA, 669 bp, Zea mays
  misc_feature: Ceres CLONE 1372488-F
  misc_feature: Encodes the peptide sequence at SEQ ID NO. 12736
  misc_feature (515)..(515): n is a, c, t, g, unknown, or other
  misc_feature (549)..(549): n is a, c, t, g, unknown, or other
  misc_feature (571)..(571): n is a, c, t, g, unknown, or other
tccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgncacagcagttaccattcatgttcaacccaatggncatgacgattccacccatgttnctacagcaacccctttgtggtgctgcattctagatagaaaatattgtgttgtaccgaataaatgagtgacatgccatcgcgtgtgactcattataaca

SEQ ID NO: 12736 - protein, 150 aa, Zea mays
  misc_feature: Ceres CLONE 1372488-F
  misc_feature (122)..(122): Xaa is any aa, unknown, or other
  misc_feature (133)..(133): Xaa is any aa, unknown, or other
  misc_feature (140)..(140): Xaa is any aa, unknown, or other
MAAKMLALFALLALCASATSATHIPGHLPPVMPLGTMNPCMQYCMMQQGLASLMACPSLMLQQLLALPLQTMPVMMPQMMTPNMMSPLMMPSMMSPMVLPSMMSQMMMPQCHCDAVSQIMLXQQLPFMFNPMXMTIPPMXLQQPLCGAAF

SEQ ID NO: 12737 - DNA, 854 bp, Zea mays
  misc_feature: Ceres CLONE 1372489-F
aaaaacaacaaaaaaaaaaaaacccaccggcgcgcctctcccccccgctcccaaaactggagctccccgcggtggcggccgctctagaactagtggatcccccgggctgcaggaattcgcacgagaccattacctagaacatcctaatcgaaaaaacaaggccacatcagcagagagcccagcaactgaaaaaaccaaccatcgcgcgggcacggttgcggttgctacctcccgatcccgtcctcccgcaagccaagctctctctctccccctccccttcagcacgatcggagtccaagtccatcccatccagacccactcgacagtcgacccgatggcgccggccatctccgtcggcgccgcggcgacgctctcgtgcagctgggcgcgacccccgaaagacaagaaacggacgaccgcggaagctccgtgcccgcggccccaacccctatagctgctaccgagtgaggaggccggcgtcctggcgtcctgcgagtctggcgcagagtagtctcctctccgtccccaagaccacacgggcgaacgacaaaggtctaaaccagtcccctcatcccccccgctccacaaactacccataatcataaagtgaggaaaggtatatacatactcatccctccgcaccatctaacccaaaccgaaaaacccaccaccataagaaaacccacacagtgacctcccctcccaccactccccccccgcccccccccgacacacctcgacggacgatcactacccactacccccctccaccgcccaccaccctaaccccccagtagtagaatagtacacaagataagaaattaaaacaattaattattataagtatagtgccc

SEQ ID NO: 12738 - DNA, 668 bp, Zea mays
  misc_feature: Ceres CLONE 1372491-F
  misc_feature: Encodes the peptide sequence at SEQ ID NO. 12739
  misc_feature (389)..(389): n is a, c, t, g, unknown, or other
  misc_feature (412)..(412): n is a, c, t, g, unknown, or other
  misc_feature (413)..(413): n is a, c, t, g, unknown, or other
  misc_feature (415)..(415): n is a, c, t, g, unknown, or other
  misc_feature (416)..(416): n is a, c, t, g, unknown, or other
  misc_feature (438)..(438): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (472)..(472): n is a, c, t, g, unknown, or other
  misc_feature (507)..(507): n is a, c, t, g, unknown, or other
  misc_feature (513)..(513): n is a, c, t, g, unknown, or other
  misc_feature (627)..(627): n is a, c, t, g, unknown, or other
  misc_feature (648)..(648): n is a, c, t, g, unknown, or other
ggagctccccgcggtggcggccgctctagaactagtggatcccccgggctgcaggaattcgcacgagaccattacctagaacatcctaatcgaaaagatccacccatcgcttctcccgctcgtcctcctcctctcctcctggacagcagagcacagcacaacacaccgagaaagaacaagcagccgccaccggagctcggaaccaccatcagcagcagcacacccggtcaaccttccacacgcgcacacacacacacacatggcgtcgcagcagaggcaacagcaggcgggagcggcggcggcgtcctccgccgtgggcttcgaggactacctgccggtgatggcggagcggctgggcgaggacgggctgatgcgggagctggcgagcnggtttccggctgctgatggaccnngnngcgcggctcatcacttcgacangctccgnnngcacgcgccgctgctggggctgggncgcatgtcggacgccgacctcccgcggatgctcgncgaggncgacttcgacgcgacggcgcgctcagcgagacggagttctgcgtcctcatggtgcgcctcagccccgagctcatggacgagcccaggcgtgggtcgacgacgccgtcgaccagngggcccgctcctcttcacagntgatgatgacgacgacgatg

SEQ ID NO: 12739 - protein, 136 aa, Zea mays
  misc_feature: Ceres CLONE 1372491-F
  misc_feature (44)..(44): Xaa is any aa, unknown, or other
  misc_feature (52)..(52): Xaa is any aa, unknown, or other
  misc_feature (53)..(53): Xaa is any aa, unknown, or other
  misc_feature (60)..(60): Xaa is any aa, unknown, or other
  misc_feature (63)..(63): Xaa is any aa, unknown, or other
  misc_feature (83)..(83): Xaa is any aa, unknown, or other
  misc_feature (85)..(85): Xaa is any aa, unknown, or other
  misc_feature (123)..(123): Xaa is any aa, unknown, or other
  misc_feature (130)..(130): Xaa is any aa, unknown, or other
MASQQRQQQAGAAAASSAVGFEDYLPVMAERLGEDGLMRELASXFPAADGPXXAAHHFDXLRXHAPLLGLGRMSDADLPRMLXEXDFDATARSARRSSASSWCASAPSSWTSPGVGRRRRRPXGPLLFTXDDDDDD

SEQ ID NO: 12740 - DNA, 710 bp, Zea mays
  misc_feature: Ceres CLONE 1372494-F
ggcggccgctctagaactagtggatcccccgggctgcaggaattcgcacgagaccattacctataacatcctaatcgaaaaaggcttagggttttcgcagccgctttaatactacctcctcttccttgtggagctctttgctggtgatcctctctctctctccttccttctaccccatatgtgtaagacgagaggaatgagagctgagttaaagttcctcaagcttaggattaatcaaagatgtactgacaaccagtaaaagaagtcccatcaagctaacgagtgaaagaagccttttgatgtttcttcccatcccaaaggaatcaattcttgagaattattggattgaggctaaggaccccaactctgctatccgtaagtgtggcatatagtccacctcatcatgaacgagctgaaaactgccccttttgatccccgcgatagctgcttgccactacattgagcaaaatgacgaggtgttgcatacttgctggtggtcgccatcgtgcatggtgtggtggatatcgccggcaacattgtcaagcttgccacgcttgctggcgtgtcacttttgcagcctattcaccgacaacaaggacaagcctctatcttagtcaccgcacgaaacttttcctacgttgatgctataatcactttttcgttacgtcagattccttagatgatactctgcttctggctgcgatgcctgc

SEQ ID NO: 12741 - DNA, 736 bp, Zea mays
  misc_feature: Ceres CLONE 1372501-F
  misc_feature (678)..(678): n is a, c, t, g, unknown, or other
  misc_feature (679)..(679): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
aagctggagctccccgcggtggcggccgctctagaactagtggatcccccgggctgcaggaattcgcacgagaccattacctagaacatcctaatcgaaaaatttcctctccctccctctccccacgccactctccctactccctccctctctctctatctccctctctctagctccccatgcagcagcagcccctcctcccttggagctggcgaccagccctcccaagctccactctcaccttggcaagctctcccatggcgtctccccctcctctacggcagtaagatgtaggaccgagagatgatgatcgagccagtgatgtggtgccaaccacaagacgcagttggtggacgacctgaagaatggacttaaccagtggatactcgccgagcgagtaccctccccagcaaacactacttaagtgttaaattaaaggtactccttaggatgattggttgatggtgtgacttagcctccatccctgccaccgggatagatggtcgagtgggttactgcttccgcaggagaggaccaggaggagtagcgtggccaggcttcgccatgttactcgggttttctccgttagttatttccgctgcattaaaatttatggttattatttctgaaactccgataatgtaatccctaatggtacttcttaaatttgtggtatannaaannnnnnnnnnnnnnnnnnnnnaaaaaaaaannnnnaaaaaagcttatcgatacc

SEQ ID NO: 12742 - DNA, 742 bp, Zea mays
  misc_feature: Ceres CLONE 1372510-F
  misc_feature: Encodes the peptide sequence at SEQ ID NO. 12743
  misc_feature (619)..(619): n is a, c, t, g, unknown, or other
tggagctccaccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggccgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgaggacacgccggtgttcctgatcttcaaccccgtgctggtccccgccgcgctgcccatcgggacggccgacatgaggttcctcacgtcgggcgcgctggggctcggggggctgtcatcggtcacgtgcctccccaacacggggcggcaggggttccagcgcaccccggactacgtggcgggagcgnacccgcagaaaggcggaggccccccccgcaccgctgcccaccaaaaccgcgccaggcaagccaaggccttccccggcgccgggtgggaaggaggcccgcgacccggacgaaagtgccaggggg

SEQ ID NO: 12743 - protein, 180 aa, Zea mays
  misc_feature: Ceres CLONE 1372510-F
  misc_feature (44)..(162): Pfam Name: Oleosin Pfam Description: Oleosin
  misc_feature (140)..(140): Xaa is any aa, unknown, or other
MADRDRSGIYGGAHATYGQQQQQGGGGRPMGEQVKGMLHDKGPTASQALTVATLFPLGGLLLVLSGLALTASVVGLAEDTPVFLIFNPVLVPAALPIGTADMRFLTSGALGLGGLSSVTCLPNTGRQGFQRTPDYVAGAXPQKGGGPPRTAAHQNRARQAKAFPGAGWEGGPRPGRKCQG

SEQ ID NO: 12744 - DNA, 752 bp, Zea mays
  misc_feature: Ceres CLONE 1372516-F
  misc_feature: Encodes the peptide sequence at SEQ ID NO. 12745
  misc_feature (374)..(374): n is a, c, t, g, unknown, or other
  misc_feature (375)..(375): n is a, c, t, g, unknown, or other
  misc_feature (380)..(380): n is a, c, t, g, unknown, or other
  misc_feature (383)..(383): n is a, c, t, g, unknown, or other
  misc_feature (409)..(409): n is a, c, t, g, unknown, or other
  misc_feature (411)..(411): n is a, c, t, g, unknown, or other
  misc_feature (416)..(416): n is a, c, t, g, unknown, or other
  misc_feature (423)..(423): n is a, c, t, g, unknown, or other
  misc_feature (424)..(424): n is a, c, t, g, unknown, or other
  misc_feature (729)..(729): n is a, c, t, g, unknown, or other
ggagctccccgcggtggcggccgctctagaactagtggatcccccgggctgcaggaattcgcacgagaccattacctagaacatcctaatcgaaaactagaacgccgccgccagtcctcactcctcaccatttcccaaaccctacccatacccccgccgccgccgccgccatgccgcccaagctcgacccgtcgcaggtggtggaggtcttcgtccgggtgacgggcggcgaggtcggcgcggcgtcgtccctggcgcccaagatcggcccgctcgggctctccccgaagaagatcggcgaggacatcgccaaggagacggccaaggactggaagggcctgcgcgtcaccgtcaagctcaccgtccagaaccgnncaggncanggtctcgtcgtcccctcccgcgccgngntcgtnataaggnngctcaaggagcccgagaggggaccgaagaaggtcaagaaacatcagcacagcggaaaatcagcctccacaacgtcgtcaaaatcggcagaaccatgaggaacagttcatggccaaggaattggccggaccggtaaagaaaatctccgaaactgggttaagggtgggtgcaccccccaagggaagaccccccaggcccttccaaaagaatttttgaacgggaaggccaaaaccccccccgcttgaaaaaataacctgagggggcctctttgggggggggaaaaaaggttttttttctcgggggggnaaaaaactttttttaaaaaagga

SEQ ID NO: 12745 - protein, 116 aa, Zea mays
  misc_feature: Ceres CLONE 1372516-F
  misc_feature (12)..(71): Pfam Name: Ribosomal_L11_N Pfam Description: Ribosomal protein L11, N-terminal domain
  misc_feature (69)..(69): Xaa is any aa, unknown, or other
  misc_feature (71)..(71): Xaa is any aa, unknown, or other
  misc_feature (80)..(80): Xaa is any aa, unknown, or other
  misc_feature (81)..(81): Xaa is any aa, unknown, or other
  misc_feature (85)..(85): Xaa is any aa, unknown, or other
MPPKLDPSQVVEVFVRVTGGEVGAASSLAPKIGPLGLSPKKIGEDIAKETAKDWKGLRVTVKLTVQNRXGXGLVVPSRAXXVIRXLKEPERGPKKVKKHQHSGKSASTTSSKSAEP

SEQ ID NO: 12746 - DNA, 701 bp, Zea mays
  misc_feature: Ceres CLONE 1372517-F
  misc_feature: Encodes the peptide sequence at SEQ ID NO. 12747
cgcggtggcggccgctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggaaaaacaggtgaaggaaattgtgttgaaggctatgggacaggctataagcaaggcagtggctattgctgagatcataaagaagaggattcctggtttgcatcaagatacaataatcagttctgtcagtattactgatgtatgggagcccattgaggaaggacttgtaccattggagatgactcgtcatgtttcaatgatatcgatttccttgtcacctaaggagcataacaagaattcacctgggtatcaagctcctctacattcggatcttaagccacaaagatatctgca

SEQ ID NO: 12747 - protein, 139 aa, Zea mays
  misc_feature: Ceres CLONE 1372517-F
  misc_feature (18)..(88): Pfam Name: Alba Pfam Description: Alba
  misc_feature: SWISSPROT Homolog: EC 3.1.26.5 Ribonuclease P
MDRYQRVEKPPPEAAAIGENEIRITTQGLVRNYVTYATSLVQEKQVKEIVLKAMGQAISKAVAIAEIIKKRIPGLHQDTIISSVSITDVWEPIEEGLVPLEMTRHVSMISISLSPKEHNKNSPGYQAPLHSDLKPQRYL

SEQ ID NO: 12748 - DNA, 697 bp, Zea mays
  misc_feature: Ceres CLONE 1372519-F
  misc_feature: Translation starting site: 167
  misc_feature: Pfam Name: Aldo_ket_red Pfam Description: Aldo/keto reductase family
  misc_feature: SWISSPROT Homolog: EC 2.3.1.170 6'-deoxychalcone synthase
ccccgcggtggcggccgctctagaactagtggatcccccgggctgcaggaattcgcacgagaccattacctagaacatcctaatcgaaaaaagtcaagtcggagcccgcaggtgtcgacaccgcgcgccgggagccggaagaagggtggtgggttgactgtggaccatgagcgcgaccgggcgagccccgtgcggcctgccgcccatcctcctggtcacggtggtgcagggcccgcgggcggagcccgtccgcgccgcggagctgcgcgacatccagctcggctaccgccacttcgacacggccgggcactacgccgactaggcgcccattggggagggcgccgccgaggccgcgcgcacggctatcgtcgtctccctgcgaggacctcttcgtcacgtgcaatgcctggtgcgtcgacgcgtatcatgagaggtggctcccggtcctgcgccggattctcaccaatcaccagaaggattatgtggacttgtaattgatgcactggcgcgtgaacatgctggtggtgaggttcacggtcctcttcatgcccgaggacatctagccgttctacatgcgagacgtgagggatgtcatggcctagtgccaccgcctgggccctggccaaggacatcggcccgtgtctccttctcctgctacaacatcgagaccatggtctcctttgcaatcataccttcg

SEQ ID NO: 12749 - DNA, 611 bp, Zea mays
  misc_feature: Ceres CLONE 1372525-F
  misc_feature: Encodes the peptide sequence at SEQ ID NO. 12750
  misc_feature (374)..(374): n is a, c, t, g, unknown, or other
  misc_feature (467)..(467): n is a, c, t, g, unknown, or other
  misc_feature (611)..(611): n is a, c, t, g, unknown, or other
tctgaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacacccccgcggaagagggaatgcnagagcgaatggccccaagcggcaccaacaaactttaacccggccaaagaccgccaaccgggggggggggaacctaaattttttcccccttccngaaaaaggaaaaaaaggcccttttccaaatgtggctctgggccccccccccaaggggcccccccctggggggagaaacccccccaaaatatttttttggggggggtggggcgcccccccccccccccgattatatttttctttn

SEQ ID NO: 12750 - protein, 75 aa, Zea mays
  misc_feature: Ceres CLONE 1372525-F
  misc_feature (64)..(64): Xaa is any aa, unknown, or other
MGKGSVGASWWAFLLLAGVLLVVAATAGAEDGVVERDRKEDLRWCKQACEWQYGKDTPAEEGMXERMAPSGTNKL

SEQ ID NO: 12751 - DNA, 682 bp, Zea mays
  misc_feature: Ceres CLONE 1372528-F
  misc_feature: Translation starting site: 207
  misc_feature: Pfam Name: tRNA_anti Pfam Description: OB-fold nucleic acid binding domain
  misc_feature: SWISSPROT Homolog: EC 6.1.1.22 Asparagine--tRNA ligase
  misc_feature (395)..(395): n is a, c, t, g, unknown, or other
  misc_feature (442)..(442): n is a, c, t, g, unknown, or other
  misc_feature (482)..(482): n is a, c, t, g, unknown, or other
aagctggagctccccgcggtggcggccgctctagaactagtggatcccccgggctgcaggaattcgcacgagaccattacctagaacatcctaatcgaaaaaagcaaaaccctaagaaacccaccctccctccagtctcctcgacccccgccgccgccgccgccatcacaacccagagcaccccctccccaccccaccctgtcccgatggctgcggacgccgccgctgcggcgatgtccgcgacttccctctgcgacgatctcgagcccgccaccgtgcgcacccgcatccgcgatgtcctggccgcaggtgccgcgcgtgccggggaccgcgtcgtggtcggtgggtgggtccggacgggccgggagcaggggaagggctctttcgcccttccntggagctcaggcgacggggtcctgcgctgccacgcttcagggcatcngtgacgccgccgtgcacccggtagcgcgccttcacggccnacgggactccgtcctcgtcgagggcgtgatcaaggagccgcccgaggggaccaagcagaacgtccagctgaaggtcagccgcgtgctttgaggtcgcgaagtccatgcccgcgtctacccgctgcccaagggcaggtcaaactcacgctcgagaagctcaaggacgtcgttcatctccgttcgggcaccacaccgatgga

SEQ ID NO: 12752 - DNA, 672 bp, Zea mays
  misc_feature: Ceres CLONE 1372532-F
  misc_feature: Translation starting site: 114
  misc_feature (501)..(501): n is a, c, t, g, unknown, or other
tggagctccccgcggtggcggccgctctagaactagtggatcccccgggctgcaggaattcgcacgagaccattacctagaacatcctaatcgaaaagtacgtatccgtcgagatggccgccccgctccggcggagcctcccctcccttggccgcgcgcttctcacgccggcgccggcgcggatgctctccgcggaggcctccgatgccctagttgagatcaagcccggggagatcgggatggtctccggcatccctgaggagcatctccgccgtaaggttctaatttattcaccagctaggactgcatcccagcaaggttcaggcaaagtcgggaggtggaaaattaattttttgtcaacccaaaagtgggagaacccgttgatgggatggacatctactgggggatccatatggctaatgtcggtgaagcaggacttacgtttgacagtgcagagtcagcaaaggcgtttgccgaaaaacatggatgggaatatgtggntcggaaaacgcatgcacctcttctgagggctaagggctacgctgagaacttcagtggagaggccctccgaaaagcgagcagcatgagctcgaacatctgggatgtgacttggcacgatgtcgtttcctcctgctcgatttattttggcttcaccgtgccccatgtaaagac

SEQ ID NO: 12753 - DNA, 668 bp, Zea mays
  misc_feature: Ceres CLONE 1372535-F
  misc_feature: Encodes the peptide sequence at SEQ ID NO. 12754
  misc_feature (565)..(565): n is a, c, t, g, unknown, or other
  misc_feature (588)..(588): n is a, c, t, g, unknown, or other
  misc_feature (589)..(589): n is a, c, t, g, unknown, or other
  misc_feature (645)..(645): n is a, c, t, g, unknown, or other
  misc_feature (665)..(665): n is a, c, t, g, unknown, or other
tggagctccccgcggtggcggccgctctagaactagtggatcccccgggctgcaggaattcgcacgagaccattacctagaacatcctaatcgaaaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgccccttgttgtttcaacaatcgcccagcctaatccttggtgcagtcattggtacaaaccatcaggggcacacagctgcagcaactcgtgctacctctgatcaacaagtagctctggcaaacctttctccctactctcagcaacaacatttcttccatttcaccactgtctacactgaaccctgctgctnatttgcagcaacactattaccannttagcaggtaggtactgcctactctccagaaacacaacttctttcattttacccanttggccgcacttgaccccgntgc

SEQ ID NO: 12754 - protein, 102 aa, Zea mays
  misc_feature: Ceres CLONE 1372535-F
MATKIFSLLMLLALSTCVANATIFPQCSQAPIASLLPPYLPSIIASICENPALQPYRLQQAIAASNIPLSPLVVSTIAQPNPWCSHWYKPSGAHSCSNSCYL

SEQ ID NO: 12755 - DNA, 618 bp, Zea mays
  misc_feature: Ceres CLONE 1372540-R
cgattgggtaccgggccccccctcgaggtcgacgttatcgataagcttttttttttttttttttgaagcaggatattcaattttgcatatactgaaattttgaagtatcacagaatgtatctctactaatccttaagacaatagtgtagacatatacaaacacaatgaagatgcactatcttcttatcgtgataactccatgatcttcttctccttaataaagagagatgaatatcttagctccatatggtaacagccaatcctggcaactgcatatgatgtacatttcatttgtactagttttctggaattggaacataaccctgtggttcttcaaggcgaactggagctatagcagccaccacaacagaggcaccaaacaacacgacaaccaacgctgtgaagttcaccaagaatgcctctgtgccgtatttgtcgagacccgagctctcgaggaaagtgagcttctcaagaaagccgagttccgcattagccagtgctaagatgtagacaaagagcccaaagagtatgggccaaaggaagaaaaaccctttcttaccttttgggggcaaccccccgggaaaaaaaaaatgttaccaaaatcccaattttttccct

SEQ ID NO: 12756 - DNA, 673 bp, Zea mays
  misc_feature: Ceres CLONE 1372543-F
  misc_feature: Encodes the peptide sequence at SEQ ID NO. 12757
gctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttggttccctccaacaattcatcagcccctattacatcagttaccctttggtgcatttatttggcacaaaaccatcagggcacaaacaactacaacaaactgtggctagcaaaaccttgctggcctacctctccagaaacagcaagtttcttcccattcaaaccaactaagctgcatttgaactctgccttccttatttggcaacaaccaacaaactacccattcagcccaagctaccctgcttgccctaccccccaagaaatttccttccacattcaaaccaactggggaagccatttgaacctccctccctggttaaatttaccagc

SEQ ID NO: 12757 - protein, 32 aa, Zea mays
  misc_feature: Ceres CLONE 1372543-F
SRTSGSPGLQEFARDHYLEHPNRKIAHIIETN

SEQ ID NO: 12758 - DNA, 677 bp, Zea mays
  misc_feature: Ceres CLONE 1372544-F
  misc_feature: Translation starting site: 325
  misc_feature (344)..(344): n is a, c, t, g, unknown, or other
  misc_feature (352)..(352): n is a, c, t, g, unknown, or other
  misc_feature (406)..(406): n is a, c, t, g, unknown, or other
  misc_feature (407)..(407): n is a, c, t, g, unknown, or other
  misc_feature (417)..(417): n is a, c, t, g, unknown, or other
  misc_feature (553)..(553): n is a, c, t, g, unknown, or other
ggagctccccgcggtggcggccgctctagaactagtggatcccccgggctgcaggaattcgcacgagaccattacctagaacatcctaatcgaaaaggaagcttgccgacaactgcactggtctccagggcttcctcgtcttcaacgctgttggcggaggaacaggctctggccttggttccctcctcctggagcgtctgtctgttgactacggcaagaagtctaagcttggtttcactgtgtacccatccccccaagtttcgacctcagtggttgagccatacaacagtgtcctgtccacccactccctccttgagcacactgatgtggctatcctgctggancacgaggncatctatgacatctgccgccgttcccttgacattgagcgcccaacctacaccanncctcacaggncttgtgtcccaggtcatctcatccctgactgcctccctgagggtcgatggtgctcttaacgtggatgtgaatgagttccagaacaacttggtgccctacccgaggatcacttcatgctttcctcccatgctccagncatctctgtggaaaggcctaccacaaacaatttgctgggccaaaaaaaccaaaagggccttcaaaccttcctccatggtggcccaagggccaccccccccatggaaacatgccggtgccctggc

SEQ ID NO: 12759 - DNA, 681 bp, Zea mays
  misc_feature: Ceres CLONE 1372545-F
  misc_feature: Encodes the peptide sequence at SEQ ID NO. 12760
  misc_feature (308)..(308): n is a, c, t, g, unknown, or other
  misc_feature (413)..(413): n is a, c, t, g, unknown, or other
  misc_feature (459)..(459): n is a, c, t, g, unknown, or other
tccccgcggtggcggccgctctagaactagtggatcccccgggctgcaggaattcgcacgagaccattacctagaacatcctaatcgaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatggntcagtacgacaccgtccacgggcactggaagcacagcgacatcacactcagggactccaagacccttctctttcggtgacagcccgtcaccgtctttggcatcangaaccctgaggaaatcccgtggggtgagggctggcgctaattatgncggggagccccccggggtcttcaatgaaaaggaaaagcttggtggcctttccagggggggggcccaaaaaggttgttattcttgccccaaaaaaaagggccccttgtttttgtgtgggggcaaaggggaaaaaaaccccccgggaggaaaaattgtttccaggggagtgtgacccaaaagggggtgtgcccccttggaaaggggttttgggaacccttcggt

SEQ ID NO: 12760 - protein, 72 aa, Zea mays
  misc_feature: Ceres CLONE 1372545-F
  misc_feature (4)..(73): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (47)..(47): Xaa is any aa, unknown, or other
MGKIKIGINGFGRIGRLVARVALQSEDVELVAVNDPFITTDYMTYMXQYDTVHGHWKHSDITLRDSKTLLFR

SEQ ID NO: 12761 - DNA, 680 bp, Zea mays
  misc_feature: Ceres CLONE 1372546-F
  misc_feature (192)..(192): n is a, c, t, g, unknown, or other
  misc_feature (206)..(206): n is a, c, t, g, unknown, or other
  misc_feature (364)..(364): n is a, c, t, g, unknown, or other
  misc_feature (528)..(528): n is a, c, t, g, unknown, or other
tggagctccccgcggtggcggccgctctagaactagtggatcccccgggctgcaggaattcgcacgagaccattacctagaacatcctaatcgaaaaaacaacggtcaagggcctagctatttgttaactctggcccctcacctgctccccttctgtccagcccacgggagggcgactagggttaggggcgnaccggaggtccccngcgcctgcccaaatccacccatcccttccgttcaagccgccggagctcccaggccgctggtgtcgaagccgtcgccccttccttccaggcccgcctcctctctgtccgttctgtcttggtcgccgaagctcaagaccacagtgtcaggaagttctccnatcttccagccaaaacacattcatcagtcagatacactttgacccgagaattattcagaatcactccacgagaggatcagctttcgaagctaggagagcaaagctctaccaaacaggccaggaacgtctctcaaatccccagttcagtaactggctaactgtangaaaagggaaaaaaaaatggaaaacggcggcccttaaaggcaacctccccgacaatgcaaacgaacatggcccgtgaaccaattctgaggaggcggccaaggaaaatgcttggcttggggccccaaccagaaatttgcgcccccggcccaaa

SEQ ID NO: 12762 - DNA, 687 bp, Zea mays
  misc_feature: Ceres CLONE 1372550-F
  misc_feature: Translation starting site: 199
  misc_feature (318)..(318): n is a, c, t, g, unknown, or other
  misc_feature (467)..(467): n is a, c, t, g, unknown, or other
  misc_feature (529)..(529): n is a, c, t, g, unknown, or other
  misc_feature (530)..(530): n is a, c, t, g, unknown, or other
  misc_feature (552)..(552): n is a, c, t, g, unknown, or other
  misc_feature (623)..(623): n is a, c, t, g, unknown, or other
  misc_feature (665)..(665): n is a, c, t, g, unknown, or other
ggagctccccgcggtggcggccgctctagaactagtggatcccccgggctgcaggaattcgcacgagaccattacctagaacatcctaatcgaaaaaccattcctttctctccctctcgccgtcgtcgccacctccacttggccccgctcatcgcctcctccgacgaccaccgtccaccggcgacaaggacagcgacgatgcagtcggcggcgtggaggcgtcacctcctcgaccaccacctctccccttcaacctcggctgccatcgccgccttcagatccgcctcccagcccgggctcgctccccaagggttgttntggagcggatggcgcaagatgcatgtctgcgagggcgccggcggtcaaaggggtcccgggcatctcgtcccgcaagggcaccgggagggaaggtcttctgtgagtggaatttgtagccacgttgtttggagctactggggtttcttggncgctatcttgtgcaaccacttggccaagatgggggtctcagtggctggtccaattcagaggnntgtgaggattctcccctcgcancctgagattatggggtgacttggggtcagaattgtgcccatgaaatacccatccgagagatggtgattcanttaaggctgttatggccaagtccaaatggggttattacctcntaaggacgggagtatggaacag

SEQ ID NO: 12763 - DNA, 695 bp, Zea mays
  misc_feature: Ceres CLONE 1372557-F
  misc_feature: Translation starting site: 149
aagctggagctccccgcggtggcggccgctctagaactagtggatcccccgggctgcaggaattcgcacgagaccattacctagaacatcctaatcgaaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaacccacgttcgggaactccaaccagttcttcaccgtcgccttcgaggctggcaggctagagggctccacgctccttaccgaaggagtggtgacggatggatccgatgaatgggcaatctacggcgggacccggaaagtttgctatggcgagaggggcccgcaaaaaaaaggtacctttgccgataggggacggcgccccggaacccttgaacgagctccgcatgcagggttctccgggcccgggggtttgggttcactccccaggcaacccaaaaccagcccagggactcccacccat

SEQ ID NO: 12764 - DNA, 651 bp, Zea mays
  misc_feature: Ceres CLONE 1372567-F
  misc_feature: Encodes the peptide sequence at SEQ ID NO. 12765
tggagctccccgcggtggcggccgctctagaactagtggatcccccgggctgcaggaattcgcacgagaccattacctagaacatcctaatcgaaaacctagtctacgccggcctaacgccttgggacctccgctgctgttctctcgccggtcatttttggttcaggggctgatcgcttgatcggatcggtgtcgcagccctatacatcatacatgacgacgcccggctcctgtcctgcgacaaccgccgccacccaccctcccatgtgcgccgctagcgccgcaggtggatcgcaaaaaatggtgcgtccgcgactagtgctcttcggggactccatcaccgagcagtccttccgccccggtggctggggtgccgcactggctgatacctactcgcgcaaggctgatgtagttgtcagaggctatggtggatacaacacaagatgggctcttttcttagtacatcacatctttccgctgggatggttagcaccccctcttgcaccactattttctttggagcaatgacgcagcccctggtaggagaactggcgagcgacaacatgtccagtttcagatataaaaatatctcaaaatgattgtaatcattggaagatggtctaattcatgggtatgggctaatacgccacc

SEQ ID NO: 12765 - protein, 87 aa, Zea mays
  misc_feature: Ceres CLONE 1372567-F
MCAASAAGGSQKMVRPRLVLFGDSITEQSFRPGGWGAALADTYSRKADVVVRGYGGYNTRWALFLVHHIFPLGWLAPPLAPLFSLEQ

SEQ ID NO: 12766 - DNA, 746 bp, Zea mays
  misc_feature: Ceres CLONE 1372569-F
  misc_feature: SWISSPROT Homolog: EC 1.14.13.39 Nitric-oxide synthase
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (626)..(626): n is a, c, t, g, unknown, or other
  misc_feature (664)..(664): n is a, c, t, g, unknown, or other
  misc_feature (685)..(685): n is a, c, t, g, unknown, or other
  misc_feature (708)..(708): n is a, c, t, g, unknown, or other
  misc_feature (709)..(709): n is a, c, t, g, unknown, or other
ccccgcggtagcggccgctctagaactagtggatcccccgggctgcaggaattcgcacgagaccattacctagaacatcctaatcgaaaaatagcgccatcaagagtcaggtgtcggcgctgctcctgaggtgcctctttagggtgtccgggccgggcaaggccaagaagttccagcagatcctggtgctgatggggaggcggtgggtgttcatgcagacggaggcgagccgcgttctcggcatggacctggaccgcggggacaacacgcacaccttcatacgctcggactcgccgccactgctcacccggaacagcatcaaccagagtccgaagttgctccaccccgtgcctcagccctgtctccaaggacttcgagcacaaggactgcagcggcctgaaaaagaggcaccaccaactagaaattgttctatgtggaagcagcaagttgttgtctcatggccacatgcccacatggtcactggctgttggtggccacaacggttatcaggggggcaagggtgttcgtttctggnnnnacagttaggtcatggagattactctgcctcacgcacaaaggtattttcgcatgggtgataactctttggagtcaacaatgaagcaagnaaaacaatacaaggtactggcagctgaactaatggaancaaaagagagctgcccacagntgaaagactgaaagacactgccnntttaatttggatgtctgaaccccattgggtttccggt

SEQ ID NO: 12767 - DNA, 673 bp, Zea mays
  misc_feature: Ceres CLONE 1372574-F
  misc_feature: Translation starting site: 179
  misc_feature: SWISSPROT Homolog: EC 3.4.25.1 Proteasome endopeptidase complex
  misc_feature (432)..(432): n is a, c, t, g, unknown, or other
  misc_feature (451)..(451): n is a, c, t, g, unknown, or other
  misc_feature (501)..(501): n is a, c, t, g, unknown, or other
ccccgcggtggcggccgctctagaactagtggatcccccgggctgcaggaattcgcacgagaccattacctagaacatcctaatcgaaaaaagaaagaaagaaagaaaaggggcaggaagaaatcgagcctcactcgatccatcgcctcgccgcagcacacacgaggccggcggcgccatggccatgaagctggacatgtgcgcgctcgagaccaacttcgccaacctgaccgcctccgccggcgacgacacgtacttctccgccgaggcccccgacgtgccgtccatggtgctccccatctgcgacgacttcgacggcttccaggcggccaccaaggatatggtgaagaataagaaggggacgaccacgcttgccttcatcttcgacaagggcgtcatcgtcgccgctgattccaggccagcatgggcggntatatatcctcacaaaccngtgagggaaaatattgaataaatccttacatgctggggacaatggctggnagtgctgctgattgccattttggcataggacctaggaaccaggtgcgcctcatgagcttcaacaagcgaagatctctatggctgggctccaaactggtgctacatctttattcataacggggaggaactgccattggacatgatcctgatgggaatggaaagggcctgcttt

SEQ ID NO: 12768 - DNA, 689 bp, Zea mays
  misc_feature: Ceres CLONE 1372575-F
  misc_feature: Encodes the peptide sequence at SEQ ID NO. 12769
  misc_feature (410)..(410): n is a, c, t, g, unknown, or other
  misc_feature (411)..(411): n is a, c, t, g, unknown, or other
  misc_feature (417)..(417): n is a, c, t, g, unknown, or other
  misc_feature (430)..(430): n is a, c, t, g, unknown, or other
  misc_feature (434)..(434): n is a, c, t, g, unknown, or other
  misc_feature (436)..(436): n is a, c, t, g, unknown, or other
  misc_feature (488)..(488): n is a, c, t, g, unknown, or other
  misc_feature (543)..(543): n is a, c, t, g, unknown, or other
cgctctagaactagtggatcccccgggctgcaggaattcgcacgagaccattacctagaacatcctaatcgaaaactctcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacaacatgggggatgtcgacatggtctcagttgaagagtcttcagaagctgcaaagggcaagtcccaagtgaagttcagtgtnngagaanacttcagaatacngatnangagatttaagggcaaaggcaggaagaaagcaaaaatgcaaaaccacttgccnaggagaagtttgatgcatggtagcatgacggaccagactgcatacatccctttgnattgttttctcaaaggttgcagcatggaccgacctcccggaaacctggcgggggaactgtctcttgatcttcggcctgagggtaaaaaaacctacttaggctggggttattgactttcaaacggaacttcctttaaaggggcatgt

SEQ ID NO: 12769 - protein, 175 aa, Zea mays
  misc_feature: Ceres CLONE 1372575-F
  misc_feature (95)..(95): Xaa is any aa, unknown, or other
  misc_feature (97)..(97): Xaa is any aa, unknown, or other
  misc_feature (101)..(101): Xaa is any aa, unknown, or other
  misc_feature (102)..(102): Xaa is any aa, unknown, or other
  misc_feature (103)..(103): Xaa is any aa, unknown, or other
  misc_feature (139)..(139): Xaa is any aa, unknown, or other
MAKYNVVQKNKRQCNQDRKRAAHGEPGTGKLKQRTAPVSMSGKRKKKLERRLNRKQKEAAMIKALENNMGDVDMVSVEESSEAAKGKSQVKFSVXEXFRIXXXRFKGKGRKKAKMQNHLPRRSLMHGSMTDQTAYIPLXCFLKGCSMDRPPGNLAGELSLDLRPEGKKTYLGWGY

SEQ ID NO: 12770 - DNA, 684 bp, Zea mays
  misc_feature: Ceres CLONE 1372576-F
  misc_feature: Encodes the peptide sequence at SEQ ID NO. 12771
  misc_feature (292)..(292): n is a, c, t, g, unknown, or other
  misc_feature (297)..(297): n is a, c, t, g, unknown, or other
cgctctagaactagtggatcccccgggctgcaggaattcgcacgagaccattacctagaacatcctaatcgaaaaacaaacacctccgatccgtccccgatcatcgcaccacctgtagcccacctcgctctcgagtctcgacccagcgacgagatggccgcggtggatctgaccccaaggacgcccaagaaggcctacggcggcgacggcggcgcctactacgagtggagccccgccgacctgcctatgctcgccgtcgcctccatcggcgccgccaagctctcgctcgccngcggnggcctctccctccccagctactccgactccgccaaggtcgcctacgtcctacaaggcgtcggtacctgcggcctcgtcctccccgaggcgacaaaggagaaagtggtggcggtgaaagagggcgacgcgctggcgctgcccttcggggggggacgtggtggacaacggccccgccgggaggccgacctcacggtgctcttcctcggcgacacttcaagggccacaagcgggggcagttcaccactttccagctcacggggccggggggatcttcacgggcctgcccaccgaattcgtgccccgcgggtgggatctgccggaaccccaccccggagggtggggtccaaccacccgccctcgggatcttaaagtgcccccccccccgcc

SEQ ID NO: 12771 - protein, 170 aa, Zea mays
  misc_feature: Ceres CLONE 1372576-F
  misc_feature (6)..(131): Pfam Name: Cupin_1 Pfam Description: Cupin
  misc_feature (47)..(47): Xaa is any aa, unknown, or other
MAAVDLTPRTPKKAYGGDGGAYYEWSPADLPMLAVASIGAAKLSLAXGGLSLPSYSDSAKVAYVLQGVGTCGLVLPEATKEKVVAVKEGDALALPFGGGRGGQRPRREADLTVLFLGDTSRATSGGSSPLSSSRGRGDLHGPAHRIRAPRVGSAGTPPRRVGSNHPPSGS

SEQ ID NO: 12772 - DNA, 706 bp, Zea mays
  misc_feature: Ceres CLONE 1372579-F
  misc_feature: Encodes the peptide sequence at SEQ ID NO. 12773
  misc_feature (430)..(430): n is a, c, t, g, unknown, or other
  misc_feature (500)..(500): n is a, c, t, g, unknown, or other
  misc_feature (545)..(545): n is a, c, t, g, unknown, or other
  misc_feature (591)..(591): n is a, c, t, g, unknown, or other
  misc_feature (627)..(627): n is a, c, t, g, unknown, or other
  misc_feature (650)..(650): n is a, c, t, g, unknown, or other
  misc_feature (655)..(655): n is a, c, t, g, unknown, or other
gctctagaactagtggatcccccgggctgcaggaattcgcacgagaccattacctagaacatcctaatcaaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacnacaacttgtgctagcaaaccttgctgcctactctcagcaacagcagtttccttcatttcaaccactaggntcattgaactcttgcttctatttgcaacaacaacaactaccattncagcagctacctgctgcctaccccagcaaattccttcattccaccnactagcagcattgaactcctcctgctaattttaagnaagaacaactaactaccattcanccagntaagcttggggtgagcccttggtaacttctttgaaaaaccaacagtttgtt

SEQ ID NO: 12773 - protein, 153 aa, Zea mays
  misc_feature: Ceres CLONE 1372579-F
  misc_feature (100)..(100): Xaa is any aa, unknown, or other
  misc_feature (138)..(138): Xaa is any aa, unknown, or other
MAAKIFCLLMLLGLSASAATATIFPQCSQAPIASLLPPYLSPAVSSVCENPILQPYRIQQAIAAGILPLSPLFLQQSSALLQQLPLVHLLAQNIRAQQLXQLVLANLAAYSQQQQFPSFQPLGSLNSCFYLQQQQLPXQQLPAAYPSKFLHST

SEQ ID NO: 12774 - DNA, 704 bp, Zea mays
  misc_feature: Ceres CLONE 1372580-F
  misc_feature: Encodes the peptide sequence at SEQ ID NO. 12775
  misc_feature (413)..(413): n is a, c, t, g, unknown, or other
  misc_feature (421)..(421): n is a, c, t, g, unknown, or other
  misc_feature (504)..(504): n is a, c, t, g, unknown, or other
  misc_feature (516)..(516): n is a, c, t, g, unknown, or other
  misc_feature (526)..(526): n is a, c, t, g, unknown, or other
  misc_feature (559)..(559): n is a, c, t, g, unknown, or other
  misc_feature (560)..(560): n is a, c, t, g, unknown, or other
gctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtgggtggggctggccgggnccacgccnggtgttcctgatcttcagccccgtgctcgtccccgccgcgctggctcatcggacggcccggtcatggggtccctcacgtcggncgcgctgggggnctccgggggncctgtcctcgctcacgtgcctcgccaacacggnngcggcaggcgttccagcgcaccccggactacgggggagaggcgcaccgcagggatggcggaggccgcggcgcacgcggcccacagaccgcgcagggagccaggccttcagggcagggcggcaggagccggcccccggggaagtg

SEQ ID NO: 12775 - protein, 84 aa, Zea mays
  misc_feature: Ceres CLONE 1372580-F
  misc_feature (79)..(79): Xaa is any aa, unknown, or other
  misc_feature (82)..(82): Xaa is any aa, unknown, or other
MADRDRSGIYGGAHATYGQQQQQGGGGRPMGEQVKGMLHDKGPTASQALTVVTLFPLGGLLLVLSGLALTASVGGAGRXHAXCS

SEQ ID NO: 12776 - DNA, 600 bp, Zea mays
  misc_feature: Ceres CLONE 1372582-F
  misc_feature (38)..(38): n is a, c, t, g, unknown, or other
  misc_feature (49)..(49): n is a, c, t, g, unknown, or other
  misc_feature (61)..(61): n is a, c, t, g, unknown, or other
  misc_feature (62)..(62): n is a, c, t, g, unknown, or other
  misc_feature (80)..(80): n is a, c, t, g, unknown, or other
  misc_feature (81)..(81): n is a, c, t, g, unknown, or other
  misc_feature (88)..(88): n is a, c, t, g, unknown, or other
  misc_feature (89)..(89): n is a, c, t, g, unknown, or other
  misc_feature (104)..(104): n is a, c, t, g, unknown, or other
  misc_feature (106)..(106): n is a, c, t, g, unknown, or other
  misc_feature (107)..(107): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (236)..(236): n is a, c, t, g, unknown, or other
  misc_feature (288)..(288): n is a, c, t, g, unknown, or other
aagctggactccccgcggtggcggccgctctagaactnagtggatcccnccgggctgcagnngaattcgcacgagaccannttacctnnagaacatcctaaatncnngaaaaaactatcnnnctaccagggcaccactcgcatcgtgtgctcagtcagatcccgtcccgcattcctaaagccagttagttggcattgagacgatgactgcttctgcagctgctggtgtgcaaatgntggctgcacccctttgcatttcggcctcgcccagaaatcctaacgcccgggntagcaattttctaaggactgattggatggtcaggaacccatggtaaatctccccaaaaataaggtggtccctgggcccttaaggggttaaacccccaataaattttttgttaaaaaaaaaaaatccaaaaaaagggtgcccccccagggtttttcccctttgtttcccaaaggaaaaaaaggcgctttctttgtgcgaagaatccctaaaaaaaaaagggtttaaggggggggaaaatttgaaaaaaaacctctctgcggggcggggggggggaaaaaataacttttggggaaaaaaaaggggggccccccc

SEQ ID NO: 12777 - DNA, 716 bp, Zea mays
  misc_feature: Ceres CLONE 1372591-F
  misc_feature: Encodes the peptide sequence at SEQ ID NO. 12778
  misc_feature (465)..(465): n is a, c, t, g, unknown, or other
  misc_feature (485)..(485): n is a, c, t, g, unknown, or other
tccccgcggtggcggccgctctagaactagtggatcccccgggctgcaggaattcgcacgagaccattacctagaacatcctaatcgaaaaatccctctctagtctctaccctttccgcctcggcacctccccacccctctcgccttcgcttcgtcgccacggcgagccccacgccgccgatcggggcgccgccagcggcggcggcgcccgatccgatggaagcggaggtggggccgccgaatccgccgcggccggagccagccggatcggagcccgacgacgcgcgcctctccccgcctcctcctgctcctgctccgccgcctccgcccccgcctcctcccgccgccgaggctgccgccgcgcccaccgcctccgcggccttctcgctgcaggctccagctccggcgccggcggaggcgaacggcagctccgacaggaagaggaggaggaaggcggaggacggngacgggtgcaagacctgcanctgcaagaagtccaggtgcctcaagctttactgtgtgtgctttgcttctgggttacattgtactgaatcatgtggatgtgaaccttgtcataacaagccacaattggcaggtactctgcggatggcaacagttttacctctgaaacctgtcaaaccattcgagctggcaaagatatagtgggaacaagtcataaggtctcctatggaattctattagaaagaaatgcacat

SEQ ID NO: 12778 - protein, 148 aa, Zea mays
  misc_feature: Ceres CLONE 1372591-F
  misc_feature (84)..(125): Pfam Name: CXC Pfam Description: Tesmin/TSO1-like CXC domain
  misc_feature: SWISSPROT Homolog: EC 2.1.1.43 Histone-lysine N-methyltransferase
  misc_feature (90)..(90): Xaa is any aa, unknown, or other
MEAEVGPPNPPRPEPAGSEPDDARLSPPPPAPAPPPPPPPPPAAEAAAAPTASAAFSLQAPAPAPAEANGSSDRKRRRKAEDGDGCKTCXCKKSRCLKLYCVCFASGLHCTESCGCEPCHNKPQLAGTLRMATVLPLKPVKPFELAKI

SEQ ID NO: 12779 - DNA, 666 bp, Zea mays
  misc_feature: Ceres CLONE 1372593-F
  misc_feature: Translation starting site: 196
  misc_feature (365)..(365): n is a, c, t, g, unknown, or other
  misc_feature (498)..(498): n is a, c, t, g, unknown, or other
  misc_feature (627)..(627): n is a, c, t, g, unknown, or other
tggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcggncctgatcgcggcggcggtggcgcacgcgttcgcgctgttcgtggcggtgtctgtgggcgcgaacatctcccggcggcacgtgaaccctggcgtgaccttcggcgccttcgtgggcggcacatcaccctgtccngggggctcctgtactgggtggcgcagctgctggggtccaccggggcgtgcttcctgctccgcttctcgacgggcgggcaggccacgggcacccttcggctgacgggcgtgtcggtgtgggaggcgctgntgctggagatcgtgatgaccttcgggctgggggacacgg

SEQ ID NO: 12780 - DNA, 698 bp, Zea mays
  misc_feature: Ceres CLONE 1372594-F
  misc_feature: Encodes the peptide sequence at SEQ ID NO. 12781
  misc_feature (631)..(631): n is a, c, t, g, unknown, or other
  misc_feature (632)..(632): n is a, c, t, g, unknown, or other
tcaccgcggtggcggccgctctagaactagtggatcccccgggctgcaggaattcgcacgagaccattacctagaacatcctaatcgaaaaacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcaggggaacctgcggcgttggcagcaccccgatcctgggccaanntgcgtcgagttcctggagcatcagtgcagcccgacggcgacgcctactgctcgctcaggggggcag

SEQ ID NO: 12781 - protein, 50 aa, Zea mays
  misc_feature: Ceres CLONE 1372594-F
  misc_feature (28)..(28): Xaa is any aa, unknown, or other
  misc_feature (29)..(29): Xaa is any aa, unknown, or other
MPVPTAASKPVPAAGEPAALAAPRSWAXXRRVPGASVQPDGDAYCSLRGA

SEQ ID NO: 12782 - DNA, 729 bp, Zea mays
  misc_feature: Ceres CLONE 1372596-F
  misc_feature: Encodes the peptide sequence at SEQ ID NO. 12783
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
ggagctccccgcggtggcggccgctctagaactagtggatcccccgggctgcaggaattcgcacgagaccattacctagaacatcctaatcgaaaacttatcgttatggcttccgtcgctttgccggcgttcacctgccggagctcagcagatccgacgaaggaacttcgcgtctgcacgaaccgcacctgccgaaaacaaggctcattccaaatcctcgagacgctaacgtccctcgcacctccccaactccaagtcaatccctgcggctgcctcggccgatgcggctcgggtccgaacctcgtcgctctccctcaaggtctcttccttcgtcactgcgccacgccttctcgagctgctgaaatcttgttcagcctatgcggcgacggcagggaagcttcctcttcctccgccgtcgcagaggctctcgccgctttggcgctaaccaacaatgctctctctcagatcgaagctgagaacttcgaagaagcagagtcgcttctcacacaggctttagagatgaaaccatacggtggactgcatagaatcttcaaacacagagcagtggcgaaactaggaatggttgattactctggggctcttgaagatataagccaagctctagcattaggtcctaactattatgagccctacgtttgccaaggtgatgtttacgttgcacaaggtcaatatgatctcccgcgagagtcatacttcnnnagtgttaga

SEQ ID NO: 12783 - protein, 208 aa, Zea mays
  misc_feature: Ceres CLONE 1372596-F
  misc_feature (205)..(205): Xaa is any aa, unknown, or other
MASVALPAFTCRSSADPTKELRVCTNRTCRKQGSFQILETLTSLAPPQLQVNPCGCLGRCGSGPNLVALPQGLFLRHCATPSRAAEILFSLCGDGREASSSSAVAEALAALALTNNALSQIEAENFEEAESLLTQALEMKPYGGLHRIFKHRAVAKLGMVDYSGALEDISQALALGPNYYEPYVCQGDVYVAQGQYDLPRESYFXSVR

SEQ ID NO: 12784 - DNA, 725 bp, Zea mays
  misc_feature: Ceres CLONE 1372598-F
  misc_feature: Encodes the peptide sequence at SEQ ID NO. 12785
  misc_feature (463)..(463): n is a, c, t, g, unknown, or other
  misc_feature (539)..(539): n is a, c, t, g, unknown, or other
  misc_feature (554)..(554): n is a, c, t, g, unknown, or other
  misc_feature (630)..(630): n is a, c, t, g, unknown, or other
  misc_feature (661)..(661): n is a, c, t, g, unknown, or other
  misc_feature (695)..(695): n is a, c, t, g, unknown, or other
gctctagaactagtggatcccccgggctgcaggaattcgcacgagaccattacctagaacatcctaatcgaaaaaccgaaattaaagacggcgactctgcctgcacagcattgaccgccgccttcgctcctccacctccccgctcgctcttctgcctccgcgcgggccgcggatcccttcactcgccacagcaagcgctagaagagggaatggagcccggcctcgcatcccgcgtcgcccgttcagccgctcagccgctttccggctgcctgtcgcggcactcgctctcgcccgtggctcaagatccagaaccacatttatccgatgccaagtctcctgtcacaagggttcctagcacggcaaaatggccacacttctatgggacacagttacatgaaaaacatcaatggtcccctgatttgggacggggaaaaacttgggctttggcctcatcgagactgancttttatgtaccgttggcaaaatggtggaactgatgaaccttttcgccaagggtgagtcctaccatttggtcctantagactgagtctttncagctgagtctaaaatatgggggcagggattgtttgaaggcctaaagctatagaaaaaactgatgggtcatccctnctattttcgtcccgaggagatggctataggnatgcttagcggggccaaaagagatgggtatgccntgcttcactgtttggagcatttccgtgatg

SEQ ID NO: 12785 - protein, 45 aa, Zea mays
  misc_feature: Ceres CLONE 1372598-F
MPSLLSQGFLARQNGHTSMGHSYMKNINGPLIWDGEKLGLWPHRD

SEQ ID NO: 12786 - DNA, 761 bp, Zea mays
  misc_feature: Ceres CLONE 1372608-F
  misc_feature: Encodes the peptide sequence at SEQ ID NO. 12787
  misc_feature (145)..(145): n is a, c, t, g, unknown, or other
  misc_feature (317)..(317): n is a, c, t, g, unknown, or other
  misc_feature (428)..(428): n is a, c, t, g, unknown, or other
  misc_feature (438)..(438): n is a, c, t, g, unknown, or other
  misc_feature (453)..(453): n is a, c, t, g, unknown, or other
tccccgcggtggcggccgctctagaactagtggatcccccgggctgcaggaattcgcacgagaccattacctagaacatcctaatcgaaaagtcgctgctgcgtctctctctctcccgcaacctccagataataaaaaaacaatnaagcgaccatgttggtgtacaccgatcttctcaccggtgatgagcttctctctgactctttcccttacaaggagattgagaatggtattctttgggaagttgaaggaaagtggactaccaagggatgtgtagaggttaacattggtgccaacccatctgctgaggaaggtgntgaggacgagggtgttgacgactctgttgagaaagttgttgacattgtcgacactttcaggcttcaggagcagcccacttacgaacagaaggggttcatccgctacatcangaagtacatncagcttttgacgccnaagctcaccccggaacagcaggaaggagttaaagaaaggtattggagggagctaccaggttaccttcttcccaagttcaagggacttccaatttctttgttggggaaggggatgccccaaagacccacctattggctttggttattaaaagggagggggtacaaaacccaaattttttgattttcccaatgggttaaaaaggggcaagaggggaaaggaaaatttttgtgcgggttaaaatgggcgggccagccccctccctttttttcttttggggggggggtttttggccccccccccataaaatt

SEQ ID NO: 12787 - protein, 159 aa, Zea mays
  misc_feature: Ceres CLONE 1372608-F
  misc_feature (1)..(150): Pfam Name: TCTP Pfam Description: Translationally controlled tumour protein
  misc_feature (55)..(55): Xaa is any aa, unknown, or other
  misc_feature (92)..(92): Xaa is any aa, unknown, or other
  misc_feature (95)..(95): Xaa is any aa, unknown, or other
MLVYTDLLTGDELLSDSFPYKEIENGILWEVEGKWTTKGCVEVNIGANPSAEEGXEDEGVDDSVEKVVDIVDTFRLQEQPTYEQKGFIRYIXKYXQLLTPKLTPEQQEGVKERYWRELPGYLLPKFKGLPISLLGKGMPQRPTYWLWLLKGRGYKTQIF

SEQ ID NO: 12788 - DNA, 701 bp, Zea mays
  misc_feature: Ceres CLONE 1372609-F
  misc_feature: Encodes the peptide sequence at SEQ ID NO. 12789
  misc_feature (272)..(272): n is a, c, t, g, unknown, or other
tccccgcggtggcggccgctctagaactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctncagaagctggaggagaccacgaggtgtggtcgtcgtcatcctcgccggccggtggtcgtgttggcggcgccgtcgtcgtcccaacggcgcggatggggccggacgggtcgcccttccttggtccgggggaagaggccgttggtggtttaaccaaaagaagcgcaacccctctggcccagggggatccccggcctacacccgggcagatcattcaacgtcctgccgggggaagggggggcacggggtaccaacgtgcacagtctcctggggggggacttcgccctcccgggagcttcgtcgaccccgggcaaagtttcgggggggtgcgcctttcaaagattggggtcgttaaggggggggggccccctttggaaccccaggggggaccgttcttctttccagtaattccaaattctttctccttaccag

SEQ ID NO: 12789 - protein, 172 aa, Zea mays
  misc_feature: Ceres CLONE 1372609-F
  misc_feature (30)..(30): Xaa is any aa, unknown, or other
MGEWCFKKRAALVIIVAIISSLQLLLITAXEAGGDHEVWSSSSSPAGGRVGGAVVVPTARMGPDGSPFLGPGEEAVGGLTKRSATPLAQGDPRPTPGQIIQRPAGGRGGTGYQRAQSPGGGLRPPGSFVDPGQSFGGVRLSKIGVVKGGGPPLEPQGGPFFFPVIPNSFSLP

SEQ ID NO: 12790 - DNA, 662 bp, Zea mays
  misc_feature: Ceres CLONE 1372610-F
  misc_feature (429)..(429): n is a, c, t, g, unknown, or other
gctctagaactagtggatcccccgggctgcaggaattcgcacgagaccattacctagaacatcctaatcgaaaacaagctcgatcaccaacccagctcggtcgtcccagctgatcaggtcgagcaccttgcgacctgctcgatcatcagtgtagagtgtctgtaggtgtctgtctctcttggtggctggttgcaacgtcatggcgacgtcttctcctcggggtgccctgctggctgctggtccctggccggcttgggggccgggctcttcccggggggcagcttggaacaggaacttgacatcacctggggcaaccgcggggcaaaggcctggaaaaccggcggctggtgacccttgccctgggacccacgtccgggtcccgcgttcacgcccccggacaagaaccctgtcgccaaaaaccaacatggnattgcgggtgggggcggggcaaatcccccggaaccggacaccgccaactaaccggtcctcccaagggcgggcccccccacaaaatcaattttccaatcccttgggaaacgtgctgccggggaacccctaaactgctctaaacacacgggtgttcgcgcggggcgcgcgcgctaaaagagaagaaaaaggtgcccccccttggtggctaacccccacccgcgaccttttccaaa

SEQ ID NO: 12791 - DNA, 782 bp, Zea mays
  misc_feature: Ceres CLONE 1372611-F
  misc_feature: Encodes the peptide sequence at SEQ ID NO. 12792
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (54)..(54): n is a, c, t, g, unknown, or other
tttttttnnnnntttttnnncccttcctttccctccccccggaagaaaaaaggncaaagctggggctccccgcggtggcggccgctctagaactagtggatcccccgggctgcaggaattcgcacgagaccattacctagaacatcctaatcgaaaactaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccagggcggaaacgcgtgctgggagctgtactgcctctgagcatggcattccaggctgacggccagatgcccggtgacaagaccattgggggaggtgatgatgctttcaacaccttcttcagtgagactggtgctgggaagcacgtgcccccgggctggtttttggtgaccttgaacccactgtcatccatgaaggggaggaactggcacctaccgccaggctcttccccccctggagcagcctcctcagcggggaagggagggatggaaggccaacaaccttttgccccggggggccactacaccccattgggcaaagggaaatatggttgaacctggtgggccttggattcgccttcacaggaaaatttgggcccaaaaaacttggccctggacatccccccgggggctttccttcgcgcctttacaagcccccggtggccggggtacgaaaccgcgccctcttcg

SEQ ID NO: 12792 - protein, 96 aa, Zea mays
  misc_feature: Ceres CLONE 1372611-F
MAFQADGQMPGDKTIGGGDDAFNTFFSETGAGKHVPPGWFLVTLNPLSSMKGRNWHLPPGSSPPGAASSAGKGGMEGQQPFAPGGHYTPLGKGKYG

SEQ ID NO: 12793 - DNA, 708 bp, Zea mays
  misc_feature: Ceres CLONE 1372613-F
  misc_feature: Translation starting site: 317
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (509)..(509): n is a, c, t, g, unknown, or other
  misc_feature (577)..(577): n is a, c, t, g, unknown, or other
  misc_feature (618)..(618): n is a, c, t, g, unknown, or other
  misc_feature (619)..(619): n is a, c, t, g, unknown, or other
  misc_feature (633)..(633): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
tggcggccgctctagaactagtggatcccccgggctgcaggaattcgcacgagaccattacctagaacatcctaatcgaaaagtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctaacttcctggtgttcccatccggcccnnnnttggtgggncgccgcgtcccaccttggccggcggtgcaccacgtgcgcgcctggcgccacgacagcctgccaccaancgccgcgtcgtcgctcatcgcctgggccatcacgcgctcgnnccttcggctggccngtgaaggagatccacatcggggaaaaccgcggtggnnncctgnnnnnggctggaaggccttcgtcatcatcctcg

SEQ ID NO: 12794 - DNA, 659 bp, Zea mays
  misc_feature: Ceres CLONE 1372617-F
  misc_feature: Translation starting site: 134
  misc_feature: SWISSPROT Homolog: EC 1.2.4.1 Pyruvate dehydrogenase (acetyl-transferring)
  misc_feature (269)..(269): n is a, c, t, g, unknown, or other
  misc_feature (365)..(365): n is a, c, t, g, unknown, or other
  misc_feature (415)..(415): n is a, c, t, g, unknown, or other
  misc_feature (468)..(468): n is a, c, t, g, unknown, or other
tggagctccccgcggtggcggccgctctataactagtggatcccccgggctgcaggaattcgcacgagaccattacctagaacatcataatcgaaaactgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcggaacgcggaaggctggtggcgcgtgcancaattacagcaaaggcggatgtaccatcgagcacgtccgacggccatgaggtcttgctgtttgaagctcttcgtgaggccttgatggaagagatgnaattagatgcaacagtgtgtgtatttggtggagaatgtggccattacggntggtcttaccaggtgacaaaaggtttggctgatacgttttgagaccttcgagntctggacacccctattgcggagaactcgtttactggcatgggagtggaccgggaatgaagggctgaggcccctcgttgaaggcatgaacatgggatccctggtccttgcttacacagatctcaaataactggggatgcttcattacacttcggggggcaagtcaaatcccactgggatccgtgccccgggg

SEQ ID NO: 12795 - DNA, 696 bp, Zea mays
  misc_feature: Ceres CLONE 1372619-F
  misc_feature: Encodes the peptide sequence at SEQ ID NO. 12796
tccccgcggtggcggccgctctagaactagtggatcccccgggctgcaggaattcgcacgagaccattacctagaacatcctaatcgaaaacccgtcctcggtcctccatcagtagtaaccactcctcgtcgtctctctcgcggtctcgcctcctgcagctagcgctcgccagaaagggaaaccgcatctgctccagcctcccgtcccgtctcggcgccgccgcctgatcgaccatagcccagcgcggggcgtcgaggccgtccggggcgggtccggcgctcagatctgaggcgagtagcaagcgaagaacatgcagatgcaggtcggaggaggcgcggccgacagcccgggcgctgcggaggcggcggccgcggatgccccgcgcccgaaccgctaccagtctcataagcggcggtactggcacacgttcgggcagtacctgcgcaaccaccggccgtcgctggatatggcgcgaagaatcgctctccacgagctcgagtctcggagctacctcgaccgattatttccgtacagggaccacggcctagggtttgcgctgtatcgggcgtccagcctctattgaggcaagctaagacgcagtggacttcaaatacagagtctcactccgaggatgaggaaggctaaagagaatgctactttgacgaatcaaccggcgcgtttgggagggatgttac

SEQ ID NO: 12796 - protein, 90 aa, Zea mays
  misc_feature: Ceres CLONE 1372619-F
MQMQVGGGAADSPGAAEAAAADAPRPNRYQSHKRRYWHTFGQYLRNHRPSLDMARRIALHELESRSYLDRLFPYRDHGLGFALYRASSLY

SEQ ID NO: 12797 - DNA, 717 bp, Zea mays
  misc_feature: Ceres CLONE 1372636-F
  misc_feature: SWISSPROT Homolog: EC 3.4.25.1 Proteasome endopeptidase complex
  misc_feature (713)..(713): n is a, c, t, g, unknown, or other
ccccgcggtggcggccgctctagaactagtggatcccccgggctgcaggaattcgcacgagaccattacctagaacatcctaatcgaacttccctagttgctaaatccggtggctccaccacctccaactcgtgtatctaccccaccccgacctttgccctgttcacccccttctcccgtttctcaccacaaccaccgctccacctgctcgaccatcccctgaggcaatgactgtctatccacgtcggacaccctgctctctgtcgcatacaacatcgtctggcagctgcactgcttcatctgtgacctgcctgatgatggtcaaataccctcttctgagtccttggtgaaattaatgatcttttcaacaacctatttgccgaaaatagtgctataccaacaccaccctcgcgctaggatgagctggccctgacatgactgacctcctctacgataccatggactactaccgcttcttctctatatcacgactacaatgtgatcggtgaggttgacgccgacaacaacttctgtcgtgttcactatgacgttgtaggttcctacgatgaactgtgccatgaccgtctcggaactgtagtctatttgtgttatgccactcctgggctacctcctattatcagcatagtcctctatgaatcctgtcccagggatgcttctctccttctgtagcagctgactgcgcgaatgtaaantaaa

SEQ ID NO: 12798 - DNA, 657 bp, Zea mays
  misc_feature: Ceres CLONE 1372638-F
  misc_feature: Translation starting site: 312
  misc_feature: Pfam Name: Oxidored_q6 Pfam Description: NADH ubiquinone oxidoreductase, 20 Kd subunit
  misc_feature: SWISSPROT Homolog: EC 1.6.5.3 NADH dehydrogenase (ubiquinone)
  misc_feature (463)..(463): n is a, c, t, g, unknown, or other
  misc_feature (607)..(607): n is a, c, t, g, unknown, or other
tggcggccgctctagaactagtggatcccccgggctgcaggaattcgcacgagaccattacctagaacatcctaatcgaaaaataatagcaaatctctcgagctcctagaagccatccccaaatcggcctacgcccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcgcgtcccgctacgacttcgaccgggntcggcgtcatcttccgtcccgtcgcgcgccagtccgattgcaggatcgtcgccggcacgctcaccaaacagatggctccagccctccgcaagggttatgaccaatgctgaagcctaaggtgggttatttcaatgggcagctgtngccaacggggggtggatataccattactcctactctgtgggaaccgggaa

SEQ ID NO: 12799 - DNA, 705 bp, Zea mays
  misc_feature: Ceres CLONE 1372640-F
  misc_feature: Encodes the peptide sequence at SEQ ID NO. 12800
  misc_feature (562)..(562): n is a, c, t, g, unknown, or other
  misc_feature (577)..(577): n is a, c, t, g, unknown, or other
  misc_feature (641)..(641): n is a, c, t, g, unknown, or other
  misc_feature (648)..(648): n is a, c, t, g, unknown, or other
  misc_feature (649)..(649): n is a, c, t, g, unknown, or other
  misc_feature (680)..(680): n is a, c, t, g, unknown, or other
  misc_feature (681)..(681): n is a, c, t, g, unknown, or other
cgctctagaactagtggatcccccgggctgcaggaattcgcacgagaccattacctagaacatcctaatcgaaaaacgatcacacaccactccacagcagtagcaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgatcgccgaggcgaggaacatcaagaccacgacgacggagaagaaggacgacgcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagcctacccgggttcagcttgcccggcagcggcagcatgcccctcttcggcggcggctccccgggctcanggggcttcggcgggnaagtgccgggtcccccacgcgcggctccgtccccgagcacgccaacaagccctgacgccaaccnacgtggnnaaaaaagagtggtgctactgttactgggaannacgtcgtcgctcatgggatggggg

SEQ ID NO: 12800 - protein, 154 aa, Zea mays
  misc_feature: Ceres CLONE 1372640-F
  misc_feature (107)..(107): Xaa is any aa, unknown, or other
  misc_feature (112)..(112): Xaa is any aa, unknown, or other
  misc_feature (133)..(133): Xaa is any aa, unknown, or other
  misc_feature (136)..(136): Xaa is any aa, unknown, or other
  misc_feature (146)..(146): Xaa is any aa, unknown, or other
MARSSKMMVAAALLALALAVSIAEARNIKTTTTEKKDDAVVQPQTFPPFDRLGGGASPAFGGLPGGSIPGSSIPGFSMPGSGSSLPGFSLPGSGSMPLFGGGSPGSXGFGGXVPGPPRAAPSPSTPTSPDANXRGXKRVVLLLLGXTSSLMGWG

SEQ ID NO: 12801 - DNA, 679 bp, Zea mays
  misc_feature: Ceres CLONE 1372645-F
  misc_feature: Translation starting site: 292
  misc_feature: SWISSPROT Homolog: EC 5.3.4.1 Protein disulfide-isomerase
  misc_feature (473)..(473): n is a, c, t, g, unknown, or other
  misc_feature (474)..(474): n is a, c, t, g, unknown, or other
tggagctccccgcggtggcggccgctctagaactagtggatcccccgggctgcaggaattcgcacgagaccattacctagaacatcctaatcgaaaagtggattgtactgttctcagtggattaatagaattggacgctggagatagacccgccggagaagatggcctgcccactgctcacagtagtctagtccctgcccaccaagtacggatctcatctcaccagctgcctgtgcagcagtccaattcctcttgctggagcataccagaagcagaatcgggtgagaggaaatgggatcaacaagaacgtctcatccatctttcccggtcctcctgctcttcctcctcgctaccgccgccgccgccggaagcaacaaggctgaggaggtggacgacctccagtaccttattgacaactccgaagacatcccacccaacgaccctgacgggtgccctggagggggcggcggcgnncggcgactacaacgacgaccttctcttccaagatcaggaccaggacctcccagactacgagccgcagatcgacgagacccacgtcggggtcctcaccgccgccaacttctcctccttcctcgccgccacccgccatgtcatgggtgagttctaccccccctggtggtgcccactgccgcgagctcgcccctggatacgcccgccg

SEQ ID NO: 12802 - DNA, 861 bp, Zea mays
  misc_feature: Ceres CLONE 1372652-F
  misc_feature: Encodes the peptide sequence at SEQ ID NO. 12803
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (9)..(9): n is a, c, t, g, unknown, or other
  misc_feature (23)..(23): n is a, c, t, g, unknown, or other
  misc_feature (29)..(29): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
nnnnggggnaacggaacgaaacnacaggntaannnnnnnccnnnnnnnnaaagctggagctccaccgcggtggcggccgctctagactagtggatcccccgggctgcaggaattcgcacgagaccattacctagaacatcctaatcgaaaaaaacacgccctatgagggccctcgtccggatccaccctgcccacggccatctccaccggatccttcctccacacctcatcaaccgccgcctccaagaccctagtaccgaaccccaacctcgtcccgctccggctcgtccgccactttccggccatggccgccaccgccgcagacgagttcgtgaagggccgcgtcttccccaacgggcgtcccgtcatcacgttcgaccgaccccaggggccctcaacgccatggaaccccaaaattggatgttaaataccagggcacctccttggatgaaagggggaaaccaaatccccagtgggcaaaggggtatttctttgtgggaaaaaggagcttcctccctccggggccttcccccccccagggggaatgggaaaattaaagaggggggtttgcccccgggggaaaattccccaacaaaggacccaaaaaacacccccccacttgtgggccaaaaaagggttttttccccaggcaagaagacccccccctctactttcggcaaaaacaaaccgtggagttattgtcccaaacccccttaaaaaattgcccttgcgagcggacggacgacggaacccatcgcgcatattctcaaaatgggcgcttattcagagggctgtgggcgcgtcatccccgcgttttttttagagagaaagatcctctctctaacccctggcctcgaaaaa

SEQ ID NO: 12803 - protein, 40 aa, Zea mays
  misc_feature: Ceres CLONE 1372652-F
MAATAADEFVKGRVFPNGRPVITFDRPQGPSTPWNPKIGC

SEQ ID NO: 12804 - DNA, 694 bp, Zea mays
  misc_feature: Ceres CLONE 1372655-F
  misc_feature: Encodes the peptide sequence at SEQ ID NO. 12805
  misc_feature (258)..(258): n is a, c, t, g, unknown, or other
  misc_feature (262)..(262): n is a, c, t, g, unknown, or other
tccccgcggtggcggccgctctagaactagtggatcccccgggctgcaggaattcgcacgagaccattacctagaacatcctaatcgaaaaaatacgaggcctggcctaccacctgcgacaaaccagtcaccgcctaccaccgttttataatccacccctcccactccccctgttttttcttcttccgctgttctactccggcgtgttggtcgacggcggcgcagatgacgaccctcgatctgatgggagggtacggncggntggacgagcaggtggccatccaggagggcgccacggcggggctgcgcgggatggaacctctcatcttgcagctctcccaggctggcaccggggagcggtccttgtcccggccgggggtacaggcgcaccccccagcaacagaggcagctgggacagatccagcagcaggttgactggcgggagctcacggaaatgacgggggtccaggtcaagaaggggatctccatccttgaacggacgggggcaacgcgcggtttcgggggggccccggggcggcggggtccccaatcccagtcccaaggaccttgcttccccccgagcccgggaaaatcggggccgggttccccccggggaggccccctgacgttggacttcaccaaggcgggggtccggttaaaacagggaactcccgggtttcaggggtgcgcgggg

SEQ ID NO: 12805 - protein, 69 aa, Zea mays
  misc_feature: Ceres CLONE 1372655-F
  misc_feature (13)..(13): Xaa is any aa, unknown, or other
MTTLDLMGGYGRXDEQVAIQEGATAGLRGMEPLILQLSQAGTGERSLSRPGVQAHPPATEAAGTDPAAG

SEQ ID NO: 12806 - DNA, 673 bp, Zea mays
  misc_feature: Ceres CLONE 1372658-F
  misc_feature: Encodes the peptide sequence at SEQ ID NO. 12807
  misc_feature (495)..(495): n is a, c, t, g, unknown, or other
tggagctccccgcggtggcggccgctctagaactagtggatcccccgggctgcaggaattcgcacgagaccattacctagaacatcctaatcgaaaagttatatctcctcaaggcacgttcaccacagtcctctctttccccggcaccaccaccacccaggctaaccggactggaccgagtgttgaacaacactgagggcgaggcagatagagcgacggcaggcatggtgagccgtgaaaatttgcacctggtgctggacccggcgtctctgggcgcgccgtgggccgacccgtccgccgcagagatcccgccgcagctcctcgccgcgctgggagagtacctctcctccacccgcgccgagggcggcgacgtcgcgacggaggcggacgacgagttcatgatgcacgacttcaaggtgcggcggtgcgcgcgcgcgcgtagccacgactggacggcgtgcccctacgcgcacccgggggatgccgcgcggcggngttaaccccgccgggtgccctacgcgggagaagcgtgcccggaattccggtgccggcccggcgggggagcccaggtgcacgcgcgggggcgcctgccctctcgcccacggggccgagaggtttgggaaccccccctctccggtaaagaaaaagaccatggaggttggctacacgcctg

SEQ ID NO: 12807 - protein, 90 aa, Zea mays
  misc_feature: Ceres CLONE 1372658-F
MVSRENLHLVLDPASLGAPWADPSAAEIPPQLLAALGEYLSSTRAEGGDVATEADDEFMMHDFKVRRCARARSHDWTACPYAHPGDAARR

SEQ ID NO: 12808 - DNA, 728 bp, Zea mays
  misc_feature: Ceres CLONE 1372669-F
  misc_feature: Translation starting site: 251
  misc_feature (705)..(705): n is a, c, t, g, unknown, or other
  misc_feature (728)..(728): n is a, c, t, g, unknown, or other
tccccgcggtggcggccgctctagaactagtggatcccccgggctgcaggaattcgcacgagaccattacctagaacatcctaatcgaaaaatctagtcatctcgtctcaggttgcgggcgaaccagagccccgtcccaactccaccacctctcttctctacggcgcgagcaagggcggcgccggccgcggcgtcggcgggaaccgggcctcgctctccccatctctccgatcacttctgtcctgtgaaaatggcggatgaactacgctcaacgtctgtgggtcagaagttccatgggcagtccgtgctgttgagcagaatctcttcctattccgccatgaacaaccctgtattcaacaatgcctattctgctgacaatgtgccccagagggcatatcatgggatgaatgcaactgctggactctcatctggcatgggaccatctcctgtctttgcttctgccccaaaagagaaaggcttttctggatttatgatcgactttatgatgggggggagtttctgctgctggctccaagaacagctgcagctccgattgagcgggtcaagcttttggatccaaaaccaggagaaatgctccaaactggcaggcttctctgaaccgggacaagggtatttggggacctggttttggccgcacaatcaaaagaaggagggtttttggcctcacctgtggaagaggaaacncagcttaatggccacaccgttan

SEQ ID NO: 12809 - DNA, 680 bp, Zea mays
  misc_feature: Ceres CLONE 1372671-F
  misc_feature: Encodes the peptide sequence at SEQ ID NO. 12810
  misc_feature (391)..(391): n is a, c, t, g, unknown, or other
  misc_feature (495)..(495): n is a, c, t, g, unknown, or other
  misc_feature (507)..(507): n is a, c, t, g, unknown, or other
  misc_feature (589)..(589): n is a, c, t, g, unknown, or other
  misc_feature (606)..(606): n is a, c, t, g, unknown, or other
  misc_feature (642)..(642): n is a, c, t, g, unknown, or other
tccccgcggtggcggccgctctagaactagtggatcccccgggctgcaggaattcgcacgagaccattacctagaacatcctaatcgaaaaaaaaacagtacttgtcccgccccacgtcgcagcgccgtgtccctctcgccttcttccccaccccaccctaccctggcacccacgcgctcttcagatcagatcggcaaggccaatcccgagcagtggtgcgaaacctcgagcgctcgcgccggtgaccataacaaagaggaagccgcggtagcactggtagcggcagcagtaagggggagatgtcgtcggcgttcagcggcgatgagaccgcccctttctttcgcttccttggcgcctccgctgcgctcgtcttctcatgcatgggggcgncgtacgggacagccaagagtggcgtcggcgtggcgtccatgggtgtcatgcgcccagagctcgtcatgaagtccatcgtgcccgtggtcatggctggtgtgctncgaatctacggnctcatcatcggcgtcatcatcaggactgggatcaaccccagggcagccatactacctctttgacgcttatgccaactggcgnctgggcttggctggggnctggctgggctggctgaagcatggcattggaatccntgggaaagctggggtcaggccaacccctcaaaaccaaa

SEQ ID NO: 12810 - protein, 89 aa, Zea mays
  misc_feature: Ceres CLONE 1372671-F
  misc_feature (14)..(79): Pfam Name: ATP-synt_C Pfam Description: ATP synthase subunit C
  misc_feature: SWISSPROT Homolog: EC 3.6.3.14 H(+)-transporting two-sector ATPase
  misc_feature (31)..(31): Xaa is any aa, unknown, or other
MSSAFSGDETAPFFRFLGASAALVFSCMGAXYGTAKSGVGVASMGVMRPELVMKSIVPVVMAGVLRIYGLIIGVIIRTGINPRAAILPL

SEQ ID NO: 12811 - DNA, 725 bp, Zea mays
  misc_feature: Ceres CLONE 1372674-F
  misc_feature: Encodes the peptide sequence at SEQ ID NO. 12812
  misc_feature (481)..(481): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (588)..(588): n is a, c, t, g, unknown, or other
  misc_feature (684)..(684): n is a, c, t, g, unknown, or other
ggagctccccgcggtggcggccgctctagaactagtggatcccccgggctgcaggaattcgcacgagaccattacctagaacatcctaatcgaaaaacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctacccgcagctcttnccatctgagcagctcatcagtggcaaggagggatgcagcaacaacttcgctcgtggtcactacaccattggcaaggagatnnngtgactgtgccttgaccgcatcangaagcttgcagataattgcactggtctccagggcttcctcgtctttcaacgctgtggtgggagaacgggctctgggcttggttctctcctcctggnagcgctgtctgttgactatggcaagaagtccaagcttcggt

SEQ ID NO: 12812 - protein, 113 aa, Zea mays
  misc_feature: Ceres CLONE 1372674-F
  misc_feature (87)..(87): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYPQLXPSEQLISGKEGCSNNFARGHYTIGKE

SEQ ID NO: 12813 - DNA, 717 bp, Zea mays
  misc_feature: Ceres CLONE 1372677-F
  misc_feature: Translation starting site: 190
  misc_feature (590)..(590): n is a, c, t, g, unknown, or other
  misc_feature (598)..(598): n is a, c, t, g, unknown, or other
  misc_feature (605)..(605): n is a, c, t, g, unknown, or other
  misc_feature (627)..(627): n is a, c, t, g, unknown, or other
  misc_feature (691)..(691): n is a, c, t, g, unknown, or other
tccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcacatcaccctgttccgggggctcctgtactgggtggcgcagctgctggggtccaccgtggcgtgcttcctgctccgcttctcgacgggcgggcaggccacgggcaccttcggnctgacggncgtgtcngtgtgggaagcgctggtgctgnaaatcgtgatgaccttcggctggtgtacacggtgtacgccacggcggtggacccgaaagaaggncagctgggcacccatcgccccattgc

SEQ ID NO: 12814 - DNA, 706 bp, Zea mays
  misc_feature: Ceres CLONE 1372679-F
  misc_feature: Pfam Name: DUF581 Pfam Description: Protein of unknown function (DUF581)
  misc_feature (268)..(268): n is a, c, t, g, unknown, or other
  misc_feature (275)..(275): n is a, c, t, g, unknown, or other
  misc_feature (529)..(529): n is a, c, t, g, unknown, or other
  misc_feature (557)..(557): n is a, c, t, g, unknown, or other
  misc_feature (589)..(589): n is a, c, t, g, unknown, or other
  misc_feature (625)..(625): n is a, c, t, g, unknown, or other
  misc_feature (626)..(626): n is a, c, t, g, unknown, or other
  misc_feature (643)..(643): n is a, c, t, g, unknown, or other
aagctggagctccccgcggtggcggccgctctagaactagtggatcccccgggctgcaggaattcgcacgagaccattacctagaacatcctaatcgaaaaaaggcaactcagccaagctcgtgagagcagaggaactctctttcctcacactccaaagcagcaagaccatctggcaaagctgcgctagaggccagcatcaggccataataagccagagagcagacgaggcatggcgacgtccgtgggctgcgccttcttcttcctcnacgcggnggagccgctgggcgaggaggcggcggcggcggcagcggccagcgctggacgcctgcgcgctctgcttcaggccggtggtgcgcgacagcgacatcttcatggacaggggcgacaccccgttctgcagcggagactgccgctacgagcagatgcaccacgacgcggcggccaccgcctaacgcgggcattcaggcacacagccgggcgagggagccacggagcaagggcggctcttgtgttcgccaccaagccgnaccgggtactggccacctagagtagagncagcgcaagtgcagcgcgcgagccgaggatgntgaaggcgtgcgctgcctgttcagcaagaaaacccnntcggggagtgaagggcngcgctggccctcccggttggtgcccccactgcgcccacaactttgggacggggggtgggctaa

SEQ ID NO: 12815 - DNA, 725 bp, Zea mays
  misc_feature: Ceres CLONE 1372683-F
  misc_feature: Encodes the peptide sequence at SEQ ID NO. 12816
  misc_feature (455)..(455): n is a, c, t, g, unknown, or other
  misc_feature (503)..(503): n is a, c, t, g, unknown, or other
  misc_feature (519)..(519): n is a, c, t, g, unknown, or other
  misc_feature (642)..(642): n is a, c, t, g, unknown, or other
  misc_feature (670)..(670): n is a, c, t, g, unknown, or other
  misc_feature (690)..(690): n is a, c, t, g, unknown, or other
  misc_feature (691)..(691): n is a, c, t, g, unknown, or other
aagctggagctccccgcggtggcggccgctctagaactagtggatcccccgggctgcaggaattcgcacgagaccattacctagaacatcctaatcgaaaaacgcctcctcctccgcctcccgctcctgccgcgcgtcgccgcgttttgtcgcagtccgcgccatggcttcggggaacccctacgccgccgagctcgccgccgccaagaaggccgtcaccctcgccgccaaactctgccagacagttcaacaggatattatgcattctggcgttcaggctaaggcagacaaaagtcctgtcacagtggctgattatggatctcaaatattggtcggtttttccttaaagatggatgtatcatctggaccattttcattggtggctgaagaggactcagatgaattgagaaaagatggcgctgaagaaattttggaagatattactgaccttgtancatgaaccatctttgatgatggttcatataacatttcgtttacaaggnaaggtatactctctgncattgatgatgggaagtctgagggaggtcatctggacgacattgggtgcttgatcccgatgacggtactaaaggtttctttgagggcgacaatatgccattgcattggctctgcttgatgaangaaagtttgttttgggtgtattggcttngtccaatcttccatgtcatnncataacaacatcatggaactcttcgggagataag

SEQ ID NO: 12816 - protein, 97 aa, Zea mays
  misc_feature: Ceres CLONE 1372683-F
  misc_feature: SWISSPROT Homolog: EC 3.1.3.7 3'(2'),5'-bisphosphate nucleotidase
MASGNPYAAELAAAKKAVTLAAKLCQTVQQDIMHSGVQAKADKSPVTVADYGSQILVGFSLKMDVSSGPFSLVAEEDSDELRKDGAEEILEDITDLV

SEQ ID NO: 12817 - DNA, 721 bp, Zea mays
  misc_feature: Ceres CLONE 1372684-F
  misc_feature: Encodes the peptide sequence at SEQ ID NO. 12818
  misc_feature (569)..(569): n is a, c, t, g, unknown, or other
  misc_feature (621)..(621): n is a, c, t, g, unknown, or other
  misc_feature (624)..(624): n is a, c, t, g, unknown, or other
  misc_feature (650)..(650): n is a, c, t, g, unknown, or other
  misc_feature (696)..(696): n is a, c, t, g, unknown, or other
tccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctgacctacgtggcgctcttcatcctctgctccgcgggggcggtgcgccgcagggtcgtgctccctgtcgccccgcgagtcgccttcgtcgtcgccttggncgcgctggtgctcaccctggcgcacacgcacgagcgcaggtccatgctcgtncgnatcgtctccgtcttcttcggaccggnatgtacgctgcgccgctctcggtcatgaaatgggtgatccagaaangagcgtgaatacatgcccctgttcc

SEQ ID NO: 12818 - protein, 152 aa, Zea mays
  misc_feature: Ceres CLONE 1372684-F
  misc_feature (9)..(98): Pfam Name: MtN3_slv Pfam Description: MtN3/saliva family
  misc_feature (117)..(117): Xaa is any aa, unknown, or other
  misc_feature (144)..(144): Xaa is any aa, unknown, or other
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRRVVLPVAPRVAFVVALXALVLTLAHTHERRSMLVRIVSVFFGPXCTLRRSRS

SEQ ID NO: 12819 - DNA, 706 bp, Zea mays
  misc_feature: Ceres CLONE 1372687-F
  misc_feature (206)..(206): n is a, c, t, g, unknown, or other
  misc_feature (290)..(290): n is a, c, t, g, unknown, or other
  misc_feature (306)..(306): n is a, c, t, g, unknown, or other
  misc_feature (307)..(307): n is a, c, t, g, unknown, or other
  misc_feature (333)..(333): n is a, c, t, g, unknown, or other
  misc_feature (582)..(582): n is a, c, t, g, unknown, or other
tccccgcggtggcggccgctctagaactagtggatcccccgggctgcaggaattcgcacgagaccattacctagaacatcctaatcgaaaaagtgcccttctgtctcctatctccccggagtccccgctgcccagcccggtctcactttccagtctccgagactccgagtctcgctcgcaccccgtcccctgcagcctgtgctctnggttggagggaagtgagctgcaaggagcgcggagggggcgaagagatggaggcaaattcggcgagaagagactggcattgctgnccctgcttctcctggnngggcccgtcggcccgggctcgggggntccggggggaggatggcctgctcaccaatgtggacgtggggagggcaccaagggggggtttttaaaaactggcttctgttgctgagggggcatcccaatcccctgggttgacaacaaagggccggtttgaatcctttcccaagcccaccccgggggtggattaccccttattttcccccgggggcacctcggaaaaaggctgagaaaatatttcttcctttggaaggggtgggaaataaaaaagaggtngaaaaaataatataactttaagggcgcccgcagagtgggccaactggggggtaaagtgtgtcccccaagagggggggtccccaaaaaaaaaaatttcaaggggtggaaaaaaagaagagggggg

SEQ ID NO: 12820 - DNA, 701 bp, Zea mays
  misc_feature: Ceres CLONE 1372690-F
  misc_feature (527)..(527): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
ggagctccccgcggtggcggccgctctagaactagtggatcccccgggctgcaggaattcgcacgagaccattacctagaacatcctaaccgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctggcagcaactcggtgcttacctgggatcaaaccaagtaaggttttgggggaaaaaacccttttttttccccccccccccccncnnnnnnnnnaaaaaaaaaaaatttttttcctccccccccctctttttattagggggggggtgtttttttttaaaaaaaaaaaaaaaatataaatcccgggggtggggggtgtttcttcctaaaaaaaaaaaattttttttttttttatagggggggggggggggggggcgggg

SEQ ID NO: 12821 - DNA, 727 bp, Zea mays
  misc_feature: Ceres CLONE 1372695-F
  misc_feature (490)..(490): n is a, c, t, g, unknown, or other
  misc_feature (491)..(491): n is a, c, t, g, unknown, or other
  misc_feature (635)..(635): n is a, c, t, g, unknown, or other
  misc_feature (724)..(724): n is a, c, t, g, unknown, or other
  misc_feature (725)..(725): n is a, c, t, g, unknown, or other
  misc_feature (727)..(727): n is a, c, t, g, unknown, or other
ggagctccccgcggtggcggccgctctagaactagtggatcccccgggctgcaggaattcgcacgagaccattacctagaacatcctaatcgaaaaactcaatctctctcctctcctcgcctctccttggtgtccgtgttcacgccgtcgctagcgcctgccgcggcgaagcttctgccctccccggcgccgggctcgggtcgtcgtcggccaggcagctgctacgcgtgaacacggtcacaccagtaccacgtgacgtgaacggtgaactcgtgaagaacagagccgccactgaggaaccctagcgacggcggcgtgctaccggtgacattgtccccctcggtccctcctccatccccgacgcagcggcgccagcctgcaggaagcctattcgagacaaggtcgatctttgctgccttggcgagcttcagccgaatcaaggtcgagcatggcggcaggccagtaaatagagcaacacaaaacccttcannatcatggagacctctgcagcaaccccgacccgggccgcacaccagggcggcacttccccatcgcatcgccctcgtcgtcgttgaggctgtggaggccagcggcgcagcgcacatgcgcaatcagtggtcccatctgagcgccgncaaggagcagtggctggccgccgtttgctgacggtcgtgcccacgctccgcgctcgtcaacgtccacctctcctgcaagaacttgccgnngn

SEQ ID NO: 12822 - DNA, 672 bp, Zea mays
  misc_feature: Ceres CLONE 1372703-F
  misc_feature: Encodes the peptide sequence at SEQ ID NO. 12823
  misc_feature (416)..(416): n is a, c, t, g, unknown, or other
  misc_feature (417)..(417): n is a, c, t, g, unknown, or other
  misc_feature (527)..(527): n is a, c, t, g, unknown, or other
tggagctccccgcggtggcggccgctctagaactagtggatcccccgggctgcaggaattcgcacgagaccattacctagaacatcctaatcgaaaaattcctcccaacaccacctcgcctgcgatcttcgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcaggcggtgtgatcctcttcgaggagaccctgtaccagaagaccaaggatgnncagcccttttgttgatgtcctcaaggaggggaggcgtcctccctggcatcagggttgacaggggcaccattgagggtggtggcactgataaggagacccacacccaaggncatgacgaccttgggcagcgctgccgcaagtactacgaggccggtgcccgctttgcaaggtgcgcgctggtctcaagattggccccatggaccatcacagctttgcatcgacctgaacgctcagggtctggctcgctatggcatc

SEQ ID NO: 12823 - protein, 171 aa, Zea mays
  misc_feature: Ceres CLONE 1372703-F
  misc_feature (11)..(171): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (86)..(86): Xaa is any aa, unknown, or other
  misc_feature (87)..(87): Xaa is any aa, unknown, or other
MSAYCGKYKDELIKNAAYIGTPGKGILAADESTGTIGKRLSSINVENVEENRRALRELLFCCPGALQYIRRCDPLRGDPVPEDQGXXALLLMSSRRGGVLPGIRVDRGTIEGGGTDKETHTQGHDDLGQRCRKYYEAGARFARCALVSRLAPWTITALHRPERSGSGSLWH

SEQ ID NO: 12824 - DNA, 731 bp, Zea mays
  misc_feature: Ceres CLONE 1372704-F
  misc_feature: Translation starting site: 137
  misc_feature: Pfam Name: Transaldolase Pfam Description: Transaldolase
  misc_feature: SWISSPROT Homolog: EC 2.2.1.2 Transaldolase
  misc_feature (592)..(592): n is a, c, t, g, unknown, or other
  misc_feature (661)..(661): n is a, c, t, g, unknown, or other
  misc_feature (671)..(671): n is a, c, t, g, unknown, or other
  misc_feature (689)..(689): n is a, c, t, g, unknown, or other
ggagctccccgcggtggcggccgctctagaactagtggatcccccgggctgcaggaattcgcacgagaccattacctagaacatcctaatcgaaaaagtcttcacttccattccaccggctccgatcccaactgccatggcgctctccatctacacgcccacctcctcctccctcgtcccgccctccattcaggaggtcaggctgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgtgttcgatgatttcgagaggttcgcacccacggcggccacagtgagctcgtcgctgctgcttgggatcactgggctcccagacactaagttcaagagtgcgatagatactgcactggcagatggtgagtgcaacgcactggagaaagctgaggacaggatgtcctggtacctcaccaaggctcttgcaaatggtggcgctgaactggctcatcaagtccctggggagagnttcgaacgaaatagatgctcgggtagcttatgacacccagggcataatccacagggtacatgaactggntgatctatancaccaacatgatgtctcnactgaccccgctgttatcaaaattcctgctacatggcaggga

SEQ ID NO: 12825 - DNA, 684 bp, Zea mays
  misc_feature: Ceres CLONE 1372709-F
  misc_feature: Translation starting site: 291
  misc_feature: Pfam Name: zf-CCCH Pfam Description: Zinc finger C-x8-C-x5-C-x3-H type (and similar)
  misc_feature (476)..(476): n is a, c, t, g, unknown, or other
  misc_feature (492)..(492): n is a, c, t, g, unknown, or other
  misc_feature (684)..(684): n is a, c, t, g, unknown, or other
tggagctccccgcggtggcggccgctctagaactagtggatcccccgggctgcaggaattcgcacgagaccattacctagaacatcctaatcgaaaactttcctctccgatccggatctccccacccgctccggcgagccatcgccgcgtcgcctccacgcgaccgactacttctcatatcaatctatctatccggcttacccgccgccgcacgcaccaaggttgcgttcaccatattacctgtttgcttatcttctcccgagcccagcaaaccctagccgccgccacccatggacatagaggccgacggacgattcggcaacaaacgagtgcacaatcgcctaggcccgggctccggcggcgctccaccatctaccaacgggaaaggtctgcaactactggcgtgccggtcggtgcaaccgctttccgtgccccttcctccacagcgagctccccgaggctgcgccgcccaagcngcccactggacccggngggaacgtatggcgcaacccccacaccggaggacgaggaggtgggcatcacaatagatggggggaagggcccaggagggggcagcggggattgcgagcccacaagccgcctgagaggccctggcagtactttcttcgccggtacggaatgtacctatggcgagaggtgccgctatccggacagctactggan

SEQ ID NO: 12826 - DNA, 708 bp, Zea mays
  misc_feature: Ceres CLONE 1372710-F
  misc_feature: Encodes the peptide sequence at SEQ ID NO. 12827
  misc_feature (561)..(561): n is a, c, t, g, unknown, or other
  misc_feature (562)..(562): n is a, c, t, g, unknown, or other
  misc_feature (581)..(581): n is a, c, t, g, unknown, or other
  misc_feature (591)..(591): n is a, c, t, g, unknown, or other
tccccgcggtggcggccgctctagaactagtggatcccccgggctgcaggaattcgcacgagaccattacctagaacatcctaatcgaaaactagctagcgccgccgccgccgcagactcctccttttcgatcccttcgcaaagcgccgccgtcgccccatccggcatggctccgaagaaggataaggccccgcccccgtcgtcgaagcccgccaagtccggcggtggcaagcagaagaagaagaagtggagcaagggaaagctaaaggagaaggtgaacaacgcggtgctgttcgaccaggctacctacgacaagctgctctctgaggtgcccaagtacaagcagatcaccccctccatcctatccgagcgcctcaggatcaatggctccctggctcggagggctatcaaggacctgatggcgcgtggcctcatccggttggtctcggttcactcaagccagcagatctacaccagggcaacaaatacctaaggatgggattcccttgtttgccctctctgtaggagctcgtcttctttagaacagttggcatctctgtnncagagttgctaatgctatngtagatgagnttctcacgtggctgaaacgtttcagagagtttgcgttagtttggcttggctattataccttatctggcctcaatagcttttttctatggaaaaaaaaaaaaaaaaagcttatcgata

SEQ ID NO: 12827 - protein, 108 aa, Zea mays
  misc_feature: Ceres CLONE 1372710-F
  misc_feature (1)..(106): Pfam Name: Ribosomal_S25 Pfam Description: S25 ribosomal protein
MAPKKDKAPPPSSKPAKSGGGKQKKKKWSKGKLKEKVNNAVLFDQATYDKLLSEVPKYKQITPSILSERLRINGSLARRAIKDLMARGLIRLVSVHSSQQIYTRATNT

SEQ ID NO: 12828 - DNA, 708 bp, Zea mays
  misc_feature: Ceres CLONE 1372712-F
  misc_feature: Encodes the peptide sequence at SEQ ID NO. 12829
  misc_feature (442)..(442): n is a, c, t, g, unknown, or other
  misc_feature (500)..(500): n is a, c, t, g, unknown, or other
  misc_feature (501)..(501): n is a, c, t, g, unknown, or other
  misc_feature (519)..(519): n is a, c, t, g, unknown, or other
  misc_feature (533)..(533): n is a, c, t, g, unknown, or other
  misc_feature (667)..(667): n is a, c, t, g, unknown, or other
  misc_feature (672)..(672): n is a, c, t, g, unknown, or other
ggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatncacgggcagaccaactaccccggcgtggccggcaacggcgcgacgttctacttcctgnntgtcgccatcctggccgncgtggtgggcgcgncgtccaagctggcgggcgtgcaccacgtgcgcgcctggcgccacgacagcctggccaccaacgccgcgtcgtcgctcatcggctgggccatcacggcgctcgctttcgggctggcctgcaaggagatccacatncgcgnacaccgcggctggcgcctgcccgtgctggaagcctt

SEQ ID NO: 12829 - protein, 123 aa, Zea mays
  misc_feature: Ceres CLONE 1372712-F
  misc_feature (14)..(123): Pfam Name: AWPM-19 Pfam Description: AWPM-19-like family
  misc_feature (35)..(35): Xaa is any aa, unknown, or other
  misc_feature (55)..(55): Xaa is any aa, unknown, or other
  misc_feature (61)..(61): Xaa is any aa, unknown, or other
  misc_feature (66)..(66): Xaa is any aa, unknown, or other
  misc_feature (110)..(110): Xaa is any aa, unknown, or other
  misc_feature (112)..(112): Xaa is any aa, unknown, or other
MAGIGRNMVAPLLVLNLIMYIIVIGFASWNLNHFXHGQTNYPGVAGNGATFYFLXVAILAXVVGAXSKLAGVHHVRAWRHDSLATNAASSLIGWAITALAFGLACKEIHXRXHRGWRLPVLEA

SEQ ID NO: 12830 - DNA, 715 bp, Zea mays
  misc_feature: Ceres CLONE 1372714-F
  misc_feature: Encodes the peptide sequence at SEQ ID NO. 12831
  misc_feature (505)..(505): n is a, c, t, g, unknown, or other
aagctggagctccccgcggtggcggccgctctagaactagtggatcccccgggctgcaggaattcgcacgagaccattacctagaacatcctaatcgaaaaacacactgctcgttctcacgacaaattcgattcatcaaaatctacaaacgtagtagtatttacgagaatagatattacaggcccaaacagctgctgcttctgttgaagcacgccgcaccggcagacgttacccctccaatgggcgaatgcagaacggagtacaggggcctgcccgacgccaatggcgaggacgcggggacggtgccggccgcgctccgcaaggtgtccatagtcccgctcgttttcctcatcttctacgaggtctccggcgggccgttcggcatcgaggacagcgtgggcgcagcggggccgctcctcgccatcgtcggcttccttgtcctccccgtcatctggagcatcccggaggcgctgattaccgcggagctgggcaccatggttccggnagaacggcgggtacgtcgtggtgggtcgcctcggcgctcggcccctactggggatcccagcaagggtgggtgaaggtggctcaatggcgtcatcgacaatgccctgtaccccgtcctctttctggactactcaagtccgccgtgcttgcccttgggcgcggccccgccgagggggttcccgtgctcgaaatcccggggtggttaccctgt

SEQ ID NO: 12831 - protein, 112 aa, Zea mays
  misc_feature: Ceres CLONE 1372714-F
  misc_feature (89)..(89): Xaa is any aa, unknown, or other
MGECRTEYRGLPDANGEDAGTVPAALRKVSIVPLVFLIFYEVSGGPFGIEDSVGAAGPLLAIVGFLVLPVIWSIPEALITAELGTMVPXERRVRRGGSPRRSAPTGDPSKGG

SEQ ID NO: 12832 - DNA, 722 bp, Zea mays
  misc_feature: Ceres CLONE 1372717-F
  misc_feature (353)..(353): n is a, c, t, g, unknown, or other
ggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtanacgcgcagcagcacttcgacccggtcggccacggcctgcccctaggcgttgacatccagatccatctcgctccgatctacattcgagaagtttgtctccgacatcgattccccagtctgaatcgttgtcgacgtcttctttgggtggacggtcgaagtcacgcgcacgcacatcccacacttgttcctccccggcggtgcattcagcaacactgtctttcttctccgtgtcggagcaccctcggcccacagggcggacccgtgaacgacgttcttttcgcgtgtcacgatctccggtcgcaagctcgatgctctccccatcgacacgcgagccccttggagggggccccgactagattttactgagatt

SEQ ID NO: 12833 - DNA, 724 bp, Zea mays
  misc_feature: Ceres CLONE 1372720-F
  misc_feature: Encodes the peptide sequence at SEQ ID NO. 12834
  misc_feature (642)..(642): n is a, c, t, g, unknown, or other
tccccgcggtggcggccgctctagaactagtggatcccccgggctgcaggaattcgcacgagaccattacctagaacatcctaatcgaaaagacggaggcactactagtgtcgtaacgacgccacgacggtgtgtctgactctgatctcgcatcgcgccgaggccctccggaatcccaatcctctcctctcccgcaagcaccccgggtctgctgcagcgcctcgtctccgtggtctggcatcagagtccccgggagaatggttgctctgtcggcaggagcgctggctccgctcgcaggtctgtctccgctgccgtcgtgcagcgcggctccgttgtactgccgcaggagtccgccacttctcaatgtcgccatcgccaagacgcggccagctgttcaccaatctgctccctgcagcttccgaaaatgtgcagctatgtcagaacatggacgtcaggaactccggaccaatgagtaccagctggatgatgatgatgagccgttttggctggcagtggtcagagaccttgctgtgggtttcaagggattggtagctttcttagctgagcaggcgaggcactgaagcacctggagtgggcggctttctaccacgctgaagacggcacacttactcttgtattggnagttatggttattggtgcattatcaacaatggatgctgccctctgctacatgctgggctggctactttcaaaatctggctaa

SEQ ID NO: 12834 - protein, 107 aa, Zea mays
  misc_feature: Ceres CLONE 1372720-F
MVALSAGALAPLAGLSPLPSCSAAPLYCRRSPPLLNVAIAKTRPAVHQSAPCSFRKCAAMSEHGRQELRTNEYQLDDDDEPFWLAVVRDLAVGFKGLVAFLAEQARH

SEQ ID NO: 12835 - DNA, 651 bp, Zea mays
  misc_feature: Ceres CLONE 1372721-F
  misc_feature (357)..(357): n is a, c, t, g, unknown, or other
  misc_feature (360)..(360): n is a, c, t, g, unknown, or other
  misc_feature (404)..(404): n is a, c, t, g, unknown, or other
  misc_feature (423)..(423): n is a, c, t, g, unknown, or other
  misc_feature (434)..(434): n is a, c, t, g, unknown, or other
  misc_feature (435)..(435): n is a, c, t, g, unknown, or other
  misc_feature (509)..(509): n is a, c, t, g, unknown, or other
tccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatgntgncgccgctcctggtgctcaacctcatcatgtacatcatcgtcatncgcttcgcgagctgaaccntgaaccacttnncatcacggcagaccaactacccccgcgtggcccgcaccggcgcgacgttctactccctggtgtcgccatcctgnccggcgtggtggggcgcgcgtccagcttgcgggcgtgcacacgtgcgcgcctggcgcacgacagctggccaccagcgccgcgtcgtgctcatcgcctgggcatcacgcgctcgccttcggcttgcctggaaggagatccact

SEQ ID NO: 12836 - DNA, 713 bp, Zea mays
  misc_feature: Ceres CLONE 1372723-F
  misc_feature (296)..(296): n is a, c, t, g, unknown, or other
  misc_feature (343)..(343): n is a, c, t, g, unknown, or other
  misc_feature (348)..(348): n is a, c, t, g, unknown, or other
  misc_feature (354)..(354): n is a, c, t, g, unknown, or other
  misc_feature (403)..(403): n is a, c, t, g, unknown, or other
  misc_feature (410)..(410): n is a, c, t, g, unknown, or other
  misc_feature (516)..(516): n is a, c, t, g, unknown, or other
ggagctccccgcggtggcggccgctctagaactagtggatcccccgggctgcaggaattcgcacgagaccattacctagaacatcctaatcgaaaaaacgaagaaccgaatgcccagtcctgaatcacgtcttcacccgtgctcgtgcgctgcgcccatcccttccgcctccacgctccccacgtgcaccgtgcacagcaccacacagccaggtccccatggcggcggcggcggcgtttgcgtctgcgacgacggcggaagagaagcgcgcctgctgcgcctggagaagcaggcgnagcaaacgcggcgcggcgcctgggaaatactctgcctcgcccgcggnttcgngcccgncgccccgttcaacgtctccgggggggctcgcccctcctcacaaacgctncgcgcgntcccggcttgctcagaacagtggacgctctacgagcagtgggcacggcggcatggattgcagcgttcgatggggaaaggactgtattggagtccttcaaacaattnctgggaacacacgggttgcccggtaaagctcgtctgtttaaccaaaagtgaatggctgaaactgaaaggcctacccgctatcctgaaaaaaatccatttgacaaattgcccacaaaggaaaatgctatcccaaaccacaggggggattgccaaagggattattatcccaaaagattcgggatttgttaatgctgaaa

SEQ ID NO: 12837 - DNA, 665 bp, Zea mays
  misc_feature: Ceres CLONE 1372726-F
  misc_feature: Translation starting site: 185
  misc_feature (202)..(202): n is a, c, t, g, unknown, or other
  misc_feature (322)..(322): n is a, c, t, g, unknown, or other
  misc_feature (335)..(335): n is a, c, t, g, unknown, or other
  misc_feature (338)..(338): n is a, c, t, g, unknown, or other
  misc_feature (345)..(345): n is a, c, t, g, unknown, or other
  misc_feature (356)..(356): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (394)..(394): n is a, c, t, g, unknown, or other
  misc_feature (395)..(395): n is a, c, t, g, unknown, or other
  misc_feature (398)..(398): n is a, c, t, g, unknown, or other
  misc_feature (399)..(399): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (409)..(409): n is a, c, t, g, unknown, or other
  misc_feature (410)..(410): n is a, c, t, g, unknown, or other
  misc_feature (439)..(439): n is a, c, t, g, unknown, or other
  misc_feature (462)..(462): n is a, c, t, g, unknown, or other
  misc_feature (574)..(574): n is a, c, t, g, unknown, or other
tccccgcggtggcggccgctctagaactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttncagaaacgcgcagctctggtgattattgtggccattattagctcgctgcagctgctcctgatactgctcaaaaagctggaggagacacgagggtgtgtcgtcgtcatcctcgccggccgntggtcgtggtggnggngccgtcntctcccgacgngcgatgggcgacgtcgnnnnnnnnnnttttttttcggnnaannannnnnnntnnttgttttacccaaaaaacgccaccctctntggcccacggattcccggctaanccggaaatattcaggttggggggaggtgcaccctggaaaaattgaactttctgggggattccctcccggagtcgtgaccggcaatttcaggggtcccttcaaagatgggttntaaggggggccccccttgaacccagggaccctttccttcaaaatccaattcctccccaaccattaggggcccctccggccgggcccataaa

SEQ ID NO: 12838 - DNA, 657 bp, Zea mays
  misc_feature: Ceres CLONE 1372734-F
  misc_feature: Encodes the peptide sequence at SEQ ID NO. 12839
  misc_feature (267)..(267): n is a, c, t, g, unknown, or other
  misc_feature (350)..(350): n is a, c, t, g, unknown, or other
tccccgcggtggcggccgctctagaactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgccatgccgggcctcgccgcctccgacaactcgcccccggcgccggcgccgccgccgcgccggntctcgtcgccgctaccccgtcgcgcgccgtcgtccccgtcgccgtccgcctcctcgcgcgcaaagctcggaagccctcgcccntctccgcgggcttccccacgacgccgacgactcgctcgacaacccggatctggggcccttcctccctcagcaggcgcgcgacgccatggtgtcgagcgaggggcggtgcgccgcgcgcgcactcgagttcgccgagcgcgcccgcatggcgctcgagcgacccggcgagggcgccgagctcaagctcgcctgaacctccacgtcggcggccgcatccacgggcggctcggcggccaggtgaagccctccccgtcctcgaggggggccgtcgcagtcttccccccgccgccagaaggggctggcgaag

SEQ ID NO: 12839 - protein, 35 aa, Zea mays
  misc_feature: Ceres CLONE 1372734-F
MVSSEGRCAARALEFAERARMALERPGEGAELKLA

SEQ ID NO: 12840 - DNA, 643 bp, Zea mays
  misc_feature: Ceres CLONE 1372735-F
  misc_feature: Translation starting site: 191
  misc_feature (344)..(344): n is a, c, t, g, unknown, or other
  misc_feature (362)..(362): n is a, c, t, g, unknown, or other
  misc_feature (403)..(403): n is a, c, t, g, unknown, or other
  misc_feature (576)..(576): n is a, c, t, g, unknown, or other
tccccgcggtggcggccgctctagaactagtggatcccccgggctgcaggaattcgcacgagaccattacctagaacatcctaatcgaaaaaaaaactccccacgcagaaaacctagcagctcggcgctccctcttctgactccttcgaggtactcccatcgctatcgaccgggtcctcgagcgcgggagatggcggatcaggagaccccagttgcagttgaggcccctaccccggtccttggggagccgatggacttgatgactgctctgcagcttgtcatgaagaaagtcggtgctcatgatgggcccttgtaagggtcttcgtgagggctgcaaagcattngagaagcatgctgctcanctttgcgtgcttgcgaggactgtgaccagccctgatatgtncagctgggtgaggctctttgctctgagcacaacgttcacctggttactgtgcctagcgctaaactcttggcgaatgtctgggctttgcaagattgatttctgaggcaaggcgaggaaggttgtggttgctcctgtgttgtcgcaaggactatggcgaaaatctgagggcttancataggtcaggagtacgtcaagtcacactaaaacagggcatcggaatctgggacttgtgctccacct

SEQ ID NO: 12841 - DNA, 717 bp, Zea mays
  misc_feature: Ceres CLONE 1372740-F
  misc_feature: SWISSPROT Homolog: EC 1.1.1.1 Alcohol dehydrogenase
  misc_feature (609)..(609): n is a, c, t, g, unknown, or other
tcagaactagtggatcccccgggctgcaggaattcgcacgagaccattacctagaacatcctaatcgaaaaacgggctcatctcgctttggatcgattggtttcgtaactggtgagggactgagggtctcggagtggattgattttggattcctgtccgaagatttgcggagggggcaatgggcaacgcggggaaggggatcaagtgcaaagctgcggtggcatgggaggcccggaagcccactggcgatcgaggagggggaggaaccgcctccccagcccatgggaggggcccgtcaagatcctcttcacctccgttctggcacaccgacttctactttctggaaggccaggggggagactccccgtgttcccctcggatcctttggcccacgaggttgaaggtattcataaaaaaggtgtttgaagaagggtgtgatttgaaggtaactcccgggggacccatggccttccctggggtgcccctgggggaggggcaaaggaagggggcccccttggcaaggccgggcaaagaagcaaacattgtgtggatctggctccaggaatcaacacccggacgcgggggggtggatggattgcccaaatggcnaaagccccccggtttttcaactggggggggaacgcctatcctccccccttgttggtgggactttccccccttcgggcggagaaaccccgttttggcatgggggggttc

SEQ ID NO: 12842 - DNA, 646 bp, Zea mays
  misc_feature: Ceres CLONE 1372743-F
  misc_feature: Translation starting site: 206
  misc_feature: Pfam Name: DEAD Pfam Description: DEAD/DEAH box helicase
  misc_feature (527)..(527): n is a, c, t, g, unknown, or other
  misc_feature (545)..(545): n is a, c, t, g, unknown, or other
cgctctagaactagtggatcccccgggctgcaggaattcgcacgagaccattacctagaacatcctaatcgaaaacttttttccccgctcttctcccacacaaacgccaccgccgcatcgaatccgagacgccgatctcggattcgccgtcaccacacgctgccctcgtcgcgctctcccgccgccgccgctcgtctcgtcagccatggcaggattggcaccagaagggtcgcaatttgatgacaagcagtatgacaagaaaatgcaggagatattaactgaagacttcttcacttcatatgatgatgtttgtgaaagttttgacagcatgggactgcaggagaaccttctgagaggcatctatgcctatggttttgagaagccatcggctattcagcagagggggataggtccctttctgcagggggcttgacgtgattcagcaggctcaggctggaactggaaaaacagctaccttctgttctggaatctttgcagcacttgattatggattggttgaatgccangcattggttcttgctccnacccgtgagcttgctcacaaattgagaaggtatgcgtgctctggggactatttgggtgcaagtgcatggctggggtgggggacatctggtcggaggaccag

SEQ ID NO: 12843 - DNA, 668 bp, Zea mays
  misc_feature: Ceres CLONE 1372747-F
  misc_feature: Encodes the peptide sequence at SEQ ID NO. 12844
  misc_feature (423)..(423): n is a, c, t, g, unknown, or other
tccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactncacccgcccccggctcagcctcatccccagccacacccatgcccgtgcccacagccgcatccaagccccgtgcagctgcagggaaccctgcggcgttgcagcaccccgatcctgggccagtgcgtcgagtttctgaggcatcagtgcagcccgacggcgacgcctactgctcgcctcagtgccagtcgttgcggcagcagtggtgccagcagctcaggcaggtgggagcgcaacaccggtaccag

SEQ ID NO: 12844 - protein, 69 aa, Zea mays
  misc_feature: Ceres CLONE 1372747-F
MPVPTAASKPRAAAGNPAALQHPDPGPVRRVSEASVQPDGDAYCSPQCQSLRQQWCQQLRQVGAQHRYQ

SEQ ID NO: 12845 - DNA, 675 bp, Zea mays
  misc_feature: Ceres CLONE 1372748-F
  misc_feature: Encodes the peptide sequence at SEQ ID NO. 12846
  misc_feature (462)..(462): n is a, c, t, g, unknown, or other
  misc_feature (490)..(490): n is a, c, t, g, unknown, or other
  misc_feature (523)..(523): n is a, c, t, g, unknown, or other
  misc_feature (651)..(651): n is a, c, t, g, unknown, or other
gagctccccgcggtggcggccgctctagaactagtggatcccccgggctgcaggaattcgcacgagaccattacctagaacatcctaatcgaaaacttttgagaactccccttctccgccactaccgaagcccttgtacccctcaccgccgccgctgctgctagggagcttccatccgcgcgcgcctacaacgagagctagcagcggtagcggccgttatcttgtcgctccggctccgttcgtgtacccaagtcccagcctagatgccgcagatggaggggtccactgatcagatcgccgccggctggttcgctaagggagccggcttccgagcgggccgtgggcttgccgaggaccggctcttccagtcgcctcaacgcgcaggcgccggagttcgtgccgcgggggccgccgccaccggcgccggcggttgtgctgccgcctcccgcgcaggtgatccgnatggtcgccgcgcctccccccgccgcgngtgggggcttcttctccgcgccgcagccccggncgttcgagtactatgcggctatcggtgaacgcagcggatttgctgccaaggagcaacaggcgccggagctggaagcgggatgctcccgccccgcgcggtgaagacggagccgggggtggatgggctcnaccacgaggtggtgcacaggatcc

SEQ ID NO: 12846 - protein, 95 aa, Zea mays
  misc_feature: Ceres CLONE 1372748-F
  misc_feature (67)..(67): Xaa is any aa, unknown, or other
  misc_feature (76)..(76): Xaa is any aa, unknown, or other
  misc_feature (87)..(87): Xaa is any aa, unknown, or other
MPQMEGSTDQIAAGWFAKGAGFRAGRGLAEDRLFQSPQRAGAGVRAAGAAATGAGGCAAASRAGDPXGRRASPRRXWGLLLRAAAPXVRVLCGYR

SEQ ID NO: 12847 - DNA, 636 bp, Zea mays
  misc_feature: Ceres CLONE 1372751-F
  misc_feature: Encodes the peptide sequence at SEQ ID NO. 12848
aagctggagctccccgcggtggcggccgctctagaactagtggatcccccgggctgcaggaattcgcacgagaccattacctagaacatcctaatcgaaaaactcttcgcttcgactcccactcccactctccctttccactctcaggctcccactccccccctaccggctaccctacccatcacacacaaacagccactcctcacctcccccgtcctccggttcatgtcctgctgctccccatgtcgcccccactcgacctcgactacataggcctctcgccggcggcggctgccgccgctgcccacgacgacctgaaggggtaccgagctccgccttggtctgccggggtccggttcgcccgacgccgtgttggggctgcaccgcaacaccctggacctgctcccggctaggggcgccaaggcgcgggttttctgacgaggcgcgacgcatcgcccggggcagctcccgggaaggaaaagagggtaccggagaggaggaccaccagaaggttgcagcaaacccccaaccggtcccaaaagctcaggggggggggatgccccaccaatcccaaagctaccccgcaggaaaacgaatgcctaccccccccactttaaaggggaaccaaagggggga

SEQ ID NO: 12848 - protein, 56 aa, Zea mays
  misc_feature: Ceres CLONE 1372751-F
MSPPLDLDYIGLSPAAAAAAAHDDLKGYRAPPWSAGVRFARRRVGAAPQHPGPAPG

SEQ ID NO: 12849 - DNA, 687 bp, Zea mays
  misc_feature: Ceres CLONE 1372752-F
  misc_feature: Encodes the peptide sequence at SEQ ID NO. 12850
  misc_feature (687)..(687): n is a, c, t, g, unknown, or other
aagctggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcaatgcagtcgttgcgccccgtgagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaaggcgacgcgcgtctcatcggggtggagtacatcgtgccgaggaagatcttcgactcgctgcccgcggaagagcagcggctgtggcactcgcacgcgcacgaaatccagtcagggcctgtggacgagcccgcacgtggcggggcttcctgaagaaagcggagctggacacatggcccgcaccttccggaaagttctggggcacctgggagggggaccggggcgaccgcctggcgggtgggcgcccccggggtn

SEQ ID NO: 12850 - protein, 87 aa, Zea mays
  misc_feature: Ceres CLONE 1372752-F
  misc_feature (1)..(86): Pfam Name: DUF1264 Pfam Description: Protein of unknown function (DUF1264)
MCTFALYAHDPKRQVETHHYVSRLNQDFLQCAVYDSDKGDARLIGVEYIVPRKIFDSLPAEEQRLWHSHAHEIQSGPVDEPARGGAS

SEQ ID NO: 12851 - DNA, 648 bp, Zea mays
  misc_feature: Ceres CLONE 1372753-F
  misc_feature: Translation starting site: 257
  misc_feature: Pfam Name: DUF642 Pfam Description: Protein of unknown function, DUF642
  misc_feature (216)..(216): n is a, c, t, g, unknown, or other
  misc_feature (243)..(243): n is a, c, t, g, unknown, or other
  misc_feature (244)..(244): n is a, c, t, g, unknown, or other
  misc_feature (260)..(260): n is a, c, t, g, unknown, or other
  misc_feature (296)..(296): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (327)..(327): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (336)..(336): n is a, c, t, g, unknown, or other
  misc_feature (337)..(337): n is a, c, t, g, unknown, or other
  misc_feature (339)..(339): n is a, c, t, g, unknown, or other
  misc_feature (354)..(354): n is a, c, t, g, unknown, or other
  misc_feature (363)..(363): n is a, c, t, g, unknown, or other
  misc_feature (365)..(365): n is a, c, t, g, unknown, or other
  misc_feature (366)..(366): n is a, c, t, g, unknown, or other
  misc_feature (532)..(532): n is a, c, t, g, unknown, or other
ggagctccccgcggtggcggccgctctagaatagtggatcccccgggctgcaggaattcgcacgagaccattacctagaacatcctaatcgaaaaagtgcccttctgtctcctatctccccggagtccccgctgcccagcccggtctcactttccagtctccgagactccgagtctcgctcgcaccccgtcccctgcagcctgtgctctgggttgnaggaaggtgagctgcaaggaagcgcgnnaggggcgaggagatgnaggcagattcggcgaggaagagacttgcattgctgnccctgctttctctggnnngcgccgtccgccngnnnctcgnngnctcgggtggagatgncctgctcancnnatgtgactttgagacagcaccaagtggtggtttttaaaatctgcttctggtggtgagggtgcatcgtcaatccctggttggacgatcaacggcacggttgaactcatttcagcaggccaacaccagggtggcatgatcctgattggtccacagggggaccatgcantaagggctagggaatgatgctaccgtttggcaggtggtggacgttgagaaaggttcggagtattctatcaattcagggctgcccggaatgtgcacaactggaggccttaatgtttc

SEQ ID NO: 12852 - DNA, 687 bp, Zea mays
  misc_feature: Ceres CLONE 1372754-F
  misc_feature: Translation starting site: 129
aagctggagctccccgcggtggcggccgctctagaactagtggatcccccgggctgcaggaattcgcacgagaccattacctagaacatcctaatcgaaaaagaagtggaaggaagcaggcggccaccatggtgaagggacgcacgggacagcgcgtcaggctctacgtccggggcaccatcctcggatacaagaggtccaagtcgaaccagtacgagaccacgtcgctcattcagatcgagggggtgaacaccaaggaggacgtcgcgtggtacgctggcaagcgcatggcgtacatcctacaaggctaaagacaagagcagcgagacccgctacaggtgcatctggggcaaggtcacccgcccgcacgacaactcgggcggcggccgcgccaagttcaagtcccaccctcccgcctgagtccatggggcgcagggtagagtgttcatgtacccgaacagcatctaaggttaggtttttggttggagaaaaggtggactctaaatggccatgctttatttcttctctctgaacttaaaatgccatgggttggcaactaagatgggtcatggactgaacctggtgaaattctacaaaaatttgttgcccaacgggttaaaaagttgcccaaagggtatggtaaaaaaagaagtttatttcccccccgggccatcgctggaatgatgg

SEQ ID NO: 12853 - DNA, 689 bp, Zea mays
  misc_feature: Ceres CLONE 1372756-F
  misc_feature: Encodes the peptide sequence at SEQ ID NO. 12854
  misc_feature (273)..(273): n is a, c, t, g, unknown, or other
  misc_feature (276)..(276): n is a, c, t, g, unknown, or other
  misc_feature (284)..(284): n is a, c, t, g, unknown, or other
  misc_feature (292)..(292): n is a, c, t, g, unknown, or other
  misc_feature (299)..(299): n is a, c, t, g, unknown, or other
  misc_feature (307)..(307): n is a, c, t, g, unknown, or other
  misc_feature (360)..(360): n is a, c, t, g, unknown, or other
  misc_feature (394)..(394): n is a, c, t, g, unknown, or other
  misc_feature (480)..(480): n is a, c, t, g, unknown, or other
  misc_feature (538)..(538): n is a, c, t, g, unknown, or other
  misc_feature (567)..(567): n is a, c, t, g, unknown, or other
  misc_feature (593)..(593): n is a, c, t, g, unknown, or other
tccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtancancccacggnccgggcgnaggacgnagtggtcnaacgggaccgcagggaggacctgcggtggtgcaaagcagcgtgcgagtggcantacggaaaggacaccccgcggaagagggaatgcnagagcgagtgcccgcgagcgcaccagcaagctgactcgggcgaggacggcgacagcggcgtggacgcctacgtctcccgctccggnaaaggggcgagtgcccggcgccagtgcctgcgcccgcacgaggggcaggccgtggagnacccaggagtggcatgaggggtgccgccngcgcgggactgggcgtcaaatggagncaagagtacggtcgcgcagccagagcgcgggcagtggcccggaagagtgcgagcgccacccccgcgggaatttgttggaaaagcaccctctggtga

SEQ ID NO: 12854 - protein, 74 aa, Zea mays
  misc_feature: Ceres CLONE 1372756-F
  misc_feature (24)..(24): Xaa is any aa, unknown, or other
  misc_feature (25)..(25): Xaa is any aa, unknown, or other
  misc_feature (30)..(30): Xaa is any aa, unknown, or other
  misc_feature (35)..(35): Xaa is any aa, unknown, or other
  misc_feature (53)..(53): Xaa is any aa, unknown, or other
  misc_feature (64)..(64): Xaa is any aa, unknown, or other
MGKGSVGASWWAFLLLAGVLLVVXXHGPGXGRSGXTGPQGGPAVVQSSVRVAXRKGHPAEEGMXERVPASAPAS

SEQ ID NO: 12855 - DNA, 660 bp, Zea mays
  misc_feature: Ceres CLONE 1372760-F
  misc_feature: Encodes the peptide sequence at SEQ ID NO. 12856
  misc_feature (244)..(244): n is a, c, t, g, unknown, or other
  misc_feature (306)..(306): n is a, c, t, g, unknown, or other
  misc_feature (344)..(344): n is a, c, t, g, unknown, or other
ggagctccccgcggtggcggccgctctagaatagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaancggcggcacctcaacatagacactaaccctagcccccgcttccccaccccttcctcctatcnaggccatgtcacctccttcttctcctcttcccccgggngctcccgccgcccgcgccctgggggggcatcactcggcagcctccacctccgggccctacctacctctgagatcgaggagcggctcgccggggtgcccgtgtacccgctcgcaaacgccgcccagaaggtcgtgcttgtgtctccacacccttgggagggcagggggccagagcgtgaatccacccccgggctcggctgctctggttccggaggaaaatcctgacccgcttctgaacaaatggatgcccatattccccccggttctggggccttcctgtcccgctgaaaaggttatccaatggagggcgggtgggg

SEQ ID NO: 12856 - protein, 115 aa, Zea mays
  misc_feature: Ceres CLONE 1372760-F
  misc_feature (8)..(8): Xaa is any aa, unknown, or other
  misc_feature (29)..(29): Xaa is any aa, unknown, or other
  misc_feature (42)..(42): Xaa is any aa, unknown, or other
MAQEPNYXRRHLNIDTNPSPRFPTPSSYXGHVTSFFSSSPGXSRRPRPGGASLGSLHLRALPTSEIEERLAGVPVYPLANAAQKVVLVSPHPWEGRGPERESTPGLGCSGSGGKS

SEQ ID NO: 12857 - DNA, 684 bp, Zea mays
  misc_feature: Ceres CLONE 1372767-F
  misc_feature: Encodes the peptide sequence at SEQ ID NO. 12858
  misc_feature (261)..(261): n is a, c, t, g, unknown, or other
aaagctggagctccccgcggtggcggccgctctagaactagtggatcccccgggctgcaggaattcgcacgagaccattacctagaacatcctaatcgaaaaacttctacctggcctcgcaggcttcgcaaggcggccacacgccgatacctcctccttcacccgctccgtcgtcccccccagccggccacgccaccatgctgccaccggccgcgcgccttgcggcccgccgcctcctcggctcgcctccgcatctgcgtncggaagcggccggccgccgggtaccttcctctccgatcgcttccgcaggctactcggccggcgcgtccaggggctccggctccagaaccaggcccttctccaggctcttaactacagccgtggctcggcggagaacaaccggaaaatgaatgggagttctcacgggcgaatataaaaaaggcaatgaaattctggctcactatccaagaaatacaagcaatctggaataattccccgtggttgaatcttgcacaacaacaagatggggggatgggtgccaatttgcaccaagggatgctatttggtaaaattggccaaaatggcaccaaaccaggggctaataaagttgccaacttccaaaaaaagggttaaaaggggacaaaggggggggaaaatacccaccttttttggggggggggaaaa

SEQ ID NO: 12858 - protein, 70 aa, Zea mays
  misc_feature: Ceres CLONE 1372767-F
  misc_feature (22)..(22): Xaa is any aa, unknown, or other
MLPPAARLAARRLLGSPPHLRXEAAGRRVPSSPIASAGYSAGASRGSGSRTRPFSRLLTTAVARRRTTGK

SEQ ID NO: 12859 - DNA, 718 bp, Zea mays
  misc_feature: Ceres CLONE 1372769-F
  misc_feature: Encodes the peptide sequence at SEQ ID NO. 12860
ggagctccccgcggtggcggccgctctagaactagtggatcccccgggctgcaggaattcgcacgagaccattacctagaacatcctaatcgaaaacaccaccactgggtcttcagaaccattagatttatctactccaaagcgcagaagaacccgatcgacaccatgagggtgttgttcgttgccctcgctctcctgtctctcgctgcaagcgccacctccacgcatacaagcggcgactgcgtctgccggccaccgccgacggttcatctaccgccgccggagcatctgcaacctccgggtcacctgccacctcgggtgcatctcccaccgccgttccacctgccgacgccggtccgcctgccaccgtcggtccatgagccgccatcggatcatctgccgcacgcaccatgccactacgctagtcaaccgcccgggcctcagtctcatccccaggcatgcccatgtccgtgccaacagccgtatccaagaccgtgacagctgcagtgaacctgctgacgttagaacccccccgatcctgggccagtgcgtcgagatcctggaaggatagaggacccctgaatgtaaaggcgctactggctcggctcattttcaaggggtatgagggaaacataaggtgcccagcagatacgagcaaggaggctacccgctttcccccggaacaagaagaatgaatcagaatcggtgccctccaaac

SEQ ID NO: 12860 - protein, 110 aa, Zea mays
  misc_feature: Ceres CLONE 1372769-F
  misc_feature: SWISSPROT Homolog: EC 3.4.16.5 Carboxypeptidase C
MRVLFVALALLSLAASATSTHTSGDCVCRPPPTVHLPPPEHLQPPGHLPPRVHLPPPFHLPTPVRLPPSVHEPPSDHLPHAPCHYASQPPGPQSHPQACPCPCQQPYPRP

SEQ ID NO: 12861 - DNA, 754 bp, Zea mays
  misc_feature: Ceres CLONE 1372770-F
  misc_feature: Encodes the peptide sequence at SEQ ID NO. 12862
  misc_feature (344)..(344): n is a, c, t, g, unknown, or other
  misc_feature (387)..(387): n is a, c, t, g, unknown, or other
  misc_feature (442)..(442): n is a, c, t, g, unknown, or other
  misc_feature (443)..(443): n is a, c, t, g, unknown, or other
  misc_feature (697)..(697): n is a, c, t, g, unknown, or other
aagctggagctccccgcggtggcggccgctctagaatagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagccctacatggctgatcacaccggggtgcgacgggaggtggcgggggctaacgcgaccctcagcgcgggggcggcatgcacggcgaggcccaacaacagcagaagcagggcgccatgatgacggggctcaaggccgcgacggccgcgaacttcggnggggtcgatgctgggtgctgtcccgggctgatcctgggccggnaccgtgatcgccgctcacggtgggcaccccccgtgctggtgatcttcagccgggnntttttggggggccccgccccccatttggggtttggggctttatgggggcggccggggtttcctcccccctccggggggcccctcggggggtccctgggggcttgtccggtgtttccccctgggatggaacaaagataccttggagggggaaagaccccccgccggggggggcccaaccaatctgggaccccaccccagaggggggagggggtgggggtcccaggggccccgccaatatacaaaggggtggccancacacagcaccccgcctctcaaccaagggggagagggggtctttgggaaaaaaaaaa

SEQ ID NO: 12862 - protein, 163 aa, Zea mays
  misc_feature: Ceres CLONE 1372770-F
  misc_feature (42)..(42): Xaa is any aa, unknown, or other
  misc_feature (60)..(60): Xaa is any aa, unknown, or other
  misc_feature (145)..(145): Xaa is any aa, unknown, or other
MHGEAQQQQKQGAMMTGLKAATAANFGGVDAGCCPGLILGRXRDRRSRWAPPVLVIFSRXFLGGPAPHLGFGALWGRPGFPPPSGGPLGGSLGACPVFPPGMEQRYLGGGKTPRRGGPNQSGTPPQRGEGVGVPGAPPIYKGVAXTQHPASQPRGRGGLWEKK

SEQ ID NO: 12863 - DNA, 725 bp, Zea mays
  misc_feature: Ceres CLONE 1372771-F
  misc_feature: Encodes the peptide sequence at SEQ ID NO. 12864
  misc_feature (490)..(490): n is a, c, t, g, unknown, or other
  misc_feature (695)..(695): n is a, c, t, g, unknown, or other
  misc_feature (696)..(696): n is a, c, t, g, unknown, or other
tccccgcggtggcggccgctctagaactagtggatcccccgggctgcaggaattcgcacgagaccattacctagaacatcctaatcgaaaagtgttttcgcttccccttccccatcccctctcctcccctcgccggcttgtcggtctcgccgcgccactggccatacatccaagacgctaatccgtgtgggggaaaagcccccctctctctgaaactattcaaatggcgtggggcgtatccccgcggcggcagccgtcgttcccggtgcaggccctctacgagctctgcaagcgctccttcccctccccttccgccgcctcatcgtctcccccgcccgctgatgtcgtccgcagcatctcctcgctcatggatacaatcactcctgcggatgttgggctcagagattataatcttgaggacgacagggggcatggattttttgactccaacctcctcaaggggtcaggaaggcttcctcggtgggcgcgncccatcaagtaccttcatatctacagctgtgatgcattctctattggaatattctgcttggcaacttcatcagtcattcctcttcatgatcatccaggaatgactgtactgagcaaaatcctttatgggtccatgcatgtgaaatcatatggatggataagagctactggtcctagcagagccaggccagcaggttggcaattanntaaagaaggggatgtcggactgctcatgc

SEQ ID NO: 12864 - protein, 167 aa, Zea mays
  misc_feature: Ceres CLONE 1372771-F
  misc_feature (14)..(167): Pfam Name: DUF1637 Pfam Description: Protein of unknown function (DUF1637)
  misc_feature: SWISSPROT Homolog: EC 1.13.11.19 Cysteamine dioxygenase
  misc_feature (158)..(158): Xaa is any aa, unknown, or other
MAWGVSPRRQPSFPVQALYELCKRSFPSPSAASSSPPPADVVRSISSLMDTITPADVGLRDYNLEDDRGHGFFDSNLLKGSGRLPRWARPIKYLHIYSCDAFSIGIFCLATSSVIPLHDHPGMTVLSKILYGSMHVKSYGWIRATGPSRARPAGWQLXKEGDVGLLM

SEQ ID NO: 12865 - DNA, 795 bp, Zea mays
  misc_feature: Ceres CLONE 1372773-F
ccccgcggtggcggccgctctagaactagtggatcccccgggctgcaggaattcgcacgagaccattacctaaaacatcctattcgaaaaaccacacttattagcttcctaatttcaattattgaatttcagtcgagttgctaaacaacacgaactcagtcgtttgagttttgaggaggcaagcaagaggacccatcgatggcctccttgaagaccactgtgcccgggtggcaaaaatttgaaggggtatttttgtttccttgtcttccccccccccttcttccattggatcaaaagggggtggaaaaacccggaaaattataaagcccaaaaggggggccagggcccgcccctgggtttcgcataaatatcccaaagcccccccggcggttccaccccgggattcgccctcccaggcgtcttcctaatgggaaatccctgggaagttaggggggtaaaaaaagggggggtggggcccggccccccccccccccatggggaacggggaacccttggggttttaccccaacacccaaaaaaaaaaaaacccggggttttagaacaccaaaagaaaacggccccccccaaacaagaaggtaattttcttcgtggggtggggaaaaaaaaggggtgttttttccccccgccccgcgcggggggttgtgataccccccctcccccccaaaaaagtttttttcccccccctctttttttcgcgcaacacacaaaggtggggcccaccccccgaggggggcgccccgccgccgcacagccccaggaggggggggtgttctt

SEQ ID NO: 12866 - DNA, 690 bp, Zea mays
  misc_feature: Ceres CLONE 1372779-F
  misc_feature (563)..(563): n is a, c, t, g, unknown, or other
tggagctccccgcggtggcggccgctctagaactagtggatcccccgggctgcaggaattcgcacgagaccattacctagaacatcctaatcgaaaaaaccggccggcttccctcgcccccggcgaggagtgaagacaagccgacaaggcaaaaccatcgcctgtacggtatccaaccgccgtcccgccgcacaaccaaggatagggcgggagagggggatctcgctttcgctccgctgccgcatgcgcaccgcccctcctcatgacaccaactagggcaccaccagcccccttctcgtcgacctccgcgcggtgactctgctgagcatcatacccttatagggcccgacccatggatgtaacttcgaccgctgccgcctccgcctcaggcggggggtagtggtacacgggcatgtccgcggatacatcaagggcctggtgctcgcgctctcctccagctcttcatcggcgcagcttcatttatcagaggagggactcaagaagccgcatcctcggcgtcagagcgggggttgtgctattcttattatatgagcctctttgtnggttgcatgataacatgattgttggaaaattgcaaattcccagcttatgattgcaccggctattttggccctcctctcgggctcttacattattatcacgctgggctgccatggaaggctggggaaa

SEQ ID NO: 12867 - DNA, 664 bp, Zea mays
  misc_feature: Ceres CLONE 1372782-F
  misc_feature: Encodes the peptide sequence at SEQ ID NO. 12868
  misc_feature (300)..(300): n is a, c, t, g, unknown, or other
  misc_feature (307)..(307): n is a, c, t, g, unknown, or other
tccccgcggtggcggccgctctagaactagtggatcccccgggctgcaggaattcgcacgagaccattacctagaacatcctaatcgaaaaaagattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatncatgtcnagaacgtggaggagaaccggcgggctctccgtgagctcctggtctgctgccctggtgccctccagtacatcagcggtgtgatcctcttcgaggagaccctctaccagaagaccagggatggcaagccttttgtcgatgtcctcaaggaggaggcgtcctccctggcatcaaggtcgacaggccaccattgaggttggtggcaccgacaaggagaccaccacccagggccacgatgacctcggaaagggctgcgctagtactacgaggccggtgcccgctttggccagtggggtggtgttctcaagatgggccccacgaggcgtcacagttggcattgacctgatggtcagggtctgg

SEQ ID NO: 12868 - protein, 108 aa, Zea mays
  misc_feature: Ceres CLONE 1372782-F
  misc_feature (11)..(109): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (43)..(43): Xaa is any aa, unknown, or other
  misc_feature (46)..(46): Xaa is any aa, unknown, or other
MSAYCGKYADELIKNAAYIGTPGKGILAADESTGTIGKRLSSXHVXNVEENRRALRELLVCCPGALQYISGVILFEETLYQKTRDGKPFVDVLKEEASSLASRSTGHH

SEQ ID NO: 12869 - DNA, 759 bp, Zea mays
  misc_feature: Ceres CLONE 1372783-F
  misc_feature: Pfam Name: PMEI Pfam Description: Plant invertase/pectin methylesterase inhibitor
tccccgcggtggcggccgctctagaactagtggatcccccgggctgcaggaattcgcacgagaccattacctagaacatcctaatcgaaaaattcaatcattcaagcgaagcagccaccactctctccactgtgactccgggacctgcctgccctgctgaacaagcacagcacacacaccccgcacaccgcaccagctcagcgcagctcaccaagacaatcaatcatggctcacccgcgcagtgtcgctgccgctgcccccctcctcctgctgctcgccgcagccgccaccgccgcaacggggctcgtgtccaccgcgtcgccgtcagccagcgacttcgtccgcaagtcgtgccgcacgacgcagtacccgtcggagtgcgaccaaagcctgtcgtcgaacggcgggtcgccgccgccgcgaacccccgaggaagctggcgcacaccgctcctaccgtcaataccgaaacgacgcgcgcgcccctggatcccaaagaagggcccaccttagccggccccaccaaagagtaaaggtaccgaaaaaagggcccggaaaaagaaatctaaccttgccataagagaagccccgcgggaaacttggcagaaaaaacagaggggaagattttgtgggcccccttccctggctctttcacaaaaaaaaaaagcagggggccactccctcgctcccccggggtacacaataaggggggttaatgggggaccccccaaacaaaggggcccaagcccggggaacaccc

SEQ ID NO: 12870 - DNA, 718 bp, Zea mays
  misc_feature: Ceres CLONE 1372785-F
  misc_feature: Translation starting site: 150
  misc_feature (684)..(684): n is a, c, t, g, unknown, or other
  misc_feature (708)..(708): n is a, c, t, g, unknown, or other
ggagctccccgcggtggcggccgctctagaactagtggatcccccgggctgcaggaattcgcacgagaccattacctagaacatcctaatcgaaaaaccatattattgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaaccactggctgcattgaactctgctgcttaattgcaacacaactaccattcagtcagctagctgctgcctacccccagcaatttcttccattcaaccactggcagcatggaactctgctgcttaaattacacagcacagctaccacatttcagcagctagctgatgtgagccctgntgccttttctgacacacacagttngttgcgttct

SEQ ID NO: 12871 - DNA, 770 bp, Zea mays
  misc_feature: Ceres CLONE 1372786-F
aagctggagctccccgcggtggcggccgctctagaactagtggatcccccgggctgcaggaattcgcacgagaccattacctagaacatcctaatcgaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggggaactcgtgaagaacagagccgccactgaggaaaccctagcgacggcggcgtgctaccggtgacattgtccccctcggccccctccatccctgacgcagcggcgccagcctggagggaagccagcccctattcgagacaaggtcgatcttttgctggccttggcgagcttcagccgaatcaagggcgagccatgggcggcagggccagtaaattagagcaacacaaaacccctcaaatttaagtggagacctcttgcagcaaaccccgaacccggccgccaccacctgggggggcacttcccccatcgcctttggccctcccctctggcgcttgaagggttggggaagggccagcgggaggcaccgcaacattgcgccaatccaggggtcccattctgacgcccccccaagaggagcaagggccttgtgcccccccgttatgttgaagggccggggcccacgcctccgggggtcctgaaaaggccacccctcccgggggaga

SEQ ID NO: 12872 - DNA, 730 bp, Zea mays
  misc_feature: Ceres CLONE 1372788-F
  misc_feature: Translation starting site: 259
  misc_feature: Pfam Name: TIM Pfam Description: Triosephosphate isomerase
  misc_feature: SWISSPROT Homolog: EC 5.3.1.1 Triose-phosphate isomerase
tggagctccccgcggtggcggccgctctagaactagtggatcccccgggctgcaggaattcgcacgagaccattacctagaacatcctaatcgaaaaatcagaggccacaaacctcaccccacctatattatcccgtgccccttgtctttcttcctccacaagcagcgaaatccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgagtgaaggacaggttcccccttcagacgctgtgggaggggggtgtcagccctccttatgtcttccttcctgtgggcaagagccagctgcgccaagagttccatgttgcggctcagaactgctgggttaagaagggaggtgctttcaccgggggaaggcagtggtgagatgctcgccaaccttgggggtcccctggggcatccttggacactctgaaaaggagagctctggctggagaatcaaatgaatttgttggagaacaggttgcgtatgccctgtctcagggactaagggccttggcatggggtggggggaaccctggggaagagggaggtgggccccccccatgggagggttgttgctgcacaaccaaaagcattggcggaaaagac

SEQ ID NO: 12873 - DNA, 738 bp, Zea mays
  misc_feature: Ceres CLONE 1372791-F
  misc_feature: Encodes the peptide sequence at SEQ ID NO. 12874
  misc_feature (315)..(315): n is a, c, t, g, unknown, or other
aagctggagctccccgcggtggcggccgctctagaactagtggatcccccgggctgcaggaattcgcacgagaccattacctagaacatcctaatcgaaaaatcccctcagtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcgggcacgcgcaccaccaccccgtcgtccgtggccgtggccaccccgcgcggcggnggcggccccatccgcgcgtcaatctcctcttcccccaccccgccctaagacctgacggtcttgcgggttcagccccatcaaggagtccatcgtggtcccgcgagatggacccggcgctacatggaggacatgatccccccccgccgacccccgacgggggtgaacggggggcgccgggttccgcggggcctggtcctgggccgaacaaaacttgtccaagggaacccccccggggagggggggccattcgtggaaaaaaatcccggggcccccggggggggggcgcccgtgggttggaaccgaaaaacttttttccccgggccagggggggggggcgccaaggccccgcgccccccttgttccctgggacgagaggggggggtgtggggctacgcaacaagagcccagaagaattatcgtggg

SEQ ID NO: 12874 - protein, 54 aa, Zea mays
  misc_feature: Ceres CLONE 1372791-F
MATTAASSLLKSSFAGSRLPSGTRTTTPSSVAVATPRGGGGPIRASISSSPTPP

SEQ ID NO: 12875 - DNA, 677 bp, Zea mays
  misc_feature: Ceres CLONE 1372792-F
  misc_feature: Encodes the peptide sequence at SEQ ID NO. 12876
  misc_feature (260)..(260): n is a, c, t, g, unknown, or other
  misc_feature (289)..(289): n is a, c, t, g, unknown, or other
  misc_feature (345)..(345): n is a, c, t, g, unknown, or other
  misc_feature (429)..(429): n is a, c, t, g, unknown, or other
  misc_feature (432)..(432): n is a, c, t, g, unknown, or other
tccccgcggtggcggccgctctagaactagtggatcccccgggctgcaggaattcgcacgagaccattacctagaacatcctaatcgaaaagtagtcgtagctcaagcatcagcggcaggagctctgggcagcgtgcgcacgtggggtacctagctcgctctgctagcctaccatggctgatcaccaccggggtgcgacgggaggtgggcggggctacggcgacctccagcgcgggggcggcatgcacggcgaggcgcancagcagcagaagcagggcgccatgatgancgcgctcaaggccgcgacggccgcgacccttcgcgggtcgatgctggtgctgtccnggctgatcctggccggcaccgtgatcgcggctcacggtggccacccccgtgctggtgatcttcagcccgtggctgggtgccggncgncatcgcgctggcgctcatggggggccgggttcgtcacctcgggcggcctcggcgtcgctgcgctgtccgtgttctcctggatgtacaagtacctgacgggcaagcacccgccgggcgccgaacagctggaccacgccaaggcgagggctggcgtccaaggccccgcgacatcaaggatgcagcacagcaccgcatcgaccagggggggggggggtcttgaaaggaaaaacacccctcgaagggga

SEQ ID NO: 12876 - protein, 168 aa, Zea mays
  misc_feature: Ceres CLONE 1372792-F
  misc_feature (36)..(149): Pfam Name: Oleosin Pfam Description: Oleosin
  misc_feature (29)..(29): Xaa is any aa, unknown, or other
  misc_feature (39)..(39): Xaa is any aa, unknown, or other
  misc_feature (58)..(58): Xaa is any aa, unknown, or other
  misc_feature (86)..(86): Xaa is any aa, unknown, or other
  misc_feature (87)..(87): Xaa is any aa, unknown, or other
MADHHRGATGGGRGYGDLQRGGGMHGEAXQQQKQGAMMXALKAATAATLRGSMLVLSXLILAGTVIAAHGGHPRAGDLQPVAGCRXXSRWRSWGAGFVTSGGLGVAALSVFSWMYKYLTGKHPPGAEQLDHAKARAGVQGPATSRMQHSTASTRGGGGLERKNTPRRG

SEQ ID NO: 12877 - DNA, 687 bp, Zea mays
  misc_feature: Ceres CLONE 1372796-F
  misc_feature: Encodes the peptide sequence at SEQ ID NO. 12878
  misc_feature (220)..(220): n is a, c, t, g, unknown, or other
  misc_feature (250)..(250): n is a, c, t, g, unknown, or other
  misc_feature (275)..(275): n is a, c, t, g, unknown, or other
  misc_feature (300)..(300): n is a, c, t, g, unknown, or other
  misc_feature (428)..(428): n is a, c, t, g, unknown, or other
  misc_feature (506)..(506): n is a, c, t, g, unknown, or other
  misc_feature (576)..(576): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (653)..(653): n is a, c, t, g, unknown, or other
cgcggtggcggccgctctagaactagtggatcccccgggctgcaggaattcgcacgagaccattacctagaacatcctaatcgaaaacaggctcatctcgctttggatcgattggtttcgtaactggtgagggactgagggtctcggagtggattgatttgggattctgttcgaagatttgcggaggggggcaatggcgaccgcggggaaggtgatcaangtgcaagctgcggtggcatgggaagcccgncagccactgtcgatcgaggaggtgnaggtagcgcctcccgcaggcatggnagtgcgcgtcaagatcctctttcactcgctctgccacaccgacgtctacttctggggaggccaggggcagactcccgtgttccctctgatcttttggccacgagctggagtatcatagagagtgttgnagaaggtgtgactgacgtagctccgggcgacatgtccttcctgttgtcactggggagtgcaaggagtgtgcccactgncagtcgcagagagcaacatgtgtgatctgctcaggatcaacaccgaccgcggtgtgatgattgcgatggncaagtcccggttttcaatcatgggaagctatctaccactttgtgtggacttccccttcaccagtaccgnnntggggnttgggggttgggttcaaaaatcaccctcagtccc

SEQ ID NO: 12878 - protein, 74 aa, Zea mays
  misc_feature: Ceres CLONE 1372796-F
  misc_feature: SWISSPROT Homolog: EC 1.1.1.1 Alcohol dehydrogenase
  misc_feature (9)..(9): Xaa is any aa, unknown, or other
  misc_feature (28)..(28): Xaa is any aa, unknown, or other
  misc_feature (36)..(36): Xaa is any aa, unknown, or other
MATAGKVIXVQAAVAWEARQPLSIEEVXVAPPAGMXVRVKILFHSLCHTDVYFWGGQGQTPVFPLIFWPRAGVS

SEQ ID NO: 12879 - DNA, 738 bp, Zea mays
  misc_feature: Ceres CLONE 1372799-F
  misc_feature: Encodes the peptide sequence at SEQ ID NO. 12880
ggagctccccgcggtggcggccgctctagaactagtggatcccccgggctgcaggaattcgcacgagaccattacctagaacatcctaatcgaaaaaaaagggaggaaaagggtccggtgtggcgacgatggagaggggcggcggcgccgcagacgagatgatgatgacctcgggcgcgacgggccgtatcgtgccggtgttccgctcccgtgctgtcgcggggcgctctgctccgcgtcgccgtggcgctgaattccctcttcttctggttgctgctcctccccagggcctccgccggacccgggcgaggacgggcgccaaccgcaccgcgtccgaaggggggcttggggcccgaccccccccccccggcgggggcggcttgcctttcagccccggaaatgaaaaacctgggggcctccccaggcccctcggggggaagggggccctgggggaaagaaagggttcattagagtggcgggcggtttcccctcgaccccggagcaaaaagaaaaggggtttttttaacacttttgccgcctcgcccccggcaccccaaaagaggcggacaattaggggccccctccctggttttatttctcacacccttgccggggacgaccccttttggccgggcagagatcaagcccagggggggttccggaaatttcgccccttgtttggttggttgcttcacaaggaccccttttttctacatatggcgcgtcgggggcctaaaa

SEQ ID NO: 12880 - protein, 203 aa, Zea mays
  misc_feature: Ceres CLONE 1372799-F
MERGGGAADEMMMTSGATGRIVPVFRSRAVAGRSAPRRRGAEFPLLLVAAPPQGLRRTRARTGANRTASEGGLGARPPPPGGGGLPFSPGNEKPGGLPRPLGGKGALGERKGSLEWRAVSPRPRSKKKRGFFNTFAASPPAPQKRRTIRGPLPGFISHTLAGDDPFWPGRDQAQGGFRKFRPLFGWLLHKDPFFLHMARRGPK

SEQ ID NO: 12881 - DNA, 740 bp, Zea mays
  misc_feature: Ceres CLONE 1372800-F
  misc_feature: Encodes the peptide sequence at SEQ ID NO. 12882
  misc_feature (350)..(350): n is a, c, t, g, unknown, or other
  misc_feature (351)..(351): n is a, c, t, g, unknown, or other
  misc_feature (400)..(400): n is a, c, t, g, unknown, or other
  misc_feature (434)..(434): n is a, c, t, g, unknown, or other
  misc_feature (466)..(466): n is a, c, t, g, unknown, or other
  misc_feature (470)..(470): n is a, c, t, g, unknown, or other
  misc_feature (471)..(471): n is a, c, t, g, unknown, or other
  misc_feature (492)..(492): n is a, c, t, g, unknown, or other
  misc_feature (493)..(493): n is a, c, t, g, unknown, or other
  misc_feature (504)..(504): n is a, c, t, g, unknown, or other
tggagctccccgcggtggcggccgctctagaactagtggatcccccgggctgcaggaattcgcacgagaccattacctagaacatcctaatcgaaaaacccaaaaaccccagcgcacccaacccaagagcgaaaatggatccgcaccagttcgccccctcccagcagtcggcgctgaccatggaatcggcggagagcacggccgccgccgccgcgcgggcgtccaacggcgctgcccgagctgtcgtcgaggacgacgacgaggacgacgacgtccccgaggtggccgcctgcatatcgacgatgctcgacccgcggggtagcgtggagagccaccgcctcttcctggcnngcgcgcacgcgctggagatgctccgcgaccgcgggtacgccggtccggnaggaagagctcgcccgacccctcccgggagtccngcggctggtggggaatacaggcccggagctcngaanngctcgccttctccactacccnntcactcgaccngtcagaagggggaaaagtttgggttcttgccaacctgaacctgtcaaaatcggaggtattccgggtgaattattaccggaagccaagatgaaaatttggcccaaatgattcttgatacggggggggaaaaaaaaattgctcaaaaccaaagaaaccctcggggggattttttcgtatttaagggtgaaccttcccaaatccgggaattgcggggggaaaccacaaaaagtggcccc

SEQ ID NO: 12882 - protein, 135 aa, Zea mays
  misc_feature: Ceres CLONE 1372800-F
  misc_feature (73)..(73): Xaa is any aa, unknown, or other
  misc_feature (89)..(89): Xaa is any aa, unknown, or other
  misc_feature (111)..(111): Xaa is any aa, unknown, or other
  misc_feature (112)..(112): Xaa is any aa, unknown, or other
  misc_feature (113)..(113): Xaa is any aa, unknown, or other
  misc_feature (120)..(120): Xaa is any aa, unknown, or other
  misc_feature (124)..(124): Xaa is any aa, unknown, or other
MDPHQFAPSQQSALTMESAESTAAAAARASNGAARAVVEDDDEDDDVPEVAACISTMLDPRGSVESHRLFLAXAHALEMLRDRGYAGPXGRARPTPPGSPAAGGEYRPGAXXXSPSPLPXHSTXQKGEKFGFLPT

SEQ ID NO: 12883 - DNA, 720 bp, Zea mays
  misc_feature: Ceres CLONE 1372801-F
  misc_feature: Translation starting site: 288
  misc_feature: SWISSPROT Homolog: EC 3.1.3.16 Phosphoprotein phosphatase
  misc_feature (357)..(357): n is a, c, t, g, unknown, or other
  misc_feature (358)..(358): n is a, c, t, g, unknown, or other
  misc_feature (402)..(402): n is a, c, t, g, unknown, or other
  misc_feature (491)..(491): n is a, c, t, g, unknown, or other
  misc_feature (680)..(680): n is a, c, t, g, unknown, or other
  misc_feature (717)..(717): n is a, c, t, g, unknown, or other
tggagctccccgcggtggcggccgctctagaactagtggatcccccgggctgcaggaattcgcacgagaccattacctagaacatcctaatcgaaaagaggaaaaatctcgcattcgcaaaccaagcaaatggaggcatgagctccgccgcctccccgtctctcgccgatctcccccaaaccctagcctcgacctgaccgccagcgggcccgcaggccggagaaggagtcggagtcgcccccacccacccaccctctgccgcgggcggggagcgggcggcggacgagatgccgtcgcacggggatctggaccggcagatcgcgcagctgcgcgactgcaagtacctgccccgagcgnnagtcaaggtgctctgcgagcaggccaaggccatcctcatggagnaatggaacgtgcagcccgtgcgctgccccgtcaccgtctggcgcgacatccacggccagttctatgacctcatcgagctcttccgcatncggggcgactctcccgacaccaactacctcttcatgggcgactacgtcgatcgtggctattatttcagtgaaacggtttctctggtagtggctttgaaagtcgttacagagatagaattacaatacttcgaggaaatcatgagagcagacaaatcactcaggtgtacggcttctatgatgaatgcttangaaatatgggaatgcaaatgtatggaagtattttacngaa

SEQ ID NO: 12884 - DNA, 744 bp, Zea mays
  misc_feature: Ceres CLONE 1372806-F
  misc_feature: Encodes the peptide sequence at SEQ ID NO. 12885
  misc_feature (296)..(296): n is a, c, t, g, unknown, or other
  misc_feature (315)..(315): n is a, c, t, g, unknown, or other
  misc_feature (408)..(408): n is a, c, t, g, unknown, or other
  misc_feature (424)..(424): n is a, c, t, g, unknown, or other
ctccccgcggtggcggccgctctagaactagtggatcccccgggctgcaggaattcgcacgagaccattacctagaacatcctaatcaaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggctgccgacgatgaatggggcgccgncggctgtacccctacgcgnagtacctgaggcagccgcagtgcagcccgctggcggcggcgcctactaccgccgggttgtgggcagcgagcggcatgttccaggcgctcgggnacagtgcttgcagcancaaatggagaatgtggaacgtgcaatccgtcccggaacacttgaaaatgatgatgaaatttggaggggggccgttgcgccagaaaaaacctgtaaaaaccctttttgatgtgaaaacaaaagaagtgttggaaacccaggggctcaccccgggggcattgtgggggggcaaaaattggcgcgcatgggggggatttaaagaaaacatgtgcccagtacgcccacaaccccggggggggccccggggattttttcccccataaaggggtttggggttttgggaaaaccccccaacccttcctcttattaaaaagaggaaag

SEQ ID NO: 12885 - protein, 42 aa, Zea mays
  misc_feature: Ceres CLONE 1372806-F
MKMVIVLVVCLALSAASASAMQMPCPCAGLQGLYGAGAGCRR

SEQ ID NO: 12886 - DNA, 694 bp, Zea mays
  misc_feature: Ceres CLONE 1372807-F
  misc_feature: Encodes the peptide sequence at SEQ ID NO. 12887
  misc_feature (402)..(402): n is a, c, t, g, unknown, or other
  misc_feature (495)..(495): n is a, c, t, g, unknown, or other
  misc_feature (694)..(694): n is a, c, t, g, unknown, or other
cgcggtggcggccgctctagaactagtggatcccccgggctgcaggaattcgcacgagaccattacctagaacatcctaatcgaaaaacacaaacaagaagcttgcattgttcgctgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggagaaaaagctctagtgatcagacaggcgacatgaggtacgtgagtgacttccccgtctacgatggccgtggctccgacgccgtcctggtggctcgcgtgcagggcgtcacaaccacgtttcgggaactccnaccagttctttcacgtcgccttcgaggctggcaggctaaagggctccacgctcctttacgaaggagtggtgacggatggatccgatgaatggncaatctacggcggcaccggagagttggctatggggagagtgtcttcaaagaaggtactttgccgataggacggccccggaacctgagagcttcacatgcagttttttggccccgggtttggttctcccacaccaacaagcagactcccctcttgcaccaaaattggtttaggggggggaaaagggggcccgccaaaaan

SEQ ID NO: 12887 - protein, 76 aa, Zea mays
  misc_feature: Ceres CLONE 1372807-F
  misc_feature (24)..(24): Xaa is any aa, unknown, or other
  misc_feature (55)..(55): Xaa is any aa, unknown, or other
MAVAPTPSWWLACRASQPRFGNSXQFFHVAFEAGRLKGSTLLYEGVVTDGSDEWXIYGGTGELAMGRVSSKKVLCR

SEQ ID NO: 12888 - DNA, 762 bp, Zea mays
  misc_feature: Ceres CLONE 1372808-F
  misc_feature: Encodes the peptide sequence at SEQ ID NO. 12889
  misc_feature (335)..(335): n is a, c, t, g, unknown, or other
ggagctcaccgcggtggcggccgctctagaatagtggatcccccgggctgcaggaattcgcacgagaccattacctagaacatcctaatcgaaaaaatactccgtcactttgtttgcaaagctcctcctcgatccatcgatcactgcaccggccggcggcaccgcgctcgcaggggctagccaacgagacggcagcaatggcggaccgtgaccgcagctgtatctacggctgggcccacgccacctacgggcaccagcagcagcagggaggaggcggccgcccgatgggtgaacaggtgaaaggcatgctccaagacaaggggccgaacgcgtcncaagggctgacggtggcaaccctgatccccctggagggactgcctgttggtgctggtcgggattggccctaaaagccccccggggggggggtgggccgagacaaaccccgttgttcctaaattttaaccccctggttgggccccccccgggccttttcttagggaaagggcggcagtggggttcccccacgccgggggcgggtggggggtacagggaacattgccccacctcaacggcgcctcacaaaaaaagggggggggaaggggttccccggcgcaccccccgaaaataatgggaaaagagcccacccccccaggatgggggaaagggcccctttccccacccagggcaaaaaaaaaacccgcgcagggcgagggcctaaggccacttccagggtcagggtacgaaaaagaaggccccctcccg

SEQ ID NO: 12889 - protein, 69 aa, Zea mays
  misc_feature: Ceres CLONE 1372808-F
MADRDRSCIYGWAHATYGHQQQQGGGGRPMGEQVKGMLQDKGPNASQGLTVATLIPLEGLPVGAGRDWP

SEQ ID NO: 12890 - DNA, 716 bp, Zea mays
  misc_feature: Ceres CLONE 1372811-F
  misc_feature: Encodes the peptide sequence at SEQ ID NO. 12891
  misc_feature (570)..(570): n is a, c, t, g, unknown, or other
  misc_feature (716)..(716): n is a, c, t, g, unknown, or other
tccccgcggtggcggccgctctagaactagtggatcccccgggctgcaggaattcgcacgagaccattacctagaacatcctaatcgaaaaagcgacagatatcttcgactcctcgttcgtggttccccatcgtcatcgccatggatttctcttaggctcacccgtccgctcggctcgcttccttccccactctctctgatcccgtcgcacttccctcctcgctgcagcccctctactattgcgattaccgtttcctcgctgccctttcctttttcggtcggcagcaatcaccggggcaagcgaaccctcgatttgcgtccccgctctctgctagcgcccctaaaagaggagcgaagcgatgtctatgtcgaagacgggtcaggccgcggagaaagatgagcagcagcagtcccgaaggatagcactgatgcagggcatctgcgccgtggtgtaccgcaaggccgataacacgccctgcccccatcaagcagggtctctacttgggatctggtggagcagcattcaatagggacgctctcaagagtttgacatcacccatatcttgatcngtgcaaaggcactggatccagtaatttccagctgatttaattacaagaagatcgaagtacttgatatcccagaccctgatctgttaaagcattctgaagaaagctttggtttcaaagaagagctaaaagtccgggaggaaaggttn

SEQ ID NO: 12891 - protein, 56 aa, Zea mays
  misc_feature: Ceres CLONE 1372811-F
MSMSKTGQAAEKDEQQQSRRIALMQGICAVVYRKADNTPCPHQAGSLLGIWWSSIQ

SEQ ID NO: 12892 - DNA, 706 bp, Zea mays
  misc_feature: Ceres CLONE 1372817-F
  misc_feature: Encodes the peptide sequence at SEQ ID NO. 12893
  misc_feature (509)..(509): n is a, c, t, g, unknown, or other
  misc_feature (587)..(587): n is a, c, t, g, unknown, or other
  misc_feature (588)..(588): n is a, c, t, g, unknown, or other
  misc_feature (611)..(611): n is a, c, t, g, unknown, or other
  misc_feature (625)..(625): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
aagctggagctccccgcggtggcggccgctctagaactagtggatcccccgggctgcaggaattcgcacgagaccattacctagaacatcctaatcgaaaattttcaagctctcctcccctcttcctaccattagcagtagccacagccagaacaccagcagacagcagcatcagcagggaggaacacgatgagcggcgccggtccggatctgcagctgccaccggggttccggttccacccgacggacgaggagctggtgatgcactacctctgccgccgctgcgccgacctgcccatcgccgtccccatcatcgccgagatcgacctctacaagttcgacccatggcagctcccaaggatggcgctgtacggcgagaaagagtggtacttcttctccccgcgggaccgcaagtacccgaacgggtccaggcccaaccgcgccgccggggctgggtactggaaggccaccggcgctgacaagcccgtgggcacgcccaagccgctggncatcaagaaggcgctcgtcttctacgccggcaaggcgcccaagggcgagaagaccaactggatcatgcacgagtacgnnctcgccgacgtcgaccgctcggngcgcaagagacagnctcaggtgggatgaactgggtcctgtgcgcatctacacaaaaaaggcggnnnnnctggaaaaggccccggcggctggcgca

SEQ ID NO: 12893 - protein, 149 aa, Zea mays
  misc_feature: Ceres CLONE 1372817-F
  misc_feature (10)..(135): Pfam Name: NAM Pfam Description: No apical meristem (NAM) protein
  misc_feature: The sequence is a functional homolog of SEQ ID NO 890 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 854 in the 10/374,780 US patent application
  misc_feature: Functional homolog of the protein sequence given in SEQ ID NO 96872
  misc_feature: Useful for making plants with modulated light quality response
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: The sequence is a functional homolog of SEQ ID NO 891 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 851 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 852 in the 10/374,780 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 476 in the 10/666,642 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 612 in the 11/435,388 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: The sequence is a functional homolog of SEQ ID NO 1729 in the 11/479,226 US patent application
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 344 in the 10/666,642 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
  misc_feature: The sequence is a functional homolog of SEQ ID NO 240 in the 10/225,068 US patent application
  misc_feature: The sequence is a functional homolog of SEQ ID NO 368 in the 10/374,780 US patent application
  misc_feature: The sequence is a functional homolog of SEQ ID NO 854 in the 11/435,388 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 582 in the 10/666,642 US patent application
  misc_feature: The sequence is a functional homolog of SEQ ID NO 310 in the 10/666,642 US patent application
  misc_feature: The sequence is a functional homolog of SEQ ID NO 886 in the 10/412,699 US patent application
  misc_feature: The sequence is a functional homolog of SEQ ID NO 1452 in the 10/666,642 US patent application
  misc_feature: The sequence is a functional homolog of SEQ ID NO 158 in the 10/225,066 US patent application
  misc_feature: The sequence is a functional homolog of SEQ ID NO 226 in the 10/666,642 US patent application
  misc_feature: The sequence is a functional homolog of SEQ ID NO 242 in the 10/714,887 US patent application
  misc_feature: The sequence is a functional homolog of SEQ ID NO 242 in the 11/435,388 US patent application
  misc_feature: The sequence is a functional homolog of SEQ ID NO 280 in the 10/374,780 US patent application
  misc_feature: The sequence is a functional homolog of SEQ ID NO 68 in the 10/225,068 US patent application
  misc_feature (107)..(107): Xaa is any aa, unknown, or other
  misc_feature (133)..(133): Xaa is any aa, unknown, or other
  misc_feature (141)..(141): Xaa is any aa, unknown, or other
  misc_feature (146)..(146): Xaa is any aa, unknown, or other
MSGAGPDLQLPPGFRFHPTDEELVMHYLCRRCADLPIAVPIIAEIDLYKFDPWQLPRMALYGEKEWYFFSPRDRKYPNGSRPNRAAGAGYWKATGADKPVGTPKPLXIKKALVFYAGKAPKGEKTNWIMHEYXLADVDRSXRKRQXQVG

SEQ ID NO: 12894 - DNA, 687 bp, Zea mays
  misc_feature: Ceres CLONE 1372820-F
  misc_feature: Encodes the peptide sequence at SEQ ID NO. 12895
  misc_feature (527)..(527): n is a, c, t, g, unknown, or other
  misc_feature (613)..(613): n is a, c, t, g, unknown, or other
ggagctccccgcggtggcggccgctctagaactagtggatcccccgggctgcaggaattcgcacgagaccattacctagaacatcctaatcgaaaactcacaaaaccctcgccagcttatcccccttccctccctcacacgatctctcctcgacggctaacccggattgccgtctcaggctcgggatccgggcgctcgcggcgatggacggaggcggcagcactggcggcgcgaaggggcagctcacggcgcaggagacagcgctctacgaccgccagatccgcgtctggggcgtcgatgcccagaagtagtctgcgagactatctgtctagctgggagtggaagttatccttgatggatgatgatgcagtcacagacgacgatctgaatggcaatttcttacttcctcctgatgacagcatatatggcggtagatctcgagaccaggtttgctgcgagactttgatagattccatcctatggctagacgttctggtgaaaggggggatccatcattaagtggaggnagaattccttgacaagttccaccttggttggacttagcggggcatctcctaaaacaaggtttgtggattaatgaaaactggccaangaagaaccaaacatttggattttaatacaatagatggcagggttcctggggggggaaaaaatttgggtgattaa

SEQ ID NO: 12895 - protein, 73 aa, Zea mays
  misc_feature: Ceres CLONE 1372820-F
MPRSSLRDYLSSWEWKLSLMDDDAVTDDDLNGNFLLPPDDSIYGGRSRDQVCCETLIDSILWLDVLVKGGIHH

SEQ ID NO: 12896 - DNA, 740 bp, Zea mays
  misc_feature: Ceres CLONE 1372821-F
  misc_feature: Encodes the peptide sequence at SEQ ID NO. 12897
  misc_feature (298)..(298): n is a, c, t, g, unknown, or other
  misc_feature (405)..(405): n is a, c, t, g, unknown, or other
  misc_feature (481)..(481): n is a, c, t, g, unknown, or other
  misc_feature (608)..(608): n is a, c, t, g, unknown, or other
  misc_feature (609)..(609): n is a, c, t, g, unknown, or other
  misc_feature (688)..(688): n is a, c, t, g, unknown, or other
  misc_feature (697)..(697): n is a, c, t, g, unknown, or other
  misc_feature (698)..(698): n is a, c, t, g, unknown, or other
tccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcggnctgtacccctacgcggagtacctgaggcagccgcagtgcagcccgctggcggcggcgccctactacgccgtgtgtgggcagccgagcgccatgttccagccgctccngcaacagtgctgccagcagcagatgaggatgatggacgtgcagtccgtcgcgcagcagctgcagatgatgatgcancttgagcgtgccgctgcccgcagcagcagcctgtacgagccagctctgatgcagcagcagcagcagctgctgggcagccccaggtctcaacccattggccatgattgatggcgcaaaacatgcccgnnccatggttggactctaccagtaccagctggccagctacgcaccaaccccctgtggggtctccgctgccattccgcctanatatgaatnnatgaaaatttgggaaatctcctctattcatctctctctatga

SEQ ID NO: 12897 - protein, 144 aa, Zea mays
  misc_feature: Ceres CLONE 1372821-F
  misc_feature (84)..(84): Xaa is any aa, unknown, or other
  misc_feature (109)..(109): Xaa is any aa, unknown, or other
MKMVIVLVVCLALSAASASAMQMPCPCAGLQGLYGAGAGLTTMMGAGGLYPYAEYLRQPQCSPLAAAPYYAVCGQPSAMFQPLXQQCCQQQMRMMDVQSVAQQLQMMMXLERAAARSSSLYEPALMQQQQQLLGSPRSQPIGHD

SEQ ID NO: 12898 - DNA, 744 bp, Zea mays
  misc_feature: Ceres CLONE 1372822-F
  misc_feature: Translation starting site: 201
  misc_feature: Pfam Name: Drf_FH1 Pfam Description: Formin Homology Region 1
  misc_feature (223)..(223): n is a, c, t, g, unknown, or other
  misc_feature (708)..(708): n is a, c, t, g, unknown, or other
  misc_feature (709)..(709): n is a, c, t, g, unknown, or other
  misc_feature (739)..(739): n is a, c, t, g, unknown, or other
ggagctccccgcggtggcggccgctctagaactagtggatcccccgggctgcaggaattcgcacgagaccattacctagaacatcctaatcgaaaataactactccgtcactttgtttgcaaagctcctcctcgatccatcgatcactgcaccggccggcggcaccgcgctcgcaggggctagccaacgagacggcagcaatggcggaccgtgaccgcagcgncatctacggcggcgcccacgccaccctacggcagcagcagcagcagggaagaaagcggcgcccgatgggtgaacagtggagggcatgctccacgacagggggccaacgcgtcccaggcgctgaacgggggaaccctgttcccgctgggcggccttgtgttggggttgccggggctggccctaaccccctccgggggggggttggcccgggccaccccggtgttccttatttttaaccccgggttgggcccccccgggtgtgttaatggaagggccgtaaggggttccccccaccccggcgcggttggggtccggggcctttcccccttcaatggccccccaaaagggggggggggggttttcacgccccccccgaataaggtggggagagccccccccagagggggggagggcgcggggcccccggtaaaaaaaaccggggggggggggccccccccttccgggggggggagaaagagccccccnnaagaaaaatatccctccccccccctcgccncaaac

SEQ ID NO: 12899 - DNA, 698 bp, Zea mays
  misc_feature: Ceres CLONE 1372825-F
  misc_feature: Encodes the peptide sequence at SEQ ID NO. 12900
  misc_feature (497)..(497): n is a, c, t, g, unknown, or other
ccccgcggtggcggccgctctagaactagtggatcccccgggctgcaggaattcgcacgagaccattacctagaacatcctaatcaaaagaggtgtgaactgtaatttcagatttcagagcgcgcaagaaccctcttgaccaccgccgccgccgccgcgaagccaagccaaactgagtaagcagctatggagggatccgccgccgctccgctccgcacgcgcatctgcatcatcgggagcggtcccgctgcgcacacggcagccatctacgcggcccgcgcggagctcaagcctgtgctcttcgagggctggatggccaacgacatcgccgcgggcgggcagctcaccaccaccaccgacgtcgagaacttcccgggcttccccaacggcatcatgggcgccgacctcatggacaactgccgcgcgcagtccctgcgctttggcaccacatcctctccgagaccgtcaccgccgtcgacttttcggcctgcccattnccgagtagtgcagactccacaaccgtcctcgccgatgcgggtatcgttgcccacggagccgtcgcgcggcgctccacttcccccggtccgatgcatactggaaccgcgcatctccgctgggccgtctgggacgtgccgccccattctcggaacaggccatcgcggcataggggggcgactccgctatggaggagccattcc

SEQ ID NO: 12900 - protein, 170 aa, Zea mays
  misc_feature: Ceres CLONE 1372825-F
  misc_feature: SWISSPROT Homolog: EC 1.8.1.9 Thioredoxin-disulfide reductase
  misc_feature (104)..(104): Xaa is any aa, unknown, or other
MEGSAAAPLRTRICIIGSGPAAHTAAIYAARAELKPVLFEGWMANDIAAGGQLTTTTDVENFPGFPNGIMGADLMDNCRAQSLRFGTTSSPRPSPPSTFRPAHXRVVQTPQPSSPMRVSLPTEPSRGAPLPPVRCILEPRISAGPSGTCRPILGTGHRGIGGRLRYGGAI

SEQ ID NO: 12901 - DNA, 680 bp, Zea mays
  misc_feature: Ceres CLONE 1372826-F
  misc_feature: Encodes the peptide sequence at SEQ ID NO. 12902
  misc_feature (270)..(270): n is a, c, t, g, unknown, or other
  misc_feature (368)..(368): n is a, c, t, g, unknown, or other
  misc_feature (481)..(481): n is a, c, t, g, unknown, or other
  misc_feature (501)..(501): n is a, c, t, g, unknown, or other
  misc_feature (585)..(585): n is a, c, t, g, unknown, or other
  misc_feature (614)..(614): n is a, c, t, g, unknown, or other
  misc_feature (623)..(623): n is a, c, t, g, unknown, or other
tccccgcggtggcggccgctctagaactagtggatcccccgggctgcaggaattcgcacgagaccattacctagaacatcctaatcgaaaaatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcntgctgcgcggcgtgcgcgtgcgaggcgtgccggacggcggtcggcagcatcggccgccgctccgcccgcatcgcctactgcggcctcttcgcgctctncctcttcgcatcctgggcgctccgcgaggtcgccgcgcccctcctccagtcgatcccatggattaaccacttcccacagacccccgaccgcgagtgggtcgagaccgacgcgntgctcagggtcagcctcggnaacttcctcttttctcaccatctcgccgtcatcatggccggggataaaggaccagaaggacccccgtgacagatcccacacggncggatggatgcccagatcttctgctgggncatcatcgncttcctcatgtctcgggcgcccaaaggggtcgtcagctcttgatcctttttccaggt

SEQ ID NO: 12902 - protein, 108 aa, Zea mays
  misc_feature: Ceres CLONE 1372826-F
  misc_feature (42)..(42): Xaa is any aa, unknown, or other
  misc_feature (80)..(80): Xaa is any aa, unknown, or other
MWAASCLASCCAACACEACRTAVGSIGRRSARIAYCGLFALXLFASWALREVAAPLLQSIPWINHFPQTPDREWVETDAXLRVSLGNFLFSHHLAVIMAGDKGPEGPP

SEQ ID NO: 12903 - DNA, 751 bp, Zea mays
  misc_feature: Ceres CLONE 1372827-F
  misc_feature: Encodes the peptide sequence at SEQ ID NO. 12904
  misc_feature (273)..(273): n is a, c, t, g, unknown, or other
  misc_feature (281)..(281): n is a, c, t, g, unknown, or other
  misc_feature (284)..(284): n is a, c, t, g, unknown, or other
  misc_feature (286)..(286): n is a, c, t, g, unknown, or other
  misc_feature (288)..(288): n is a, c, t, g, unknown, or other
  misc_feature (304)..(304): n is a, c, t, g, unknown, or other
  misc_feature (316)..(316): n is a, c, t, g, unknown, or other
  misc_feature (320)..(320): n is a, c, t, g, unknown, or other
  misc_feature (323)..(323): n is a, c, t, g, unknown, or other
  misc_feature (344)..(344): n is a, c, t, g, unknown, or other
  misc_feature (345)..(345): n is a, c, t, g, unknown, or other
  misc_feature (389)..(389): n is a, c, t, g, unknown, or other
tggagctccccgcggtggcggccgctctagaatagtggatcccccgggctgcaggaattcgcacgagaccattacctagaacatcctaatcgaaaaatccctctctagtctctaccctttccgcctcggcacctccccacccctctcgccttcgcttcgtcgccacggcgagccccacgccgccgatcggggcgccgccagcggcggcggcgcccgatccgatggaagcggagggggggcgccgaatccgccgcggcggagccagcggatcgnagcccgangangngngctctccccggctccntctgggtctggntcgncgnctccgcccccgggctctcccnngcgcgaaggtgggcgcgggcccaccggcctcgggggcttctcgntgcaggctccagctccggcgccggggggagcgaacggaacctcccacgggaaaaggaggaggagggcggaggacggggacgggtgaagacctgcacctgcaaaagccaggggccccaagctttacggggggggctttgctcggggttaatttgaccgaatctgggggaggggaaactttggcaaaacaagccaaattggcagggaactctggggatgggcaacggttttacctcctgaaacctgtccaaaaattcgaaaggtgggccaaaaaaataaggggaaccaaggcataaggggccccccatggggattttaaataaaaagaaaaagggcccccgggaaaaaaaaacccgggtctcct

SEQ ID NO: 12904 - protein, 153 aa, Zea mays
  misc_feature: Ceres CLONE 1372827-F
  misc_feature (18)..(18): Xaa is any aa, unknown, or other
  misc_feature (20)..(20): Xaa is any aa, unknown, or other
  misc_feature (21)..(21): Xaa is any aa, unknown, or other
  misc_feature (22)..(22): Xaa is any aa, unknown, or other
  misc_feature (23)..(23): Xaa is any aa, unknown, or other
  misc_feature (28)..(28): Xaa is any aa, unknown, or other
  misc_feature (32)..(32): Xaa is any aa, unknown, or other
  misc_feature (42)..(42): Xaa is any aa, unknown, or other
MEAEGGRRIRRGGASGSXPXXXXSPRLXLGLXRRLRPRALPXAKVGAGPPASGASRCRLQLRRRGERTEPPTGKGGGGRRTGTGEDLHLQKPGAPSFTGGALLGVNLTESGGGETLAKQAKLAGNSGDGQRFYLLKPVQKFERWAKKIRGTKA

SEQ ID NO: 12905 - DNA, 722 bp, Zea mays
  misc_feature: Ceres CLONE 1372828-F
  misc_feature (209)..(209): n is a, c, t, g, unknown, or other
  misc_feature (232)..(232): n is a, c, t, g, unknown, or other
  misc_feature (251)..(251): n is a, c, t, g, unknown, or other
  misc_feature (276)..(276): n is a, c, t, g, unknown, or other
  misc_feature (291)..(291): n is a, c, t, g, unknown, or other
tggagctcaccgcggtggcggccgctctagaatagtggatcccccgggctgcaggaattcgcacgagaccattacctagaacatcctaatcgaaaaactactccgtcactttgtttgcaaagctcctcctcgatccatcgatcactgcaccggccggcggcaccgcgctcgcaggggctagccaacgagacggcagcaatggcgaaccngtgacccgcagcgcatctacggncgcgcccacgccacctacnggcagcagcagcagcagggaggaangcggcgcccgatggntgagcaggtgatggcatgctccagacaaaggggcgaacgggtcccagcgctgaacggggtgacactgtcccgcttggcggcctgctgctggtgctttcgggcttgggcttaacacctcccgggtggggttgcccgggcaaccctttttttttgaatttaacccctggtttgccccgcgggttttttaattggaaggggggatggggttccccactcgggggcttgggggtcctgggcttttttccctttaaggtcctccaaaaaaggggggggggggtttcccccccccccccatttatgggggagggccccccgcgggggtgggggggcgcgggggacaccttcaaaaaaaagaggggggggggggcccccttctcgggggggggggggggggcgcccccccaaaaaaaaaaagaagagcccctgtttag

SEQ ID NO: 12906 - DNA, 730 bp, Zea mays
  misc_feature: Ceres CLONE 1372830-F
  misc_feature: Encodes the peptide sequence at SEQ ID NO. 12907
  misc_feature (381)..(381): n is a, c, t, g, unknown, or other
  misc_feature (392)..(392): n is a, c, t, g, unknown, or other
  misc_feature (393)..(393): n is a, c, t, g, unknown, or other
  misc_feature (470)..(470): n is a, c, t, g, unknown, or other
  misc_feature (471)..(471): n is a, c, t, g, unknown, or other
  misc_feature (477)..(477): n is a, c, t, g, unknown, or other
  misc_feature (478)..(478): n is a, c, t, g, unknown, or other
  misc_feature (550)..(550): n is a, c, t, g, unknown, or other
  misc_feature (571)..(571): n is a, c, t, g, unknown, or other
  misc_feature (705)..(705): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
ctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtgttcgaacgggaccgcaaggaggacctgcggtggtgcaagcaggcgtgcgagtggcagtacggaaaggacaccccgcgnaagagggatgnnaagagcgagtgccgcgagcggcacagcaagctgacgcgggcgaggacgggaccagcggcgtggacgcctactctccnngctcgnnaagggggcaaaaggccccgccccagtgcctgcgcccgcacgaagggccagccgtggaagaaccaggagggcnctggggcggtgccgcccgcgnggaactggccgtcgaattggaacaaggagtacggtcgcggcagcgagagcgcgggcaagtggcccggaaaaaggtgcaccgccaccaccgcgggggaattgggggggaaaggcacgctgctggagaaaaaaaancnnnnnnnnnggggggccnnnnnna

SEQ ID NO: 12907 - protein, 173 aa, Zea mays
  misc_feature: Ceres CLONE 1372830-F
  misc_feature (63)..(63): Xaa is any aa, unknown, or other
  misc_feature (89)..(89): Xaa is any aa, unknown, or other
  misc_feature (92)..(92): Xaa is any aa, unknown, or other
  misc_feature (116)..(116): Xaa is any aa, unknown, or other
  misc_feature (123)..(123): Xaa is any aa, unknown, or other
  misc_feature (167)..(167): Xaa is any aa, unknown, or other
  misc_feature (168)..(168): Xaa is any aa, unknown, or other
  misc_feature (169)..(169): Xaa is any aa, unknown, or other
  misc_feature (170)..(170): Xaa is any aa, unknown, or other
  misc_feature (171)..(171): Xaa is any aa, unknown, or other
MGKGSVGASWWAFLLLAGVLLVVAATAGAEDGVFERDRKEDLRWCKQACEWQYGKDTPRKRDXKSECRERHSKLTRARTGPAAWTPTLXARXGGKRPRPSACARTKGQPWKNQEGXGAVPPAXNWPSNWNKEYGRGSESAGKWPGKRCTATTAGELGGKGTLLEKKXXXXXGA

SEQ ID NO: 12908 - DNA, 699 bp, Zea mays
  misc_feature: Ceres CLONE 1372832-F
  misc_feature: Encodes the peptide sequence at SEQ ID NO. 12909
  misc_feature (406)..(406): n is a, c, t, g, unknown, or other
  misc_feature (502)..(502): n is a, c, t, g, unknown, or other
tccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttggtgtttcaacaatcgccagccctaatcttgntgcagtcattggtacaaccatcagggcaagcagctgcagcactcgtgctacctgggatcaacaagtagctctggaaaactttctccctactctcanaaacaaaaatttcttccatacaccaatggctaacctgaaccctggtggttatttggagaaaaaatataacattcagccgtttgttttggcgaactccaaaaaaaaaaattttttcctttaaacatttggccccaagaaccccggggttttttgggaagaaaaaaaaaacacatttgcggggtgggggggaaggcggg

SEQ ID NO: 12909 - protein, 104 aa, Zea mays
  misc_feature: Ceres CLONE 1372832-F
  misc_feature (83)..(83): Xaa is any aa, unknown, or other
MATKIFSLLMLLALSACVANATIFPQCSQAPIASLLPPYLPSMIASVCENPALQPYRLQQAIAASNIPLSPLVFQQSPALILXQSLVQPSGQAAAALVLPGINK

SEQ ID NO: 12910 - DNA, 687 bp, Zea mays
  misc_feature: Ceres CLONE 1372833-F
  misc_feature (636)..(636): n is a, c, t, g, unknown, or other
tccccgcggtggcggccgctctagaactagtggatcccccgggctgcaggaattcgcacgagaccattacctagaacatcctaatcgaaaaatcccgcatctgctgttctttatttctatacatacatatatactatcaccggttatttgcttctctattctgtccgagtactttacggtgttccgcacatagatctcgtggccggcggttttgcgctttcgcttgcgtttcttggccctgctggtgtttgaccggaccgaacgggggcagatcgatgctttgggtttgaagcggagctcctatcattccaatgaagggtcgtaccgaagggccggttccgctgctcgttcatggttcccactatcctatctcatcatgtgtatatatgtatgtattccatggggggagggtttctctcgtctttgagataggcttgtggtttgcatgaccgaggagctgcaccgcccctttgctgccgctcttttggattgaagggagctctgcatcctgatcacccctccatttttttttgcttggtgcgtccttctggggacctgagatcgaaggctcgtggtggctcactgtagcctcgctacactgttttctctctctctggggctatttgctgttctctngattccttagcggggctatcccgggtgaggttacgaagagacgttgttgcg

SEQ ID NO: 12911 - DNA, 690 bp, Zea mays
  misc_feature: Ceres CLONE 1372834-F
  misc_feature: Encodes the peptide sequence at SEQ ID NO. 12912
  misc_feature (456)..(456): n is a, c, t, g, unknown, or other
  misc_feature (511)..(511): n is a, c, t, g, unknown, or other
cgcggtggcggccgctctagaactagtggatcccccgggctgcaggaattcgcacgagaccattacctagaacatcctaatcgaaaaatcgcacaaatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggnttcggcggttaggtcgcccctctcccggtggcgattacgtggtggcggtggcggnccgtgttgtgttcttggtctagtaggctgtgtgtctttaatcgggctgttttcggggggggggtggactgcatccgtctagtttcaagccatgggctgaaatatctcgcctgtgaaacaatggaatgccctctttccagcccaaaaaaaaaaaaaaaagctatcgtacgcccacctccg

SEQ ID NO: 12912 - protein, 103 aa, Zea mays; identical to SEQ ID NO: 6459
  misc_feature: Ceres CLONE 1372834-F
  misc_feature (25)..(94): Pfam Name: Histone Pfam Description: Core histone H2A/H2B/H3/H4

SEQ ID NO: 12913 - DNA, 702 bp, Zea mays
  misc_feature: Ceres CLONE 1372835-F
  misc_feature: Encodes the peptide sequence at SEQ ID NO. 12914
  misc_feature (124)..(124): n is a, c, t, g, unknown, or other
  misc_feature (244)..(244): n is a, c, t, g, unknown, or other
  misc_feature (265)..(265): n is a, c, t, g, unknown, or other
  misc_feature (270)..(270): n is a, c, t, g, unknown, or other
  misc_feature (272)..(272): n is a, c, t, g, unknown, or other
  misc_feature (438)..(438): n is a, c, t, g, unknown, or other
  misc_feature (439)..(439): n is a, c, t, g, unknown, or other
  misc_feature (530)..(530): n is a, c, t, g, unknown, or other
  misc_feature (605)..(605): n is a, c, t, g, unknown, or other
  misc_feature (608)..(608): n is a, c, t, g, unknown, or other
  misc_feature (635)..(635): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
ccccgcggtggcggccgctctagaatagtggatcccccgggctgcaggattcgcacgagacattacctagaacatcctaatcgaaaatcgcacatattattgagaccaactagcaacatagaangcacaatagtgtaccaacaatggcagccaaaatattttgcctccttatgctccttggtctttctgcaagtgctgctacggcgaccattttcccgcaatgctcgcaagctcctatagcttnccttcttccccgtacctctcnacagngntgtcttcggtatgtgaaaacccaattcttcacccctacaggatccaacagggcatcacagctggcatcttacctttatcacccttgtcccctcaacatcatcagccctattacatcagttacctttggtgcatttattggcacaaacatcagggcacaacactacnnacacttgtgctagcaaaccttgctggctactctcagcacagcagtttcttccattcaacaactagctgcattgaactctgctttctatttngcacaaacaacactaccattcagccagctacctgctgcctacccccagaattttctttcattcaaccaaactggnagnattgaactctccgtgtttatttacagnaggaacaaactactaccattccaccgggttagttgttccccnnnnnnnnnnnnnnnnnnnnnnnnnn

SEQ ID NO: 12914 - protein, 102 aa, Zea mays
  misc_feature: Ceres CLONE 1372835-F
  misc_feature (34)..(34): Xaa is any aa, unknown, or other
  misc_feature (41)..(41): Xaa is any aa, unknown, or other
  misc_feature (43)..(43): Xaa is any aa, unknown, or other
  misc_feature (99)..(99): Xaa is any aa, unknown, or other
MAAKIFCLLMLLGLSASAATATIFPQCSQAPIAXLLPRTSXQXCLRYVKTQFFTPTGSNRASQLASYLYHPCPLNIISPITSVTFGAFIGTNIRAQHYXHLC

SEQ ID NO: 12915 - DNA, 695 bp, Zea mays
  misc_feature: Ceres CLONE 1372836-F
  misc_feature (399)..(399): n is a, c, t, g, unknown, or other
  misc_feature (400)..(400): n is a, c, t, g, unknown, or other
  misc_feature (437)..(437): n is a, c, t, g, unknown, or other
  misc_feature (447)..(447): n is a, c, t, g, unknown, or other
  misc_feature (453)..(453): n is a, c, t, g, unknown, or other
ggagctcaccgcggtggcggccgctctagaatagtggatcccccgggctgcaggaattcgcacgagaccattacctagaacatcctaatcgaaaattccccatctccggataaaagataaggagtgtctctcctttgccatcctcctctctttcagctaagtccctgccccctctctttttcttacattcaggtcctcgcagctcctctcttttttcttgtttctttcgatctgcgagccgtccaagtccagtactcttcttttcctcaagaactcttgcagccgccccctctgggttcctcgaattcttgtccccggtccctcctctggtcccgcgtaaatcgtccgtcagaagacacaccgtccccacccccatgttaaccacagtttctctgacgnncgcgtgctccgatgagctgacgtgcttcgaatcgcgntccactcttnctcggngcttctctgtgggtcacgtctctatgacgcatccccctctcagtggtgagtctcgccgtcttccctcttctttctcttgaaatagccttcaaatcatctctaggctccggtttttcccatcttcccccaacccaaccccaaaaaaaagattaatcccaaaagaaaagattcattgcttcttaacccgaaggtcgagcccaaagaaacgaaccaaggaaaaaggcaagggaaaaggaattttc

SEQ ID NO: 12916 - DNA, 743 bp, Zea mays
  misc_feature: Ceres CLONE 1372846-F
  misc_feature (247)..(247): n is a, c, t, g, unknown, or other
  misc_feature (279)..(279): n is a, c, t, g, unknown, or other
  misc_feature (297)..(297): n is a, c, t, g, unknown, or other
  misc_feature (312)..(312): n is a, c, t, g, unknown, or other
aagctggagctcaccgcggtggcggccgctctagaactagtggatcccccgggctgcaggaattcgcacgagaccattacctagaacatcctaatcgaaaaaggcttcagctgtccgcccgcggaccacccctccgccgtctccaccattccgccgttcccaccacgccactcgccagttcggcactccctcctgtctcccccccttgccgagacggcgcggacgccccgtcgcccaccccgatggntgccactctcctccacggcgccaccgcctcgnttcagagctcctcccagnccggacgcggcgggnggcggcaaccgccttttcacccccttcggggttccacccattcattacggctcggggggttcctcggtttcgtccaatcgccggctccaaggtttaaccccgggagggtttcggcgggttcctggtttcggggggaggggaaaccccccgggggcccccccggtttttcccccccccctaaaagggggaaaaaaaatggaggggtccaaaaggggggggaaaacaagggtataacccccccccggggaaaaataaaccccggagaggggcccagaaaaatttggaaaagaaaatggggggaagaaatttaaaagggtggggggcctcctcgggataatgaagcccccctgctaatggggggggacatattttttttctcccccccacagaggggggggggggggggtctttcttcggaaaaaccacctcta

SEQ ID NO: 12917 - DNA, 733 bp, Zea mays
  misc_feature: Ceres CLONE 1372847-F
  misc_feature: Encodes the peptide sequence at SEQ ID NO. 12918
  misc_feature (333)..(333): n is a, c, t, g, unknown, or other
aagctggagctccccgcggtggcggccgctctagaactagtggatcccccgggctgcaggaattcgcacgagaccattacctagaacatcctaatcgaaaaatatttgctgcgcactcatctccctcagctagctcgaccgcctctctctggtctctagcgctgtggagctccttcctacgtgcgctagccgccaggtcgtcttcaacctccatccgtggagctcgctccctagccgagtttttccatggtgccctggatgccagcccctttactcgatgcccctgctaggttcctggcatgttcgcccagaccgatgcctagctcccatggncgccctggatctccatggttgagttttctccctgcaggatccccccaatagcgcctggtctttttcccttgtcgaaaacacctctggtgctgcccctccctggaactcgcctcccgctctgcttgtccatttcctgcaacaacctgatgatcccttttccctccctcccatggtgaagcactaaaccccccccctggtgaggggccacgtcccctcctcccgggaaccaaggccccttcccctggcccctgggatttttttccaagccccccacctgggaaaacttcccgggttggggggggaaaaactccaaatttaaaagaaaccccccccccgggttttggggaacacccccaccggggggggtggggaaccccccgcggacagaaggattatatgg

SEQ ID NO: 12918 - protein, 45 aa, Zea mays
  misc_feature: Ceres CLONE 1372847-F
MVPWMPAPLLDAPARFLACSPRPMPSSHGRPGSPWLSFLPAGSPQ

SEQ ID NO: 12919 - DNA, 776 bp, Zea mays
  misc_feature: Ceres CLONE 1372849-F2
aaagctggagctccccgcggtggcggccgctctagaactagtggatcccccgggctgcaggaattctgaccacaccattacctataacatcctattctagaaaagaagaagacatcggctttcaggcggcctccaatcttgatcgtcatcggcgacccaacctgtgatcccaagtctctacagcatgctctgggaaagggagccatacagtatgaagagtttctgaaaaccggtgacccggagttcagatggaagccaccgaaggacgagtggcagagcatcgccctaggctacacttctgggactacttccagcccaaagggcgtcgtgttgcatcaccgcggtgcttatctcatggcactcaccgttgccatcgtgtgggtggatgcctgaaaggggctgtctacttgaggactctgcccatcgtccattgcaatggtatggggtacccctgggcgcttgcaaaccttctgccgaaaaaccatatgggcttcccccggggagtcacaaaagcccttaaacgaagggcttcccgaaacaagggaagggacccacttttggggcccaacccgggaggtccctttaaaaacctgaatcaaacgcttcagaaaaagaaaaaatttctttgccccttgcccccggggcgttcagggtcacacagttgccccaaaaacccccccaaaaccctttccctgggtgaggggggtagagcccactcgagagggtcccggggtccaaaaaacaagaggcccctccaaaaaaattccgcgcccccc

SEQ ID NO: 12920 - DNA, 776 bp, Zea mays; identical to SEQ ID NO: 12919
  misc_feature: Ceres CLONE 1372849-F
  misc_feature: Encodes the peptide sequence at SEQ ID NO. 12921

SEQ ID NO: 12921 - protein, 32 aa, Zea mays
  misc_feature: Ceres CLONE 1372849-F
KLELPAVAAALELVDPPGCRNSDHTITYNILF

SEQ ID NO: 12922 - DNA, 637 bp, Zea mays
  misc_feature: Ceres CLONE 1372856-F
  misc_feature (421)..(421): n is a, c, t, g, unknown, or other
  misc_feature (428)..(428): n is a, c, t, g, unknown, or other
ccccgcggtggcggccgctctagaactagtggatcccccgggctgcaggaattcgcacgagaccattacctagaacatcctaatcgaaaaaactactccgacactttgtttgcaaagctcctcctcaatccatccatcactgcaccggccgatggcatcgcgctcgctattcctcaacaacgacaccgcagaaatgtcgtgaccgtgaccgcactgcgatctaatgtgtcgtgcacgccagctacgaatgaacatgatgaacacaaagaaggcgtgagcccgatgtatgattacagatacgtgatgctacacgacgagagcacgacggcgacacaggagctgacgaggtgactctgtacccgctgaaaggctgctgctgcagtcctctactgcgctgacgacttctggtgtgcaggcgtgncacgctntgttctgatatcagcacgagtgcacccgcgaagtgctctcgtacgccgtcagaaagcatctgtgggagcattgggtccccgcccagaacaggtcatggaatggctggggcctggaaaataacgtggcgcaatctcacgggagaagggaacctggttcggctgggccaacctccggcccgcccttccctgaaggataaaagggaaaaggt

SEQ ID NO: 12923 - DNA, 726 bp, Zea mays
  misc_feature: Ceres CLONE 1372857-F
  misc_feature (18)..(18): n is a, c, t, g, unknown, or other
  misc_feature (19)..(19): n is a, c, t, g, unknown, or other
  misc_feature (27)..(27): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
tgttttgtggtttgtttnncgcgggcncgctccggggggggggggnnnnnnnaaaaagatggagctccccgcggtggcgggcgctctagaactagtggatcccccgggctgcaggaattcgcacgagaccattacctagaacatcctaatcgaaaagtaccacgttcaaaacggcaaggcgatcgatctgaaaccacagatcgatcgacgaccagcagaagacgacgtacgtgaaaccgcgagacagtgcgaggacgactggggtgggggggtgcgatccatcgacaaggccatgggacaacggcgctttgaggacgaacgcgcagctctggcgactgggggaagcttggtgctcatcctaacgacaggccaagctggtgctgctggtggttctggacgccatctgtctttgcccacgcagaaggggggggcggcgcgcatgaacgacaccagtaggagtgacatgcaggtcatcacacccgcgccgctcgctatctcgacggcggctcgaatgggggccggacgggtgctccggggaggacgtggcggtgtaccagagcagcgccaaccctctgcccagcggcatcccggcctacagcgtgggcatcatcaacggctgcgagcggggggtggcaccgtctacggacgtccacggtgtcctgcgggggacttccgcgtccacgggaggctgggtcgacccggggcaaggttcccaggcgcggcggg

SEQ ID NO: 12924 - DNA, 727 bp, Zea mays
  misc_feature: Ceres CLONE 1372859-F
  misc_feature: Encodes the peptide sequence at SEQ ID NO. 12925
  misc_feature (600)..(600): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
cgctctagaactagtggatcccccgggctgcaggaattcgcacgagaccattacctagaacatcctaatcgaaaagaatgaaacccgattcacaaaaccctagcgacctcgattcctcaccagcatggccgtcggcccctactctctcggcctctctccgccgccgcggcttgataccatcctcttcccacagctgcggcctcacctacgccgccgcgtgcctgctcgggttgctgcagccggcactagctggtctcccgccgccggtgactccgaagacggggtcggcggctggtggtttcccgagtacgagaaatcgatgaaacaggcgagggggaggattgggtttaagagagctgtcgtggttgggttgggagcttctgcggcgatcgccttggctgggctggcgtggcgcttcccatcttcccagaagcgtatacagcaactcattgttgctccattacactatattcaagagaaattgccaacaatagagtcaacagagacaatcaaggaggatgcaagtgacaggggatctgatgaattgagtctaggacgctgtagagtgacatatgtgtcaggaatacgaacatgcgcttncattgatcacgactggtggagtactgtgaacacaatggaagctctgtaagccnnnnnnnnnnnnnnnnnnnnnnnnnnnnnnnnnnnnnnnnnnnnnnnnnnnnnnnnnnnnnnnnnnnnnnnnnnn

SEQ ID NO: 12925 - protein, 174 aa, Zea mays
  misc_feature: Ceres CLONE 1372859-F
  misc_feature (159)..(159): Xaa is any aa, unknown, or other
MAVGPYSLGLSPPPRLDTILFPQLRPHLRRRVPARVAAAGTSWSPAAGDSEDGVGGWWFPEYEKSMKQARGRIGFKRAVVVGLGASAAIALAGLAWRFPSSQKRIQQLIVAPLHYIQEKLPTIESTETIKEDASDRGSDELSLGRCRVTYVSGIRTCAXIDHDWWSTVNTMEAL

SEQ ID NO: 12926 - DNA, 552 bp, Zea mays
  misc_feature: Ceres CLONE 1372860-F
  misc_feature: Encodes the peptide sequence at SEQ ID NO. 12927
  misc_feature (250)..(250): n is a, c, t, g, unknown, or other
tctgaactagtggatcccccgggctgcaggaattcgcacgagaccattacctagaacatcctaatcgaaaaaaatttcactttccttctctcctctcctcctgctgctactaggttcgggccgtccgtccttgctcttgatctgcattatttaattcggaccattcccccgccgtcctcccgccccctggcggaatgagatgagacggcacgccagtaccggtggccgcatggcagcggaactggggagngtcgcctccgcctctcgcctccaaaacggcaaggtggcctccttctattgagaagtaagggatgggggtgttttgagggaaaaactggccctacagggacggaaagttttttctgggggcccttttaccgaacggaaaggggaaacttgccaatacatttgccccggttataaaattcttgggaaacgaaagggttttttcccgcccccccgtttttgtggggaggcgccgccaaaaaaccccaaatatttgtggggtttttttgggcgccccccccccttttgtggggggggaaaatgtat

SEQ ID NO: 12927 - protein, 33 aa, Zea mays
  misc_feature: Ceres CLONE 1372860-F
  misc_feature (17)..(17): Xaa is any aa, unknown, or other
MRRHASTGGRMAAELGXVASASRLQNGKVASFY

SEQ ID NO: 12928 - DNA, 761 bp, Zea mays
  misc_feature: Ceres CLONE 1372865-F
  misc_feature: Encodes the peptide sequence at SEQ ID NO. 12929
  misc_feature (427)..(427): n is a, c, t, g, unknown, or other
  misc_feature (428)..(428): n is a, c, t, g, unknown, or other
  misc_feature (430)..(430): n is a, c, t, g, unknown, or other
  misc_feature (431)..(431): n is a, c, t, g, unknown, or other
  misc_feature (547)..(547): n is a, c, t, g, unknown, or other
aaagctggagctccccgcggtggcggccgctctagaactagtggatcccccgggctgcaggaattcgcacgagaccattacctagaacatcctaatcgaaaaatctacctcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgacccttcgcgggtcgatgctggtgctgtccgggctgatcctgggcggcaccgtgatcgcgctcacggtggcacccccgtgctgtgatctcagcgnngnnttggggggccggccccctatcggctgggggttttgggggcccggttcgtcccctccggggcctcggggtccttgggctgcccggggtttccctgtatggccgggtcctggaggggnaggcccccgcgggggcgccacccgtggggccccccccaggggggggtggggggccaagggccccgggacttagggtgggggaaaagaccccctttcaacagggggggggggttttgaaaagaaaaacccctcgggggggggcggggggggggcctctttaaaaaacgtgggggggggggggatatatggccctaaaggggggggggggtgccta

SEQ ID NO: 12929 - protein, 142 aa, Zea mays
  misc_feature: Ceres CLONE 1372865-F
  misc_feature (79)..(79): Xaa is any aa, unknown, or other
  misc_feature (80)..(80): Xaa is any aa, unknown, or other
  misc_feature (119)..(119): Xaa is any aa, unknown, or other
MADHHRGATGGGGGYGDLQRGGGMHGEAQQQQKQGAMMTALKAATAATLRGSMLVLSGLILGGTVIALTVAPPCCDLSXXLGGRPPIGWGFWGPGSSPPGPRGPWAARGFPVWPGPGGXGPRGGATRGAPPRGGWGAKGPGT

SEQ ID NO: 12930 - DNA, 660 bp, Zea mays
  misc_feature: Ceres CLONE 1372869-F
  misc_feature: Encodes the peptide sequence at SEQ ID NO. 12931
  misc_feature (344)..(344): n is a, c, t, g, unknown, or other
  misc_feature (599)..(599): n is a, c, t, g, unknown, or other
  misc_feature (616)..(616): n is a, c, t, g, unknown, or other
  misc_feature (639)..(639): n is a, c, t, g, unknown, or other
ggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggaanggggggaatcggggaaggaggaggtgagggagtatgagagcgacatgaggaagctggaggagctgctttctaagctgaacccctcggcggaggagttcgtgccgcagtcccgccgccgcgtggacggcggcgctccccgcctttcggccgacgcgcccgtgttcgtgtcgccggcgatcgactactacgcgcgccaccaccagctcccgccgccgcagcttctgcagcagcagcagccgatgcacgtgctgcagntttgtgggtggcgtccngcgggtttggcatggggtggcgnccccggggggatggactccag

SEQ ID NO: 12931 - protein, 90 aa, Zea mays
  misc_feature: Ceres CLONE 1372869-F
  misc_feature (6)..(23): Pfam Name: PAM2 Pfam Description: Ataxin-2 C-terminal region
  misc_feature (71)..(71): Xaa is any aa, unknown, or other
  misc_feature (84)..(84): Xaa is any aa, unknown, or other
MRKLEELLSKLNPSAEEFVPQSRRRVDGGAPRLSADAPVFVSPAIDYYARHHQLPPPQLLQQQQPMHVLQXCGWRPAGLAWGGXPGGMDS

SEQ ID NO: 12932 - DNA, 1530 bp, Zea mays
  misc_feature: Ceres CLONE 1372870
  misc_feature: Encodes the peptide sequence at SEQ ID NO. 12933
aagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgcccccgcctgggccaagccagagcctgcctctgttctgccaggtggccgccgccgtggacggcggcgggcaggggaggaagaggctgctggtggtggtcggcggctgggacccggagacgtgggcgccgacggacgcggtgctcgtctacgacttcctgtcgggcgcgtggcggcgcggcgcgcccatgcccggcccgcgcaggtccttcttcgcctgcgcggccgtgggcggcgccgtgtacgtggccggcggccacgacgccgagaagaacgcgctgcgctcggcgctggcctacgacccgggcgccgacgcgtgggcggggctcccggacatggcggaggagcgcgacgagccgcgcgggctctgcgtcgccggacgcttcgtcgtcgtcggcgggtacccgacgcgggcgcagggccgcttcgtcgcctccgcggagtccttcgacccggcggcggcggcgtcgcccgcctggggctgggcgcccgtccacgaccgcctgctgcccgaggacggcgcgtgcccgaggacctgctgcgccgcgccgcggtccgtcggccgcatgtacatgctccgcgacgggcacctcgtggcgcgcgacggcgccgcggcgtggcgccccgtggcgcgggtgccagacgacgcgctcaccgcgccggccgtctccgccttccctgacggccgcgtcgtggtcgttgggtccgggtgccacggcggggaccagaccgtgtacgtgctccgcgaggagggcgggagacctgcgtcctggtcgcgcgcgccgccgccgccgccggagttcgccgggcacgtgcaggcctcctgcttccttgaactctgaactctgaagtggagggtgtgtacctacacgtacgtggtggctgtgcatacatgacggaactacgctaccgtacttgttgtgccactgctgcagtgctgctagtctgctactcatcacggttgtatatacttagcaaataaatcatcacggttgtatgtacttagcaaataaagcagcggaacgggaatgatgtttattaaagaacatttccaggctaaaaaaaaaaaaaaaaaaaaaaaaaaaaaaaaaaaaaaaaaagaaaaaaaaaaaaaaaa

SEQ ID NO: 12933 - protein, 383 aa, Zea mays
  misc_feature: Ceres CLONE 1372870
  misc_feature (115)..(168): Pfam Name: Kelch_1 Pfam Description: Kelch motif
  misc_feature (171)..(217): Pfam Name: Kelch_1 Pfam Description: Kelch motif
  misc_feature (3)..(50): Pfam Name: F-box Pfam Description: F-box domain
MGDLIPGLPDEVARECLVRVGFDQLPVVRRISRQWKSEVESPDYHRQRRAEGLARPVLALVQAQPTAPPDDDDDAGPAHKRSTAANSYRLVLLEPAEGRWTPLPPPPGPSQSLPLFCQVAAAVDGGGQGRKRLLVVVGGWDPETWAPTDAVLVYDFLSGAWRRGAPMPGPRRSFFACAAVGGAVYVAGGHDAEKNALRSALAYDPGADAWAGLPDMAEERDEPRGLCVAGRFVVVGGYPTRAQGRFVASAESFDPAAAASPAWGWAPVHDRLLPEDGACPRTCCAAPRSVGRMYMLRDGHLVARDGAAAWRPVARVPDDALTAPAVSAFPDGRVVVVGSGCHGGDQTVYVLREEGGRPASWSRAPPPPPEFAGHVQASCFLEL

SEQ ID NO: 12934 - DNA, 756 bp, Zea mays
  misc_feature: Ceres CLONE 1372872-F
aaagctggagctccccgcggtggcggccgctctataactagtggatcccccgggctgcaggaattcgcacgagaccattacctagaacatcctaatcgaaaagttctgttctgttctgtcctgtccatcacaattcacgcgacgacgacccggcctgcgggcagatctttcttgacctagccagctcgttcttggcgcactagctagccagccagctagtagctatcctcgctcctccccaccgtcctcagtgctagactattcgtccgatgggcggcgtccaactcgacgacctctccgaattggccgtgctccggccgatccagacagcggcagcggctcggccgccgggcgacgacgccgaagacgggccggacgccgccgacacgggctgcgtcacgccaacgggctcgagcttccggctgatgcccatgcgccgccgggacggcggttgcggcgccctggacagtaccgacgcccgccgccgccgcctgggtcacgcggggggggtcacttggctggctggggccggcccgggggggccccccggggcccgaaaacccgggaaaaggcgggcccggccccccgcccaaaaaaaaaaaagaaaagctttgtttgtgggccccccccttttttcccgcgggcggaaagaactttccccgcggggggtctctggcccccccaaagtccccccccccagggggcccccccccccccacaaaagagccccccccggcgcccccccgcgggggtggg

SEQ ID NO: 12935 - DNA, 723 bp, Zea mays
  misc_feature: Ceres CLONE 1372873-F
  misc_feature: Encodes the peptide sequence at SEQ ID NO. 12936
  misc_feature (500)..(500): n is a, c, t, g, unknown, or other
aagctggagctccccgcggtggcggccgctctagaactagtggatcccccgggctgcaggaattcgcacgagaccattacctagaacatcctaatcgaaaaactagtgatcagaccagtgagctagcgactgtaccatgcagcagctgtaggagagcctggtggtaggtaggataggagtagcgccagccgccaagtgcgcgtccgggctggctgcttcgacgagcaggagggagccgcaccgccgggctcccgcaatgtcgcctcctccgcccccgccgctgctgcgcaacgagctgtcgcgcaggacggcggtgctgggcctgcgcctgtgggtgctggtgggcatcgccgtcggggccgccttcgtgctgctcctcgtgctcatctccctccacctcgccgcggcgcggcggaggcggcccaggaagggcgtcgcgacgcgccgggcgggggcggccgccgctgtccccgtccaccatcccgcccgggtccaagganatccagggaggtggcccgtccacgtcggctcgctccgccactacctggagacggggcacgcgttcctcaaggacggcggcgacggcgacggcgacggcgagtccgtggcgcacgggtcgcagcgcgtccacatcgaggccggcagggccagcgcatggtcgcggcggcttccgacgcgctgtccggcggcgggggggcccccgagtgtcgcacctcggctggg

SEQ ID NO: 12936 - protein, 155 aa, Zea mays
  misc_feature: Ceres CLONE 1372873-F
  misc_feature (82)..(82): Xaa is any aa, unknown, or other
MSPPPPPPLLRNELSRRTAVLGLRLWVLVGIAVGAAFVLLLVLISLHLAAARRRRPRKGVATRRAGAAAAVPVHHPARVQGXPGRWPVHVGSLRHYLETGHAFLKDGGDGDGDGESVAHGSQRVHIEAGRASAWSRRLPTRCPAAGGPPSVAPRL

SEQ ID NO: 12937 - DNA, 615 bp, Zea mays
  misc_feature: Ceres CLONE 1372875-F
  misc_feature: Encodes the peptide sequence at SEQ ID NO. 12938
  misc_feature (495)..(495): n is a, c, t, g, unknown, or other
ctagaactagtggatcccccgggctgcaggaattcgcacgagaccattacctagaacatcctaatcaaaaatcgcacaaatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcgggtaggtcgcccctctcccggtggcgaattacgtgatggcgctggcggnccgtgttgtggtcttggtctaagtaagcagggtggccttaatcggggctgtttgcccgggggggggctgtactggattcattctagtttctaggccaagggggtgaagaatctcggctgc

SEQ ID NO: 12938 - protein, 103 aa, Zea mays; identical to SEQ ID NO: 6459
  misc_feature: Ceres CLONE 1372875-F
  misc_feature (25)..(94): Pfam Name: Histone Pfam Description: Core histone H2A/H2B/H3/H4

SEQ ID NO: 12939 - DNA, 659 bp, Zea mays
  misc_feature: Ceres CLONE 1372876-F
  misc_feature: Encodes the peptide sequence at SEQ ID NO. 12940
  misc_feature (454)..(454): n is a, c, t, g, unknown, or other
  misc_feature (472)..(472): n is a, c, t, g, unknown, or other
  misc_feature (486)..(486): n is a, c, t, g, unknown, or other
tggagctccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttngccgagcatgatgtcgcnaatgatgatgccancaatgtcactggcgacggccgtctcgcaagattatggctggcaccaggaatttacccttccatggtccaaccccatgggccatggacgaattcccccccatgggtcttaaaaagaaccccctttggggggggggcggccctttctaaaaaaaaaaaaaattggggtggaccca

SEQ ID NO: 12940 - protein, 167 aa, Zea mays
  misc_feature: Ceres CLONE 1372876-F
  misc_feature (99)..(99): Xaa is any aa, unknown, or other
  misc_feature (110)..(110): Xaa is any aa, unknown, or other
MAAKMLALFALLALCASATSATHIPGHLPPVMPLGTMNPCMQYCMMQQGLASLMACPSLMLQQLLALPLQTMPVMMPQMMTPNMMSPLMMPSMMSPMVXAEHDVANDDAXNVTGDGRLARLWLAPGIYPSMVQPHGPWTNSPPWVLKRTPFGGGAALSKKKKNWGGP

SEQ ID NO: 12941 - DNA, 673 bp, Zea mays
  misc_feature: Ceres CLONE 1372885-F
  misc_feature: Encodes the peptide sequence at SEQ ID NO. 12942
  misc_feature (583)..(583): n is a, c, t, g, unknown, or other
  misc_feature (587)..(587): n is a, c, t, g, unknown, or other
  misc_feature (588)..(588): n is a, c, t, g, unknown, or other
  misc_feature (625)..(625): n is a, c, t, g, unknown, or other
tggagctccccgcggtggcggccgctctagaactagtggatcccccgggctgcaggaattcgcacgagaccattacctagaacatcctaatcgaaaaacaactttcgcccaattccccactagcaaccgtccccacaatcctccgacgatgcctgccgcgccgacgctgttgcccccgtgcgacgcggaggagccgctgctggcggagtcctccgaccgcttctccatgttcccgatccgtttcccgcagatctgggagttctacaagaaggcggtggcctccttctggacggcggaggaggttgacctctctgccgacgcccggcactgggacgaggcgctgtcccccgacgagcggcacttcatctcccacgtgctcgccttcttcgctgcatccgacggcatcgtgctcgagaacctcgcttcccgcttcatgaccgacgtgcaggtcgccgaggcgcgggccttctacggcttccagatcgccatcgagaacatccactcggagatgtattcgctgctgctcgagacctacatccgcgaccacgtcgagaaggaccgcctgttccgcccatcgatacgntggnncgcggtccggcgcaaggctgactgggccatgcgctgnattgaccggcgggagcgcttcgccgagcgcatcgttgccttcgccctt

SEQ ID NO: 12942 - protein, 175 aa, Zea mays
  misc_feature: Ceres CLONE 1372885-F
  misc_feature (15)..(175): Pfam Name: Ribonuc_red_sm Pfam Description: Ribonucleotide reductase, small chain
  misc_feature: SWISSPROT Homolog: EC 1.17.4.1 Ribonucleoside-diphosphate reductase
  misc_feature (147)..(147): Xaa is any aa, unknown, or other
  misc_feature (159)..(159): Xaa is any aa, unknown, or other
MPAAPTLLPPCDAEEPLLAESSDRFSMFPIRFPQIWEFYKKAVASFWTAEEVDLSADARHWDEALSPDERHFISHVLAFFAASDGIVLENLASRFMTDVQVAEARAFYGFQIAIENIHSEMYSLLLETYIRDHVEKDRLFRPSIRWXAVRRKADWAMRXIDRRERFAERIVAFAL

SEQ ID NO: 12943 - DNA, 640 bp, Zea mays
  misc_feature: Ceres CLONE 1372891-F
  misc_feature: Encodes the peptide sequence at SEQ ID NO. 12944
tccccgcggtggcggccgctctagaactagtggatcccccgggctgcaggaattcgcacgagaccattacctagaacatcctaatcgaaaaaccccactccgccccacctccgcgcctcagatccatccccaaccggcaaccctagcgccgggttcctcctcctcggatccgcccgccgccgcgcggactccattgccagaggtgatcgagggggagagatagagcttgggtggtcggattatggagagagggaggggaggatgtccagacggtcgttgaacccgagccggcgggtggcggacggcggtctgccgacagtcggaggcctgttccaccccaagtcacgctcgcctcccgtgcttactattgccctagtcgtcctggatgtcattcttctcgtcgcctacttcagcagcggatcaggtcggtataaagattctcggtgtaactgttacaagcagagagtctgtgaccaggtctgaaggtgcttgcacatgagaaggtatgcgcggggttccatatcttaaaagggcatatggaaatgccatggaaaaggatctccatgtggcccctgatagttgtgcagtagtttctacttggttgaaagaagggaaagctgtagcttgtttagaggaacct

SEQ ID NO: 12944 - protein, 73 aa, Zea mays
  misc_feature: Ceres CLONE 1372891-F
MSRRSLNPSRRVADGGLPTVGGLFHPKSRSPPVLTIALVVLDVILLVAYFSSGSGRYKDSRCNCYKQRVCDQV

SEQ ID NO: 12945 - DNA, 642 bp, Zea mays
  misc_feature: Ceres CLONE 1372892-F
  misc_feature: Encodes the peptide sequence at SEQ ID NO. 12946
  misc_feature (342)..(342): n is a, c, t, g, unknown, or other
  misc_feature (368)..(368): n is a, c, t, g, unknown, or other
  misc_feature (522)..(522): n is a, c, t, g, unknown, or other
  misc_feature (523)..(523): n is a, c, t, g, unknown, or other
cgctctagaactagtggatcccccgggctgcaggaattcgcacgagaccattacctagaacatcctaatcgaaaaacactgatccaccaccctccctctagttgagatactgccgccgccgccgccccgcccaacgccaggtgccgaggccttcgccggcgaagagcgccgaccggtacgagatcgaggaagacggccatgttctcatccgcccgccttgccctacgccgagctgcctctcttggggcgggcctctgccgcgccgcggaggatcccttttcgcgaaggtttctccatgggcagctcctcccacgttcctttgcctcagatgcatcgggacancaacaggggtttcccaccttctgggntctggagttgttgcagatacggatccacgtcgaatttaacaggatcttggttttgtgtccaaagatattcgtggctaagacacaggtcaacttcaacacacgataatggaaaggcggcgatgtctgggacaccccgtggccagaacctttcggnntcaaggggagggcttcacagtcaacctccgcacctttgccatggaccacgaaagtattccaagagggagagttttcgcccgtcctactggaagagaagagacctttccggagggggacg

SEQ ID NO: 12946 - protein, 91 aa, Zea mays
  misc_feature: Ceres CLONE 1372892-F
  misc_feature (48)..(48): Xaa is any aa, unknown, or other
  misc_feature (57)..(57): Xaa is any aa, unknown, or other
MFSSARLALRRAASLGAGLCRAAEDPFSRRFLHGQLLPRSFASDASGXQQGFPTFWXLELLQIRIHVEFNRILVLCPKIFVAKTQVNFNTR

SEQ ID NO: 12947 - DNA, 658 bp, Zea mays
  misc_feature: Ceres CLONE 1372897-F
  misc_feature: Encodes the peptide sequence at SEQ ID NO. 12948
  misc_feature (641)..(641): n is a, c, t, g, unknown, or other
gctctagaactagtggatcccccgggctgcaggaattcgcacgagaccattacctagaacatcctaatcgaaaaaaaaattccaaatttgttggtgtacacacgccacaccctaaccaaaacatcctggcgtttcccgctcacccagcgtgcgctccatcttggcgaggccgcgagggagaccgctacagcagtagccgccgccgccggcagatccccaggccttcgttgaacccttccccgtaacgagatcagatggatgggtatatgtcgagagggacccagaatggttctgtgtatgtctgcaatctacctcctggaactgatgaaaatatgctggctgaatattttggcaccataggctgccctaaaaggcatgctactgaccagaaggacaaaaggactgggcgtccacaaatttgcatatacagggactaagctactaatgaaccaaagggtgatgcaccagtcacctatgaggatccacatgctgcttctgctgctgtgaaatgattccacaacattgatttccatgagagcactatgcaggttcacatagctgagtcaacaagcatgatgcattcgatagccccacaagtttgaacatcatgtggtggtgttggtgcacaagatgaactggantatggatgcagcatagg

SEQ ID NO: 12948 - protein, 60 aa, Zea mays
  misc_feature: Ceres CLONE 1372897-F
MDGYMSRGTQNGSVYVCNLPPGTDENMLAEYFGTIGCPKRHATDQKDKRTGRPQICIYRD

SEQ ID NO: 12949 - DNA, 760 bp, Zea mays
  misc_feature: Ceres CLONE 1372907-F
  misc_feature: Translation starting site: 205
  misc_feature (425)..(425): n is a, c, t, g, unknown, or other
  misc_feature (435)..(435): n is a, c, t, g, unknown, or other
  misc_feature (483)..(483): n is a, c, t, g, unknown, or other
  misc_feature (559)..(559): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgaacgcctccgtggntggggctggnccgtggcacgccccgtgtcctgatcttcagccccgtgctcgtccccgncgcgctgctcatcgggacggccgtcatggggtccctcacgtcgggcgcgctgggggcccggggggctggtcctcgntcacgtggctcggcaacacggggggggaggggtttccagcgcaccccggataaagggggaggaggcccaccccaggaagggggggagggcccggggccacccgggcccacaaacccgggagggaggccaggccatcccgggagagggcccaggaggccggccccccgggagagagtgaaggggccccccttttgtgcggag

SEQ ID NO: 12950 - DNA, 649 bp, Zea mays
  misc_feature: Ceres CLONE 1372911-F
  misc_feature: Encodes the peptide sequence at SEQ ID NO. 12951
  misc_feature (590)..(590): n is a, c, t, g, unknown, or other
cgcggtggcggccgctctagaactagtggatcccccgggctgcaggaattcgcacgagaccattacctagaacatcctaatcgaaaaatctgccggtgctcttgaaccgggtcgagtccatctcctgtcggggaccgagcgatctcctttggaccggactgcacaatggggacgagcacactgccgcgtgccatccttcaccctctcgctgctgagcaggctgattcccacattgatggcgctgctgcacccgaccagatgccgggtgtctcttacgacatgcgtgaggctgagaaggagattgatgactacttagctacaatcgccctcgacttcccgaggaaacttgaggagaccagtggatactcgtacgcgaatgtgaagaggttgtagtagcatactgatgccacaatcgaacagctgaagaacgacccatccaggatctccgaagatgttgtgtggatgctcctcaaacatgtctccactgtctagaactgagagagattcctctgtaataatcctatagccctttatgagcatatgcgcctctgaaactgcattgacatgctcaagactcagtctcatatgtnaggtgctaatggtaatgtattcactgccctcgtctatcatgtctgtcgcatcataatac

SEQ ID NO: 12951 - protein, 75 aa, Zea mays
  misc_feature: Ceres CLONE 1372911-F
  misc_feature: SWISSPROT Homolog: EC 3.6.3.14 H(+)-transporting two-sector ATPase
MGTSTLPRAILHPLAAEQADSHIDGAAAPDQMPGVSYDMREAEKEIDDYLATIALDFPRKLEETSGYSYANVKRL

SEQ ID NO: 12952 - DNA, 923 bp, Zea mays
  misc_feature: Ceres CLONE 1372911-R
  misc_feature (923)..(923): n is a, c, t, g, unknown, or other
ttttgtgttacgggtccccctcctgggcgaggtatgtatagactgctgctgctgcccgtgtcctttccgtttacactcttatctgtactcttgtatgtatgtaattttgaaattacatttgcaaagcgtagagaaaaaaaaaaggaaaatgagttgttgagcgggtatgccgcccgccacctagctactacgacgacgacacgaggtgcgcatagagcatctggttccagacgtcgggaacgccggggaggcaccagtggatgcagtcggctccactgctggggtcgcgcgccaactcctccagctccgccgccgtgggcgggctccactgccgccggtgcacagacgggtgcgtgcttgcagtgctcctacagctgcgtgacgttgagcaccagtagggggacaccgtgcgcgcccagccgcgccacctgggcctaccacgtgcgcgcgaacgcctggtccgtgtcccgcccgcggtgcccctaccccgtgatcgggtccctttccccggaacattgagagggtgtgcggcgccaggtcacggtacccggggggtcttcctggcaattcattcgggaattgtaagtcgccgtcggggcaaaataggtaccttgaaataaaaagccacggcttctgtggatacggatccaaacaattgacaaactgcctgtccaactaccgtaaccgttgttctttttttcctcacttcttgggaaactgccgcgggcaaggacttgttccggttcaacctcttttttataaaaatatacctcctgtgatgcactaccctcgaataatcaaaacacccccttaagtagaactctttaacatatcacacaaggatgtgtaacacacaccaccggtatatgtggatagcgcactcttattataaaacacagtagtaacatgataagagacgattn

SEQ ID NO: 12953 - DNA, 664 bp, Zea mays
  misc_feature: Ceres CLONE 1372917-F
  misc_feature: Encodes the peptide sequence at SEQ ID NO. 12954
  misc_feature (417)..(417): n is a, c, t, g, unknown, or other
  misc_feature (421)..(421): n is a, c, t, g, unknown, or other
  misc_feature (422)..(422): n is a, c, t, g, unknown, or other
  misc_feature (514)..(514): n is a, c, t, g, unknown, or other
tggagctccccgcggtggcggccgctctagaactagtggatcccccgggctgcaggaattcgcacgagaccattacctagaacatcctaatcgaaaagagacccattagcgaccggccagtgatccccgaccccgagtcccgaggccgacgccattcctgattcctccatcttccgttccgccgcaccgccgccggagatatgtcgaggctcgctgctgccgccctccgctgcgtcgtcactgcatcgagagatacctcctcatctcgcttcgccgtgtctgcgccggtgtctgctcggctcttctccgcggatgcatccggtgaagccgccgccacggccgcagagtcgcaggatgactctttcttcaggcatcccgcgaaggattagcctatggaaggttttacagtgtcattgntggnnagcagtcgtcttgagaagacatattggaaactgatattatccatcaccttgacggatgttgattgtcatgggatgatgtgaagattgatacnacagggaaatgctccttggccgctttgcttgaggtttcttcgaagggcatgtttccaccggaattaggcaagcaatccaattcgtttggccaggattgatgaaataatccgggaaactgggattctcaaaatccctccatgggaaagggt

SEQ ID NO: 12954 - protein, 62 aa, Zea mays
  misc_feature: Ceres CLONE 1372917-F
MSRLAAAALRCVVTASRDTSSSRFAVSAPVSARLFSADASGEAAATAAESQDDSFFRHPAKD

SEQ ID NO: 12955 - DNA, 742 bp, Zea mays
  misc_feature: Ceres CLONE 1372919-F
  misc_feature: Encodes the peptide sequence at SEQ ID NO. 12956
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (28)..(28): n is a, c, t, g, unknown, or other
tggggccnnnccnnnnnnnnnccccagnaacgaagcgccgcgcgccccctctacccccgccggtccccgcgggggcggccgctctagaactagtggatcccccgggctgcaggaattcgcacgagaccattacctagaacatcctaatcgaaaagacgctcgacgcctctcctcctctcctcccccacccgtccatcgcccctccctccggtctgcgctcccacagcctcacccctgcgcccccgccgattcgcatcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagagatccttcgcgcagcagcactacgctgacctttccgacaagcctttcttccccgggttggtggagtacatcatttccggccccgtggtggcggatggtgtgggaggggaaggacgtcgtgttgactggccgtaggatcattggggccaccaggccttgggaggcagcccccggtaccattcgtggggactacgccgtggaagtcggcaggtgaacatccctttctttgtactcgatcaggtgtgctttgctggggaatggttttagtttggacactttaatagccatgctctactggtggaactctgggtcagtctaaataaacggggggctttatgaaat

SEQ ID NO: 12956 - protein, 85 aa, Zea mays
  misc_feature: Ceres CLONE 1372919-F
  misc_feature (2)..(82): Pfam Name: NDK Pfam Description: Nucleoside diphosphate kinase
  misc_feature: SWISSPROT Homolog: EC 2.7.4.6 Nucleoside-diphosphate kinase
MEQTFIMIKPDGVQRGLIGDIISRFEKKGFYLKGMKFMNVERSFAQQHYADLSDKPFFPGLVEYIISGPVVADGVGGEGRRVDWP

SEQ ID NO: 12957 - DNA, 636 bp, Zea mays
  misc_feature: Ceres CLONE 1372924-F
gctctagaactagtggatcccccgggctgcaggaattcgcacgagaccattacctagaacatcctaatcgaaaaagacacacaaacacaagtcgtcgtaggcagcgagcgtctctcctctcccacgcatcgcgccaaggaagagagagagatcgccgctccccttctcggcgtcggtggtgcgggtggcctccctcctcgagcgagatctgtctggtcacagatctatctgacaaaatgtgaagatctgctggatcggtgctgggtatgtcggtgggccaaaccatggccggtattgccctcagtggccagaaattgagggtcggccgcggttgcatctcccaacccccgcattgagggcttggaaaggggcacccctggccaacttccaagacttgggctcaatgatgtttttggaaaaaggggaggggaaggaacccccttttttccccctggggttttgaaaacccccccttagggggtgaaatattatctttggttcgggggaaaccccccccaaaaaccccgggggtttgggaattggaaagggtggccccccccccccattggggaaaggccccccccccggattggggggggtttcccaaatttaaaaaaatttttttttgaaaaaccc

SEQ ID NO: 12958 - DNA, 654 bp, Zea mays
  misc_feature: Ceres CLONE 1372927-F
  misc_feature: Encodes the peptide sequence at SEQ ID NO. 12959
  misc_feature (571)..(571): n is a, c, t, g, unknown, or other
gctctagaactagtggatcccccgggctgcaggaattcgcacgagaccattacctagaacatcctaatcgaaaaaccgctgctccacacgggcacacctttgcctcgcccaaccgctgcctcgctcgcgtccgccattccccagacctcgagagctaccgtctggtccgatcggacggaccccttcgcgcgccccagagatttcaggtaaggtgctgcaacagaacatgcaaggcggaataggcgggaggcagggtttattcggtttcgaggacccttctggtggttccggtggatttggacaaccagcgaggcttatgcctgggttttttggcggtgcaaatccctttgacgaccctttcttcacaacccctttggtagcatgatgcacactatcttctcagcccctttcagcggcatgatgcaacctaccttcatgaaccccttcggcagcatggagcaacctagcttgcttgcaccaagtatgtttgcgccccatggcaatctcaatggtagggatgtctggaaggcagacactcctcggtcgaggtatattggatgggcagcggtgntcattcatgaggtgcctgcaaccagcaagtggctaaagggccaatttatcatggagtgatcctcacaccgagggagagggacg

SEQ ID NO: 12959 - protein, 52 aa, Zea mays
  misc_feature: Ceres CLONE 1372927-F
MQGGIGGRQGLFGFEDPSGGSGGFGQPARLMPGFFGGANPFDDPFFTTPLVA

SEQ ID NO: 12960 - DNA, 678 bp, Zea mays
  misc_feature: Ceres CLONE 1372928-F
  misc_feature: Translation starting site: 155
  misc_feature: Pfam Name: Citrate_synt Pfam Description: Citrate synthase
  misc_feature: SWISSPROT Homolog: EC 2.3.3.1 Citrate (Si)-synthase
  misc_feature (314)..(314): n is a, c, t, g, unknown, or other
  misc_feature (557)..(557): n is a, c, t, g, unknown, or other
gcggtggcggccgctctagaactagtggatcccccgggctgcaggaattcgcacgagaccattacctagaacatcctaatcgaaaaaaaaaaaggattagggttctaacaaaatcaagatatttcaccagaggaacacagaggctgtgcttaagatgttgtcagagattgggagtgttgataacattccagagttcatagagggtgtgaagaacaggaagaggaagatgtctggttttggacaccgtgtgtacaaaaactatgacccaagagctaaagtcatcaagaagctagcagatgaagtgttctccattngttggaagagatcctctaattgaagtagccgttgctctggagaaggcagctctttctgatgattactttgttaagaggaagctttatccaaatgttgatttctactctggtttaatctacagggcaatggggtttccaccagagttctttacccgtcttgtttgctattcctcgcatgggctggatacttggtctcattggaaagagtccggtgggatgatcctggacaccaaggatcatgangcccacaacaggggtacaccccccgggaggtgtgggcttaggcatttacacaccagtttaaagggaagagggatggaggcaaaaggaggtcagaacagggttggagtccaagtctctactt

SEQ ID NO: 12961 - DNA, 675 bp, Zea mays
  misc_feature: Ceres CLONE 1372929-F
  misc_feature: Encodes the peptide sequence at SEQ ID NO. 12962
  misc_feature (557)..(557): n is a, c, t, g, unknown, or other
tccccgcggtggcggccgctctagaactagtggatcccccgggctgcaggaattcgcacgagaccattacctagaacatcctaatcgaaaaatatccgcagttcagctccctccccactcgagggtcatagctttattttctcttatcttcgctagatatcttgatgggagtaatcataacttctggcatccttcttcctcctcgctctctacccgaaaagagagtgctgcagagaaatccgaaaccaaagattcaaagtttgcgtaaaggtattctaaaactaagccaccagcgagagagaaaacctccactaagtcccgtgcgaaagcatgaacctcttcagcggcgatcgccgggaagagccccctcgccgtggacgagaactggcgccagcgaagacacgagcccgatcttctgccacaagaagcatagccccgtggcgactctgcggagccaccagcgggttgacgccgtgatgagatctgttcgatctccatatgtcgagcacgagtgatggactctgatgaaacagcgactgctgaccgcgtatctgggnaaggagggagaaaaggaatagaagaacctggttggccggacgggggattaaacccggcgttgaagagaaataagggttagcgacgcagcagctgcgaatattgtcgaggaggagatgg

SEQ ID NO: 12962 - protein, 116 aa, Zea mays
  misc_feature: Ceres CLONE 1372929-F
MGVIITSGILLPPRSLPEKRVLQRNPKPKIQSLRKGILKLSHQRERKPPLSPVRKHEPLQRRSPGRAPSPWTRTGASEDTSPIFCHKKHSPVATLRSHQRVDAVMRSVRSPYVEHE

SEQ ID NO: 12963 - DNA, 690 bp, Zea mays
  misc_feature: Ceres CLONE 1372930-F
  misc_feature: Translation starting site: 122
  misc_feature: Pfam Name: DHO_dh Pfam Description: Dihydroorotate dehydrogenase
  misc_feature: SWISSPROT Homolog: EC 1.3.1.2 Dihydropyrimidine dehydrogenase (NADP(+))
atagctggagctccccgcggtggcggccgctctagaactagtggatcccccgggctgcaggaattcgcacgagaccattacctagaacatcctaatcgaaaaaaacccagaccaccgcaccatggaatcgctgacgcttcgcgcttcgacggccgcctcgccgctgcggcgacgccgggtgctccccggacgggagcgcgcgacgaacgtccgcgccacggcctccgccggagagccggacctctccgtgcgcgtggacgggctgcagatgcccaacccgttcgcgatcgggccggggccaccgggcagcaactacaccgacatgaagcgcgccttcgacgagggctggggcgacgccatcgcctacactgcggcataggatgctgaaaaagacatcagcgacactcctcgttatgcagagcttccggcagaaccaaatcggggctgccatggggagcatcattggctggcagaacattgagctcatcagtgacaggccgctggagaccatgctgaatgagtccaagcagatgaagaaagagtatcctgacaggatacttatcggttcaactatggaggagtacaacaaagctgcatggcatgagcttatcgaacgtgttgcagagtctggagtgcatgctcattgagattactccctcatgtccacatggcatgtcatagagaaaactg

SEQ ID NO: 12964 - DNA, 760 bp, Zea mays
  misc_feature: Ceres CLONE 1372930-R
  misc_feature (644)..(644): n is a, c, t, g, unknown, or other
  misc_feature (760)..(760): n is a, c, t, g, unknown, or other
cgattgggtaccgggccccccctcgaggtcgacggtatcgataagcttttttttttttttttttgagaaaacctgtgcgagattgaagtctccaagattttacaaggtcaagccctcagctcagtgctacaaattaatgttcacatgacaaatatatcgctcaatgtcacccgttgtcacgactttgtgtggattcatggcctgttctatagactgaaggcccaaggttcagaaccatgtacagatgaggactagatgcttggtgtgtggcatttctggtgcgcgtttattaaaaagatgaagttggagcatggtgtaaggaatggcccggtggggggtggcagagatgcatcagttggataccatgctttcggtctctttgacgaacccatcacccgtccaatcccttgtctgattgaaagcccttcttgaatggctttctctgcctgaccgcctcttgttgcccgggaaccagaatctggttgcgtcttgaaataccgaaagcgaggcccccccaaactttccatttgaggaaaaatttggctctccccttaaaatcctggaaactttgccaaaaacttcttttcccaaggggaaaacccctgaaatcttcccccccggggctatccctggccttgtttccncccccaaaaaaaaaaaaacttcaggagaattatttttgcagagtttcccccccccaccaatttgccaaaaaaaaaaatgggttccttttaaaaaaacacttttttttttaaacacn

SEQ ID NO: 12965 - DNA, 702 bp, Zea mays
  misc_feature: Ceres CLONE 1372934-F
  misc_feature: Encodes the peptide sequence at SEQ ID NO. 12966
  misc_feature (420)..(420): n is a, c, t, g, unknown, or other
  misc_feature (421)..(421): n is a, c, t, g, unknown, or other
  misc_feature (460)..(460): n is a, c, t, g, unknown, or other
  misc_feature (481)..(481): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (540)..(540): n is a, c, t, g, unknown, or other
  misc_feature (690)..(690): n is a, c, t, g, unknown, or other
tccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctggtcggggctggcgctgacggctccgtgggttggnngctggccgtggccaccgccggttgttcctgatcttcagnccccgtgctggtccccgccgncgctgctcatcgggaggcgggnnnacatgggtccccccacgtccggcgcgctggggggnttctctgggggggccctgccccttcggctcacggtgccctcgccaacaccgggggggggggaagggcgttcccaggcgcaccccggggactaatagggggggaagggagggcgcaaccgcaaaaataagtgggcgaaaaggcccggcggncggacacggcgg

SEQ ID NO: 12966 - protein, 85 aa, Zea mays
  misc_feature: Ceres CLONE 1372934-F
  misc_feature (76)..(76): Xaa is any aa, unknown, or other
MADRDRSGIYGGAHATYGQQQQQGGGGRPMGEQVKGMLHDKGPTASQALTVATLFPLGGLLLVLVGAGADGSVGWXLAVATAGCS

SEQ ID NO: 12967 - DNA, 670 bp, Zea mays
  misc_feature: Ceres CLONE 1372935-F
  misc_feature (288)..(288): n is a, c, t, g, unknown, or other
  misc_feature (584)..(584): n is a, c, t, g, unknown, or other
ggagctccccgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgattngagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtcttttttcgcctccgtgctctccgggctcttcggccaggccgaggccgaggacgaggacgaggacgaagagatgcccacgcgcaaccacaacgctgccgcggctgccgctccgcagcatcaccatcacaaaccgaggtggtgctcccgctcttggaangaagcaaggccgtgccccggccgagctgatgccatgaaccggcgagccccccctcggcgatattgggcaccctcgtcagcgtcgcc

SEQ ID NO: 12968 - DNA, 684 bp, Zea mays
  misc_feature: Ceres CLONE 1372937-F
  misc_feature (266)..(266): n is a, c, t, g, unknown, or other
  misc_feature (300)..(300): n is a, c, t, g, unknown, or other
  misc_feature (302)..(302): n is a, c, t, g, unknown, or other
aagctggagctccccgcggtggcggccgctctagaactagtggatcccccgggctgcaggaattcgcacgagaccattacctagaacatcctaatcgaaaaattgtggctcctcacttccgcgccgccacccctacaggtaaggaagaggaggagggcaggatgtcgcaccgtaagttcgagcacccgaggcacggctccctcggcttccttcccaggaagcgctcctccccgtcaccgcggcaaggtgaagtcattccctagggnatgaccccagaaagcttgccatctcactggcttncnttggctacaaggctggcatgactcacattggccgggagggtggaaaagccaggatccaaactccctaaaaagggaaactgggggaggttggtaccttaattgaaaccccctcccccttggaattgggggggcccccggggaaaatgggaaaaaccccccggggggccccccgaaaatttaaaattttggtgggggcccccttttttgggaaaaagggggggagggggtttccaaaaaagggggggaaaaaaaaaaaaaaaggtttttccaaaagggggcccccaaaaaaaaaaaaaaaggtggtggaaaaaaaaaaaaaaaccccgcgcccttggggaaaaaaaaaaaaaaaaaattttttttttttttctgcgggggtttc

SEQ ID NO: 12969 - DNA, 652 bp, Zea mays
  misc_feature: Ceres CLONE 1372943-F
  misc_feature: Translation starting site: 338
  misc_feature: Pfam Name: Band_7 Pfam Description: SPFH domain / Band 7 family
cgctctagaactagtggatcccccgggctgcaggaattcgcacgagaccattacctagaacatcctaatcgaaaaatcgaagggtcgacaatggttacgacgatcggtagtccatagcagcggcgggcgcaacttcgacccggttttcttcccatatatctgtcaaatccttctccggttgccctccatcggcagcaatttccgccatagataccggcgatcgagggcctcggacaacccaatcgacggagcagcgcggcggcaggagagggcaaacccttttcttctcagtactctacttgtctgcgcctggatcccctccgcaggaagataagacatgggtcaagcactcgggctcgattcaggtggatcaatcgacagtagccatcaaggaaacttttgggaagttggacgaggtcctagagcctggatgccacttctggcatggggcataagggaacaaaattgctgggtatttgggccctggggggggcacaacctggattgcccccttgcaaaacaaagaaaaaagggaaaaggctttcccccaaggtggggggattggggggaaaaacggggccctttggggatagggggtttggggggggttttaaaggggttaaaaaacccccgcgggaagaaatcctgtttt

SEQ ID NO: 12970 - DNA, 683 bp, Zea mays
  misc_feature: Ceres CLONE 1372944-F
  misc_feature: Encodes the peptide sequence at SEQ ID NO. 12971
  misc_feature (438)..(438): n is a, c, t, g, unknown, or other
  misc_feature (477)..(477): n is a, c, t, g, unknown, or other
  misc_feature (480)..(480): n is a, c, t, g, unknown, or other
  misc_feature (501)..(501): n is a, c, t, g, unknown, or other
ggagctccccgcggtggcggccgctctagaactagtggatcccccgggctgcaggaattcgcacgagaccattacctagaacatcctaatcgaaaactgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagcctttttgntgatgtccctcagggagggagcgtcctccctggcatcanggntgacaagggcaccattgaggntggtggcactgattaggagaccaccacccaaggccatgacgactttggcaagcggtggcgcaagtactaagagggaggtggccggctttgccaggggggccgttgttctcaagattggcccctaagggccatcccaggttttgcctcgaacctgacggtcaggggtctggctcctttggccc

SEQ ID NO: 12971 - protein, 89 aa, Zea mays
  misc_feature: Ceres CLONE 1372944-F
  misc_feature: SWISSPROT Homolog: EC 4.1.2.13 Fructose-bisphosphate aldolase
MSAYCGKYKDELIKNAAYIGTPGKGILAADESTGTIGKRLSSINVENVEENRRALRELLFCCPGALQYISGVILFEETLYQKTKDGKPF

SEQ ID NO: 12972 - DNA, 670 bp, Zea mays
  misc_feature: Ceres CLONE 1372947-F
  misc_feature: Translation starting site: 198
  misc_feature (438)..(438): n is a, c, t, g, unknown, or other
  misc_feature (518)..(518): n is a, c, t, g, unknown, or other
  misc_feature (537)..(537): n is a, c, t, g, unknown, or other
  misc_feature (658)..(658): n is a, c, t, g, unknown, or other
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcgggnctgggggggccgggccgccatcgcgctggcgtccatgggcggccgggttcgtcacctccggcggcctcggcgtcgctgcngctgtccgtgttctccggnatgtacaagtacctgacgggcaagcacccgccgggcgccgaccagctggaccacgccaaaggcgaggctggcgtccaaggcccgcgacatcaaggatgcagcacagcaccgcatcgaccangcggcaggggtn

SEQ ID NO: 12973 - DNA, 656 bp, Zea mays
  misc_feature: Ceres CLONE 1372953-F
  misc_feature: Translation starting site: 380
  misc_feature (403)..(403): n is a, c, t, g, unknown, or other
  misc_feature (417)..(417): n is a, c, t, g, unknown, or other
  misc_feature (420)..(420): n is a, c, t, g, unknown, or other
  misc_feature (444)..(444): n is a, c, t, g, unknown, or other
  misc_feature (447)..(447): n is a, c, t, g, unknown, or other
  misc_feature (448)..(448): n is a, c, t, g, unknown, or other
  misc_feature (462)..(462): n is a, c, t, g, unknown, or other
  misc_feature (474)..(474): n is a, c, t, g, unknown, or other
  misc_feature (476)..(476): n is a, c, t, g, unknown, or other
  misc_feature (477)..(477): n is a, c, t, g, unknown, or other
  misc_feature (483)..(483): n is a, c, t, g, unknown, or other
  misc_feature (484)..(484): n is a, c, t, g, unknown, or other
  misc_feature (491)..(491): n is a, c, t, g, unknown, or other
  misc_feature (497)..(497): n is a, c, t, g, unknown, or other
  misc_feature (530)..(530): n is a, c, t, g, unknown, or other
  misc_feature (531)..(531): n is a, c, t, g, unknown, or other
  misc_feature (534)..(534): n is a, c, t, g, unknown, or other
tggagctccccgcggtggcggccgctctagaactagtggatcccccgggctgcaggaattcgcacgagaccattacctagaacatcctaatcgaaaaaaaaaaccctatcccagtaaacgccgcggctccttccgctaccaccttcatccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccacgagggcgccagtagatatattcatcttcatctcggcttgcgatatttttgaattttctattccgtattgaaggcgtcgatggccttgtccgccctaatcagnaccctccctcgcgncgncatctggtggcgcgctttactcgncgnntgcatctccctcgncttttgatttcnanntcccanntcccaancctaanctcccccctgtaaacaccccactccagctttgnnagnctactattactggaacctctccggcgaatccgtttgatttaccggccctccgttaccagggggaaaggggaatttgtattcggccccttgggacggaaagccatttttggccccgtttaaaa

SEQ ID NO: 12974 - DNA, 681 bp, Zea mays
  misc_feature: Ceres CLONE 1372958-F
  misc_feature: Translation starting site: 127
  misc_feature: Pfam Name: Sod_Fe_N Pfam Description: Iron/manganese superoxide dismutases, alpha-hairpin domain
  misc_feature: SWISSPROT Homolog: EC 1.15.1.1 Superoxide dismutase
  misc_feature (386)..(386): n is a, c, t, g, unknown, or other
  misc_feature (416)..(416): n is a, c, t, g, unknown, or other
  misc_feature (430)..(430): n is a, c, t, g, unknown, or other
  misc_feature (431)..(431): n is a, c, t, g, unknown, or other
  misc_feature (459)..(459): n is a, c, t, g, unknown, or other
  misc_feature (488)..(488): n is a, c, t, g, unknown, or other
  misc_feature (608)..(608): n is a, c, t, g, unknown, or other
  misc_feature (614)..(614): n is a, c, t, g, unknown, or other
  misc_feature (679)..(679): n is a, c, t, g, unknown, or other
ggagctccccgcggtggcggccgctctagaactagtggatcccccgggctgcaggaattcgcacgagaccattacctagaacatcctaatcgaaaaaggagatacagcgagcgagcgaccaaagccatggctctccgcaccctggcatcgaagaaggtcctaaccttcccgttcggcggcgcgggccggccgttggcggcggcggcgtctgcgaggggggtgacgacggtcacactccccgacctctcctacgacttcggcgcgctggaaccggccattctcgggggagatcattgcgcttgcaccaccagaagcaccacgccacctacgtcgccaactacaacaaggcgcttggagcagctttgacactgccgtctccaagggcngacgcctccgcttgtcgtccagcttgcagncgccatcaagttannacggcggcggtcatgtgaaccattcatncttctggaagaacctcagcccattagcgnaagggtggcggggagccgcctcatgggaaaacttggctgggcatcgatgaggagaatttttttggttcgtttgaagcacttgtaaagaagaggaatgcagaagggctgcttttacagggnctgggnagggggggggggggtttagcttttggataaagaggcaaaaaaaaagctttcggttgaaacaaagnct

SEQ ID NO: 12975 - DNA, 804 bp, Zea mays
  misc_feature: Ceres CLONE 1372960-F
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
tttttnnnccccnnnnnnnnntttctctctttcccccccccccccccctttcccccccggcgctccacgcgggggcggccgctctagaactagtggatcccccgggctgcaggaattcgcacgagaccattacctagaacatcctaatcgaaaacttccccatctccggtataatagataaggaggggatctcctttggcatcctcctctctttcagctaaatccctgccccctctctttttcgtacgttcaggtcctgggaggtcctctcatctgtttcttggaacattcgatcggcgagccgaccaagacccggactcttctttccccccgggaactcttgcagccgggccctctgggatcctcgaattcgaggtgcccggacccgcctcctgccctggggcacatgcgtacgcccgaggcaggacagcgtcccctccgccctggtctatcctcgcagctcctcaggcggccttctggggtgctccgaggcgtgaattgagctgccgtagggcgccttatcccccctcactacggcggtcgccatccaacggactgggtactaccctccttggccctggcgcgggggttaccccgatctcctccgcggacgagaggctttcctaagaacggggaaatcaacgcatttgttcgcatgctgaaaccgggccaacccccccacctctgcggggctcttgcctgaacttatacacctccccatctgactatgtaaccactccgttcacacaggggtggggaaggggatcgtcatgtgagattgtgggggtatccccccgatcttgt

SEQ ID NO: 12976 - DNA, 699 bp, Zea mays
  misc_feature: Ceres CLONE 1372962-F
  misc_feature: Translation starting site: 378
  misc_feature: Pfam Name: DUF292 Pfam Description: Eukaryotic protein of unknown function, DUF292
  misc_feature (422)..(422): n is a, c, t, g, unknown, or other
  misc_feature (554)..(554): n is a, c, t, g, unknown, or other
  misc_feature (584)..(584): n is a, c, t, g, unknown, or other
  misc_feature (634)..(634): n is a, c, t, g, unknown, or other
  misc_feature (635)..(635): n is a, c, t, g, unknown, or other
  misc_feature (647)..(647): n is a, c, t, g, unknown, or other
  misc_feature (677)..(677): n is a, c, t, g, unknown, or other
  misc_feature (686)..(686): n is a, c, t, g, unknown, or other
tgaactccccgcggtggcggccgctctagaactagtggaacccccgggctgcaggaaatcgcacgagaaccatttacctaaaacatcctaatcgaaaaaaatcctcgctttcccttcccccacgtcgcgtccgatcggcgacggtgcgccatgtcgatgctggacaccttcttcagcaagggcggcggcggcggctttccgcggcgccaagtgcaagacgctgctgaagctgtcgatcccgcggataaagctgctgcggaaccggcgggagcttgcagcttgcgccagatgcgccgggacatcgccaagcttcctaaaggccggccaggaggccactgcccggatcagggtggagcacattcatccgggaggagaacatgatggcccgcgcaggagatccttcgagcttctttcttgcgagncttcattcgcggttcgcctgcccattcatcgaggcccaaaaggagtgtcctattgattcttcaaaaagcaatattcaagtgtctgtttttgccgcttccagatgtgcagatctacctgaacttgatgcaagntcaaaatgatgtttgcaactaaatatgggnaaaggaatttgtcgctgcagctttcagagttgatgccttggaattgtggnngtcaatcgtcanaatatttgaattgccttttctattcgtccntccctctgnttgaatgcaaagt

SEQ ID NO: 12977 - DNA, 614 bp, Zea mays
  misc_feature: Ceres CLONE 1372965-F
  misc_feature: Pfam Name: Cyclin Pfam Description: Cyclin
  misc_feature (601)..(601): n is a, c, t, g, unknown, or other
tccccgcggtggcggccgctctagaactagtggatcccccgggctgcaggaattcgcacgagaccattacctagaacatcctaatcgaaaacttcctcgtgtcatcacccttctcgcctcgcttcttacgaagatgattcaaaagaacgaaaaggcattccacacaagacgcaacaaggacgaagagatcactatggtccatggctcacgagcaccggccatgaacatccaacgctacacagagagagtccacaggtgacgctcggtgtagccctgcttgcttcgttgcagcctttgtttatatcattaggtatctagaaagaccaggggctacgagtatgactcttcgtctcacatcacttaacgttgatcgccttctcatcaccagtctcttggtcgcagcataattcttggatcgcaagtgttataataatgcttattatgcgaaaattggaggagctagcactgaagagatgaataggctggagagaacgttcttgttcgatcttgatttcagattaaatattaccgcggagatgtttgagaaacactgtctcatgttgcagagacaaacggtgccttggtggttcaagagaacgangaacagcccttga

SEQ ID NO: 12978 - DNA, 668 bp, Zea mays
  misc_feature: Ceres CLONE 1372966-F
  misc_feature: Encodes the peptide sequence at SEQ ID NO. 12979
ggagctccccgcggtggcggccgctctagaactagtggatcccccgggctgcaggaattcgcacgagaccattacctagaacatcctaatcgaaaaccagccactccactcctaccccacacagaagcggcggcggcggagcaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggttggtgagtatgggctgaggtgcaagcgtgagctttggagggtccagtatgcactgagcaggatccgtaatgctgcaaggcacttgctcacccttgacgagaagaacccccgtcgtatctttgagggtgaggcacttcttcgccgcatgaaccgctatgggctgcttgctgagggtcagaacaagcttgattatgttcttgccctcaccgctgagaacttcctcgcaaggcggcttcaaacacttgtcttcaaggctggcatggccaagtccttcaccatgggctcgtgtcttgatcaagcaggtcaccatcaagggttggcaggaaaattgtcaacgcccatcttcatgggggaaggggggtgggagtctggagaagcacattga

SEQ ID NO: 12979 - protein, 160 aa, Zea mays
  misc_feature: Ceres CLONE 1372966-F
  misc_feature (7)..(108): Pfam Name: Ribosomal_S4 Pfam Description: Ribosomal protein S4/S9 N-terminal domain
MVHVNFYRNYGKTFKKPRRPYEKERLDAELKLVGEYGLRCKRELWRVQYALSRIRNAARHLLTLDEKNPRRIFEGEALLRRMNRYGLLAEGQNKLDYVLALTAENFLARRLQTLVFKAGMAKSFTMGSCLDQAGHHQGLAGKLSTPIFMGEGGWESGEAH

SEQ ID NO: 12980 - DNA, 693 bp, Zea mays
  misc_feature: Ceres CLONE 1372973-F
  misc_feature (566)..(566): n is a, c, t, g, unknown, or other
  misc_feature (581)..(581): n is a, c, t, g, unknown, or other
  misc_feature (582)..(582): n is a, c, t, g, unknown, or other
  misc_feature (610)..(610): n is a, c, t, g, unknown, or other
  misc_feature (621)..(621): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
aaactggagctccccgcggtggcggccgctctagaactagtggatcccccgggctgcaggaattcgcacgagaccattacctagaacatcctaatcgaaaaacgttcaaaacggcaagtcgatcgatctgaaaccacagatcgatcgacgaccagcagaagacgacgtacgtgaaaccgcgagacagtgcgaggacgactggggtgtggcggtgcgatccatcgacaaggccatgggacaacggcgctttgaggacgaacgcgcagctctggcgactgtggcaagcttgctgctcatcctaacgacagcccaagctgctgctgctgctgcttctggacgccatctgtctttgcccacgcagaaggcggcggcggcgcgcatgaacgacaccagtagtagtgacatgcaggtcatcacacccgcgccgctcgctatctcgacggcggctcgaatggggcccggacgggtgctccgggggaggaccgtggccggtgtaccagagcagcgccaaccctctgcccagcggcatcccggcctacaccgtgcgcatcatcaacgtctgcaancgggggggtgacccnntctaccgacgtcccacgtctcctgcggncgacttcgcgnccccacggaagcttggtcgaccccgggccaagttccaggcgcgtcggcttcaacggactgcgtcnnnnaaag

SEQ ID NO: 12981 - DNA, 628 bp, Zea mays
  misc_feature: Ceres CLONE 1372977-F
  misc_feature: Translation starting site: 328
  misc_feature: Pfam Name: Swi3 Pfam Description: Replication Fork Protection Component Swi3
  misc_feature: Pfam Name: RNase_PH Pfam Description: 3' exoribonuclease family, domain 1
tggagctccccgcggtggcggccgctctagaactagtggatcccccgggctgcaggaattcgcacgagaccattacctagaacatcctatcgaaaaagccacgcgcccacgcgccccaagttcacgccggacctgctcctctccgacggcggcatcggcttcgtgctccgctacttccccaaggcgttcaagccccgcgcccgcccaggccacgaggtggacgaccgacctcgccaacctcatcaagctctacgcggactggcactcccgcctgatcccctactactccttcgaacagttcgtgcgcaaagtcgagaaatcgggacgatggtgggcctctctgaaggggagaaacacttcatccgcggcggcattgcacaagaccttcgcactgatggacgtaggcggctgcagttccggtccctctccgtccaaaccggagtcattccacaggcgaatggctcagcgcgtgttaggttgggggccactgaaataatcgctagtgtcaaggctgaattaggaaaccaagcattcttcaccctgacaaaggaaaagttgccatttttgtcgactgtagtccaaccgctgagcctctgtttgagggtagaggctctggagaattgtctgc

SEQ ID NO: 12982 - DNA, 718 bp, Zea mays
  misc_feature: Ceres CLONE 1372981-F
  misc_feature (331)..(331): n is a, c, t, g, unknown, or other
  misc_feature (338)..(338): n is a, c, t, g, unknown, or other
  misc_feature (342)..(342): n is a, c, t, g, unknown, or other
  misc_feature (343)..(343): n is a, c, t, g, unknown, or other
  misc_feature (366)..(366): n is a, c, t, g, unknown, or other
  misc_feature (627)..(627): n is a, c, t, g, unknown, or other
ggagctccccgcggtggcggccgctctagaactagtggatcccccgggctgcaggaattcgcacgagaccattacctagaacatcctaatcgaaaacccctcctccgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacnccggggngcgnncccgcggcggggaagaagctctncggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagctcgcccgcatctgcgacggcatcctcgcgctcctcgactcccactcgtccaatccggccgggggggccgagtccaaggtcttctacctcaggatgnaggggtgactaccacaagtaccttgctgagttcaagtcaggtgcagaggaggaaggatgctgcggagagcaccatgaatgcctacaaagct

SEQ ID NO: 12983 - DNA, 717 bp, Zea mays
  misc_feature: Ceres CLONE 1372982-F
  misc_feature: Encodes the peptide sequence at SEQ ID NO. 12984
  misc_feature (402)..(402): n is a, c, t, g, unknown, or other
  misc_feature (417)..(417): n is a, c, t, g, unknown, or other
  misc_feature (434)..(434): n is a, c, t, g, unknown, or other
ggagctccccgcggtggcggccgctctagaactagtggatcccccgggctgcaggaattcgcacgagaccattacctagaacatcctaatcgaaaaactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctgntgatctcagccgggnttgggggggccgggcgncatcgcgctgcgctcatgggcggccggtttcgtaccctccgggggcctccgggtccctgggcttgccgggttctcccgggaggacaaggaactgaagggaaagcccccgccggggggccgaccactggaccccccaggggggggggtgggggtccagggccccggaatttaggggtggggcccagcccccgtctcccaggggcgggggggttttggagaaaaaacccaccccgggggggggggggggggggccccctttaaacccggggggggggggggaaat

SEQ ID NO: 12984 - protein, 172 aa, Zea mays
  misc_feature: Ceres CLONE 1372982-F
  misc_feature (36)..(117): Pfam Name: Oleosin Pfam Description: Oleosin
  misc_feature (76)..(76): Xaa is any aa, unknown, or other
  misc_feature (81)..(81): Xaa is any aa, unknown, or other
MADHHRGATGGGGGYGDLQRGGGMHGEAQQQQKQGAMMTALKAATAATFGGSMLVLSGLILAGTVIALTVATPVLXISAGXGGAGRHRAALMGGRFRTLRGPPGPWACRVLPGGQGTEGKAPAGGPTTGPPRGGGGGPGPRNLGVGPSPRLPGAGGFWRKNPPRGGGGGGPL

SEQ ID NO: 12985 - DNA, 657 bp, Zea mays
  misc_feature: Ceres CLONE 1372983-F
  misc_feature: Encodes the peptide sequence at SEQ ID NO. 12986
  misc_feature (281)..(281): n is a, c, t, g, unknown, or other
aagctggagctccccgcggtggcggccgctctagaactagtggatcccccgggctgcaggaattcgcacgagaccattacctagaacatcctaatcgaaaaacacgaactcgagacctcgcccgcccaaatacaaaagcctcagatctcagtgaccagcgccgccgcttcgttcgtgtcgaatagagaagagaggaaatggcggcgagcgagggcgtgctcctggggatgggcaaccccctcctcgacatctccgccgttgtcgatgacgccttcctggcnagtatgactcaagctgaacatgccattctcgctgaagagaagcactcgcctatgtatgatgagttgggctagcaacaggcaatgttgaatatattgctggagggccaccccagaactctatcagggttgccccatggatgcttcaaactcctgggtgcaccaagttacatgggatgcattgggaaggaccagtttggtgaggaaatgaagaaaaatgctcaagctgcaggaggtatggctcattactatgagggatgaaactgctcctactggcacatgggctggatgggtttgttggggccgaagggtcattgattggaaatctggcggggggaaactggttacaatctggagcatcttcagagaaccggagaat

SEQ ID NO: 12986 - protein, 51 aa, Zea mays
  misc_feature: Ceres CLONE 1372983-F
  misc_feature: SWISSPROT Homolog: EC 2.7.1.20 Adenosine kinase
MAASEGVLLGMGNPLLDISAVVDDAFLASMTQAEHAILAEEKHSPMYDELG

SEQ ID NO: 12987 - DNA, 706 bp, Zea mays
  misc_feature: Ceres CLONE 1372990-F
  misc_feature: Translation starting site: 338
  misc_feature (324)..(324): n is a, c, t, g, unknown, or other
  misc_feature (397)..(397): n is a, c, t, g, unknown, or other
tggagctccccgcggtggcggccgctctagaactagtggatcccccgggctgcaggaattcgcacgagaccattacctagaacatcctaatcgaaaaattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgacccccggagcaggcgcgcctcgcggaggaggccgncgcgtgcgccgtgatggcgctggagcgggtccccgccgacatccgcgcgcagggcggcgtgccccgcatgtcngaccccggcctcatccgcgacatcaagcgcgcccgccacattccggtcatggccaaagccccgcatcgggcacttcgtggaggcccaagatccctggaggcggggggcgtcaaactacctggaccaaaacgcaaggggttaccccccgccgaagaacgggcaccacatttaaaaagaaaaattttccggggcccccttttctttgggggttgccgcggacccccgggggagggcctctccccaaggggggcccgaggggcccccccccctgtgatcccccacccagggaagaaaggcccgccccccggg

SEQ ID NO: 12988 - DNA, 716 bp, Zea mays
  misc_feature: Ceres CLONE 1372991-F
  misc_feature (676)..(676): n is a, c, t, g, unknown, or other
  misc_feature (677)..(677): n is a, c, t, g, unknown, or other
  misc_feature (695)..(695): n is a, c, t, g, unknown, or other
tggagctcaccgcggtggcggccgctctagaactagtggatcccccgggctgcaggaattcgcacgagaccattacctagaacatcctaatcgaaaaacaaagaagccggggacggagagcagagagcttcagcgcaactgtgctcaatcgtttcttcgtctttagttggtgcttggtctccctccgtcctctgtttcccaaaaagaggtgtctcagctgactcttttgcttgtagcaaaatagcacactcttctctctagaggtgagcaccaccttgctgaagcagctagctagcgacgaccatgggctcctcgaaaccatcccgacgggccattcggggtaatcgggaatggggaaccccccgtgggggtctttccctttccccggggggctacgtttattcgcaatttgggaaaaaaaggggtccgggggaaaaaaaaactcccccggaatcccccaaaagggggaaaactttttaaaattgcattggatgggggggggggtttaaaagggtttgcccctgggggaccccccccccaaggatgggggtggggggaccccctcccaaaggggaccgcgggtggtttatccccccgggacccaaaacggggggcttcttcccccccctaaaacccccggggggggggcgccccaagggggccctccctgggtggnnccgcccccggggtcgctnatttctcggggacgcggcgcc

SEQ ID NO: 12989 - DNA, 633 bp, Zea mays
  misc_feature: Ceres CLONE 1372992-F
  misc_feature (352)..(352): n is a, c, t, g, unknown, or other
aagctggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctccgtcgaggagctgccagctgccgccgctccgcgtcgagacccgaaacgagagacgctgcttccgcggtggaacccnaggtcgtcgtccctaagagcgaagccggtggagcccaaactgaaactgaaaccaggaggccgagccgttgctgagccgacgaggcaaagcccaagaagcagagccggaggccgcgcgccggcagcagaaacgaaggtcaggaaaccaagaacgaagcccccgcgccggcaacaaaaacgaagctgctgctgcccccgccaaggctgctggacccgaaaaaacccgccaaaaccaaaaaagggggcggctgggaaaggcttaaccaggggggaggagggagc

SEQ ID NO: 12990 - DNA, 721 bp, Zea mays
  misc_feature: Ceres CLONE 1372993-F
  misc_feature: Encodes the peptide sequence at SEQ ID NO. 12991
ggagctccccgcggtggcggccgctctagaactagtggatcccccgggctgcaggaattcgcacgagaccattacctagaacatcctaatcgaaaagaaacccgtctcgcaccacaagcgagcgagggacccggggcggaagaagagagagaagacgtctctctcctctcggcgtccccgttccccaacctctcgtctgctgcctgcctgcctgcctgcctgcaaaaaggagtttgtcatggcgtctaagcgcatcctcaaggagctgaaggacctgcagaaagacccccccacatcatgcagtgcaggtcctgctggtgaggacatgtttcattggcaagcaacaattatgggaccacctgacagtccctatgctggtggtgttttcttagtgaacattcatttcccgccagattaccccttcaaacctccaaaggtttctttcaagacaaaggtcttccatcctaatatcaacagcaatggaagtatatgccttgacattctcaaagagcagtggagcccctgctttgacaatttctaaggtcctgctctccatctgctccctgctgaccgaccccaacccggacgaccctcttgtcccggagattgcccacatgtacaagacggaccgggcgaagtacgagtcgacggcccgcagctggacgcagaagtacgcgatgggctgacgaacgctttcctgctcgtctgggcgccatggtcc

SEQ ID NO: 12991 - protein, 100 aa, Zea mays
  misc_feature: Ceres CLONE 1372993-F
  misc_feature (5)..(100): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSAGPAGEDMFHWQATIMGPPDSPYAGGVFLVNIHFPPDYPFKPPKVSFKTKVFHPNINSNGSICLDILKEQWSPCFDNF

SEQ ID NO: 12992 - DNA, 673 bp, Zea mays
  misc_feature: Ceres CLONE 1372999-F
  misc_feature: Encodes the peptide sequence at SEQ ID NO. 12993
  misc_feature (371)..(371): n is a, c, t, g, unknown, or other
  misc_feature (374)..(374): n is a, c, t, g, unknown, or other
  misc_feature (420)..(420): n is a, c, t, g, unknown, or other
  misc_feature (430)..(430): n is a, c, t, g, unknown, or other
  misc_feature (435)..(435): n is a, c, t, g, unknown, or other
  misc_feature (440)..(440): n is a, c, t, g, unknown, or other
  misc_feature (446)..(446): n is a, c, t, g, unknown, or other
  misc_feature (460)..(460): n is a, c, t, g, unknown, or other
tggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctctttcactcgctctgccacaccgacgtctacttctgggaggncanggggcagactccccgtgtccctcggatctttgcccacgaggctggnagtatcatanagagntgtgnagaggntgtgactgacgtanctccgggcgacatgtcctttctgtgtccctggggagtgcaaggagggtgcccactgcaagtcgccaaaggccacctgggtggactgctcaagaatcacccgacccggttgggatgattgccaatggcaaatccccggttttcatccaggggaaacccattcaccccttggtggggacttcccccttccggagaacccgcttggcggggggtgg

SEQ ID NO: 12993 - protein, 123 aa, Zea mays
  misc_feature: Ceres CLONE 1372999-F
  misc_feature: SWISSPROT Homolog: EC 1.1.1.1 Alcohol dehydrogenase
  misc_feature (56)..(56): Xaa is any aa, unknown, or other
  misc_feature (57)..(57): Xaa is any aa, unknown, or other
  misc_feature (76)..(76): Xaa is any aa, unknown, or other
  misc_feature (77)..(77): Xaa is any aa, unknown, or other
  misc_feature (79)..(79): Xaa is any aa, unknown, or other
  misc_feature (81)..(81): Xaa is any aa, unknown, or other
  misc_feature (86)..(86): Xaa is any aa, unknown, or other
MATAGKVIKCKAAVAWEAGKPLSIEEVEVAPPQAMEVRVKILFHSLCHTDVYFWEXXGQTPRVPRIFAHEAGSIIXXCXEXVTDVXPGDMSFLCPWGVQGGCPLQVAKGHLGGLLKNHPTRLG

SEQ ID NO: 12994 - DNA, 648 bp, Zea mays
  misc_feature: Ceres CLONE 1373000-F
  misc_feature: Encodes the peptide sequence at SEQ ID NO. 12995
  misc_feature (414)..(414): n is a, c, t, g, unknown, or other
  misc_feature (421)..(421): n is a, c, t, g, unknown, or other
  misc_feature (427)..(427): n is a, c, t, g, unknown, or other
  misc_feature (440)..(440): n is a, c, t, g, unknown, or other
  misc_feature (441)..(441): n is a, c, t, g, unknown, or other
aaagctggagctccccgcggtggcggccgctctagaactagtggatcccccgggctgcaggaattcgcacgagaccattacctagaacatcctaatcgaaaaacggccaatgcaattgcagttgcagttgcaattgcacggcacccatttccagagccgtcctcaattagctagtcaaatctcgctatcctttccccaccatccagatcttccctttcatggacgccgccgtctccaccctcaccgctctcgccatcttcgcgagcaccgtcgagcacgccgcctacaggagcgtgcaggggtatagggtggtcgggaggaaaggcggcgggtgggtccgttgggagaggtgggtggagcggcagttcgtcctctccctctccttccacggtgcgtcgaggttgccctgcccgncgccgcngcgcgnatactggcagcgnngtggcgcagccggccggtggtccgcgagggacagacgtcgacacttgggcgtgcattgtgggattcgaatccggcggcggcggtggttcggcctccccggcgggggcggggttttcccccttcgggaacccaagggtggaggatctggctaatctggacaaggaccgggtggaggggggttccgtgtcccaaaagaaaaaaaaggcc

SEQ ID NO: 12995 - protein, 124 aa, Zea mays
  misc_feature: Ceres CLONE 1373000-F
  misc_feature (66)..(66): Xaa is any aa, unknown, or other
  misc_feature (68)..(68): Xaa is any aa, unknown, or other
  misc_feature (70)..(70): Xaa is any aa, unknown, or other
  misc_feature (75)..(75): Xaa is any aa, unknown, or other
MDAAVSTLTALAIFASTVEHAAYRSVQGYRVVGRKGGGWVRWERWVERQFVLSLSFHGASRLPCPXPXRXYWQRXGAAGRWSARDRRRHLGVHCGIRIRRRRWFGLPGGGGVFPLREPKGGGSG

SEQ ID NO: 12996 - DNA, 671 bp, Zea mays
  misc_feature: Ceres CLONE 1373002-F
  misc_feature: Encodes the peptide sequence at SEQ ID NO. 12997
  misc_feature (448)..(448): n is a, c, t, g, unknown, or other
  misc_feature (519)..(519): n is a, c, t, g, unknown, or other
  misc_feature (659)..(659): n is a, c, t, g, unknown, or other
agagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcgnacggagaagtgcaggtgcttgcctgccgccagcatctccaccgctttgccgagcgtcaggatctccgtcgncagcgcccgcgccgtcggcatcctcagctcgtcgggctccaccagcaggcgcgacagcgccggcttgtagctgtccagcgccgcgtccacctcggcgtcggcgctcctagccgggccgccctgagcccgcgccgcgccgnaccgtcgaagtt

SEQ ID NO: 12997 - protein, 122 aa, Zea mays
  misc_feature: Ceres CLONE 1373002-F
  misc_feature (49)..(49): Xaa is any aa, unknown, or other
  misc_feature (119)..(119): Xaa is any aa, unknown, or other
MLLTSCRQGRGMASLSCARADGVVRSGALPAKLLLCASCCFPTAAPVAXGEVQVLACRQHLHRFAERQDLRRQRPRRRHPQLVGLHQQARQRRLVAVQRRVHLGVGAPSRAALSPRRAXPSK

SEQ ID NO: 12998 - DNA, 679 bp, Zea mays
  misc_feature: Ceres CLONE 1373005-F
  misc_feature: Translation starting site: 209
  misc_feature (360)..(360): n is a, c, t, g, unknown, or other
  misc_feature (371)..(371): n is a, c, t, g, unknown, or other
  misc_feature (450)..(450): n is a, c, t, g, unknown, or other
  misc_feature (488)..(488): n is a, c, t, g, unknown, or other
  misc_feature (493)..(493): n is a, c, t, g, unknown, or other
  misc_feature (494)..(494): n is a, c, t, g, unknown, or other
  misc_feature (510)..(510): n is a, c, t, g, unknown, or other
  misc_feature (511)..(511): n is a, c, t, g, unknown, or other
  misc_feature (606)..(606): n is a, c, t, g, unknown, or other
  misc_feature (646)..(646): n is a, c, t, g, unknown, or other
aagctggagctccccgcggtggcggccgctctagaactagtggatcccccgggctgcaggaattcgcacgagaccattacctagaacatcctaatcgaaaatacctagaacatcctaatcgaaaactcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgagcgcagcagcagcagaagcagggcgcatgatgacgccgctcaaggccgcgacggccgcgacccttcggcggntcgatgctggntgctgtccgggctgatcctgggcggcaccgtgatcgcgctcacggtggccacccccgtgctggtgatctcagccggggntgggtggccgggcgccatcgcgctgggctcatgggcgnccggnntcgtcacctccggggnnctcggggtcgctgcgctggccgggttctccctggatgtacaagtacctgacgggcaagcacccgccgggcgccgaccagctggacacgcaaggcnaaggctgggcgttccaggcccgcgacaatcaggatgcagnacagcacgcatcgaccaagcgcaggggtcttga

SEQ ID NO: 12999 - DNA, 709 bp, Zea mays
  misc_feature: Ceres CLONE 1373006-F
  misc_feature: Encodes the peptide sequence at SEQ ID NO. 13000
  misc_feature (501)..(501): n is a, c, t, g, unknown, or other
  misc_feature (517)..(517): n is a, c, t, g, unknown, or other
  misc_feature (523)..(523): n is a, c, t, g, unknown, or other
  misc_feature (546)..(546): n is a, c, t, g, unknown, or other
tccccgcggtggcgggcgctctagaactagtgggtcccccgggctgcgggaattcgcacgagaccattacctagaacatcctaatcgaaaaaactctagtctctagccacaactcgaagtacgagtacctccggagtccggatggctggagcggtggacggcgacgaagccggcggcgaggagaggcgaccggcggagaaggagctcttccgcggcggcgagtccggcgacgccggcgcggtcgcctccctcggccccggcgacctctccctgggcaacgaggacgggcgctccctcctccacggcgccgccgctggcggccatccccaggtggtggtcgcgcttgcccagtgcggtggtgacgccgcggctagcgtggtgaatgggcaggacggagaggggtgggcggcgatccactccggcgcgagctccgggaactctcaaatcggcgacatcctgcttgagcgaggtggctgatgttaacctggttactggatggtnggtcgactggcccttncatatngtggcgagtagagggagggttancatagcctgaaaactaatagcccatgggtggctatggcacaagaaaggacaagtttgggctggccaccttttgcatagagcctgcagcactgggaaaccggggaggttggtggaatcccccatttgggggaaggggcgttgaatttaagggcgtgttaaaaga

SEQ ID NO: 13000 - protein, 111 aa, Zea mays
  misc_feature: Ceres CLONE 1373006-F
MAGAVDGDEAGGEERRPAEKELFRGGESGDAGAVASLGPGDLSLGNEDGRSLLHGAAAGGHPQVVVALAQCGGDAAASVVNGQDGEGWAAIHSGASSGNSQIGDILLERGG

SEQ ID NO: 13001 - DNA, 848 bp, Zea mays
  misc_feature: Ceres CLONE 1373008-F
  misc_feature: Encodes the peptide sequence at SEQ ID NO. 13002
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (791)..(791): n is a, c, t, g, unknown, or other
  misc_feature (848)..(848): n is a, c, t, g, unknown, or other
nnnnnnnnnnnnnnnnnnnnnnnnnccccccttggcggcgcaaaaaccaagctggagctccccgcggtggcggccgctctagaactagtggatcccccgggctgcaggaattcgcacgagaccattacctagaacatcctaatcgaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttccggtatgtcgaaaacccaattccttcaaccctacaggatccaacaggcaatcgcagctggcatcttaccttttatcaccccttgttcgtccgacaatcatcagcccctattacaacagctaccctttgggtgcattttattgggcacaaaaacatcagggggacaaccaacctaccacaaacttgggggtaagcaaaacctttggctggcctaactcctcgagcaaaccgggaaggtttccttcccatttccaacccaacctaagggttccatttggaaacttctggcttttcttaattgttggaaacaaaccaaccaacttacgcatttctcaggcccaggctaaccctggcttgccctaaccccccccggcaaatttttccgttcccatttccaagcccaaagctaaggagaggaatttctaaacctccctccctgggctttaattntaaacgggcgaggcaagccagacctaaccttcacccattttccgagccacgagctan

SEQ ID NO: 13002 - protein, 116 aa, Zea mays
  misc_feature: Ceres CLONE 1373008-F
MAAKIFCLLMLLGLSASAATATIFPQCSQAPIASLLPPYLSPAVSSGMSKTQFLQPYRIQQAIAAGILPFITPCSSDNHQPLLQQLPFGCILLGTKTSGGQPTYHKLGGKQNLWLA

SEQ ID NO: 13003 - DNA, 724 bp, Zea mays
  misc_feature: Ceres CLONE 1373010-F
  misc_feature: Encodes the peptide sequence at SEQ ID NO. 13004
  misc_feature (144)..(144): n is a, c, t, g, unknown, or other
tccccgcggtggcggccgctctagaactagtggatcccccgggctgcaggaattcgcacgagaccattacctagaacatcctaatcgaaaaaggctagtccccccacacctggatccatcgggtcggaggccatggcgacggcnaggctccgatcctcggcctccctccgcggggctctcctccgccacttctccgttggtcccgcctcgactccgcgcgccgtctcccgggtcccagatttccaggttcctcagtctattatgtggaggcattttgcaacgtccaggcctaattctcttgcaagacgcgacaactttggtctgatggcctgtttgcacgctcagatacgatgcgcttcgcagggtgctggtgtgaaagaaaccgaatccagtagcagcaagataagcatcggggcccaaaccaaaacagatcaaggaggatgacgaggatgctaacctggtataccaagggccaatatcatcgaccataaagaaagtgaagcttctctccctgtccacctgctgcctctccgtgtctctggggccagtgataacattcatgacttcgcctgacatgaatgtgatcctcaagggagcggttgcatccaccgtcattttcctcagcggcactaccactgcagcgttacattgggtcgtggagccgtacattcaccagctcgggtggcgtcctggttcggatagctttgaggccgaggtgatgaca

SEQ ID NO: 13004 - protein, 103 aa, Zea mays
  misc_feature: Ceres CLONE 1373010-F
MATARLRSSASLRGALLRHFSVGPASTPRAVSRVPDFQVPQSIMWRHFATSRPNSLARRDNFGLMACLHAQIRCASQGAGVKETESSSSKISIGAQTKTDQGG

SEQ ID NO: 13005 - DNA, 722 bp, Zea mays
  misc_feature: Ceres CLONE 1373013-F
  misc_feature: Encodes the peptide sequence at SEQ ID NO. 13006
  misc_feature (532)..(532): n is a, c, t, g, unknown, or other
  misc_feature (615)..(615): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
gctctagaactagtggatcccccgggctgcaggaattcgcacgagaccattacctagaacatcctaatcgaaaaatcgatccagtgcaaacaagctcggtcgcaggcgcaacccacccacgtctaccacacgaagcatcgtagccagccacccatccagccagctaaacccacacatggccgggatcgtggtggtgttcgacttcgacaagacgatcatcgacgtgcacagcgacaactgggtggtggacagactcggcctcaccgacctgttcgagcgcctcctccccaccacgccctgtaacacgctcatggacactatgatggaggagctgcacgcgcgggtcaccacgctggccgaggtgaccgaggtgctcatgacggcgcccatcgacccgcgcgtgcacgccgccgtcaggaccgcgacgcgctcggctgcgactgcgcgtgatcacgacgccaagccttcttatctgaccgtcctggacagcacgggctgctcgactgttctccagataacaccacccagccgngtgacgcacgcatcgatgcctgacacggggtgcgagtgggcacctgctcaaatggagcctgtgacttctcgagcagcactccnannnnntcggtccgaaaatcggnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13006 - protein, 154 aa, Zea mays
  misc_feature: Ceres CLONE 1373013-F
  misc_feature (4)..(163): Pfam Name: Put_Phosphatase Pfam Description: Putative Phosphatase
  misc_feature (147)..(147): Xaa is any aa, unknown, or other
  misc_feature (148)..(148): Xaa is any aa, unknown, or other
  misc_feature (149)..(149): Xaa is any aa, unknown, or other
MAGIVVVFDFDKTIIDVHSDNWVVDRLGLTDLFERLLPTTPCNTLMDTMMEELHARVTTLAEVTEVLMTAPIDPRVHAAVRTATRSAATARDHDAKPSYLTVLDSTGCSTVLQITPPSRVTHASMPDTGCEWAPAQMEPVTSRAALXXXRSENR

SEQ ID NO: 13007 - DNA, 727 bp, Zea mays
  misc_feature: Ceres CLONE 1373014-F
  misc_feature: Encodes the peptide sequence at SEQ ID NO. 13008
ggagctccccgcggtggcggccgctctagaactagtggatcccccgggctgcaggaattcgcacgagaccattacctagaacatcctaatcgaaaaaaaaatataacctcagttcaaatcctaacctcgagcttctctatgacttccgccactaccgacccaaaccctgaggtggacaccccgtatgacgccgcctccgtcgtaaccgggctcctcaacgatctccgcctccgtgggcgagtcggtccaggaaaaaaacgacctctatggtcggctcaggtcgatctagagccacatggagttcgtatagatccataagtcagtacgttaaagacaaacacaagaagctcaagctgcgaactcctccgtacgtcggaggaggtctggaggatccagtccgcaccgctcgtcatcggccagtttatggagatggtcaaccaagacaacggcattgtgccttctactactggtagtaactactatgtacgaatactcagtaccataaaccgcgagctgctcaagcatcagcatctgtcgcgtctcatcaacactcacatcctttacctgaccagctagcggccgaggaagactccaagatctccttgctgggatcccaggagcagcccgaggtcagctacgacgctatggaaggatgcaacatccaaagtcataatacgtgaggggtgtaaaatacccttgactcatcatgagttggacaggagcatgg

SEQ ID NO: 13008 - protein, 50 aa, Zea mays
  misc_feature: Ceres CLONE 1373014-F
MEMVNQDNGIVPSTTGSNYYVRILSTINRELLKHQHLSRLINTHILYLTS

SEQ ID NO: 13009 - DNA, 685 bp, Zea mays
  misc_feature: Ceres CLONE 1373018-F
  misc_feature: Translation starting site: 179
  misc_feature: SWISSPROT Homolog: EC 2.7.6.1 Ribose-phosphate diphosphokinase
  misc_feature (349)..(349): n is a, c, t, g, unknown, or other
  misc_feature (453)..(453): n is a, c, t, g, unknown, or other
  misc_feature (454)..(454): n is a, c, t, g, unknown, or other
  misc_feature (500)..(500): n is a, c, t, g, unknown, or other
aagctggagctccccgcggtggcggccgctctagaactagtggatcccccgggctgcaggaattcgcacgagaccattacctagaacatcctaatcaaaaaaagcagagtctgcccctccccgcgccgttctttttggttccccactccccagtccccgccgccgccgaaacccgcagatggaggtcgtcgtcgccgcgaagcagaaggcgaagaaacacatacacctcttctactgctcagaatgcgaggagctcgccctcaagatcgccgccagctccgacgccatcgagctccatcccatcactggcggagcttcgacgacgggttcccgaacctgttcatcaacnagggcgcacgacattcggtgggcagcacgtggcggtccctgggctccttcagctcggcgtcggtcatattcgagcagatctccgtcatcttcgcgctgcccagnntatcattggctcattcactctcgggctggctttccttcccacgggnctcattcgaggcgcggtgaggaggagggcgatgtccccaccgcggtcaccctcgcgcggattctctcgatgatccccaagtcggggggggggcctaacaggggcggtcttttacgaaatcacggcgttcaaggagaggttctactttcggggacgacgtcctggcattgttcgagacagggatcc

SEQ ID NO: 13010 - DNA, 748 bp, Zea mays
  misc_feature: Ceres CLONE 1373019-F
  misc_feature: Encodes the peptide sequence at SEQ ID NO. 13011
  misc_feature (13)..(13): n is a, c, t, g, unknown, or other
  misc_feature (14)..(14): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
tttttcccccccnncccccccccctctttcccctggggggagannnnnnttcaaagctggagctccaccgcggtggcggccgctctagaatagtggatcccccgggctgcaggaattcgcacgagaccattacctagaacatcctaatcgaaaacttgccgccagccagcccattaaccctcgttcctgtcgcgcagccacgacctccacttccgcatcttccccggcggcggcgcggtcagttgaaccatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggaccccaacaccatctttgtcttcaagttccgcacccacttcggaggaggaaagcccactggtttcgggctcatctacgacaacctcaagggtgccaagaagtccgagccgaaataccgcctcatcaggaatggtcttgctactaaggttcgagaacccccgcaaggcaaatgaaggaccggaagaacagggcccaaaaagatccggtgggggcaaaaaagaccaaagcttggggacccccaagaaaaaaataaaacggttcctttaacatttggaatcactcggcccggggggttctggggggggtccaaacttgccaagggtcactaaa

SEQ ID NO: 13011 - protein, 113 aa, Zea mays
  misc_feature: Ceres CLONE 1373019-F
  misc_feature (28)..(108): Pfam Name: Ribosomal_S24e Pfam Description: Ribosomal protein S24e
MADSKATSAVTLRTRKFMTNRLLARKQFVLEVIHPGRANVSKAELKERLAKAYEVKDPNTIFVFKFRTHFGGGKPTGFGLIYDNLKGAKKSEPKYRLIRNGLATKVREPPQGK

SEQ ID NO: 13012 - DNA, 671 bp, Zea mays
  misc_feature: Ceres CLONE 1373027-F
  misc_feature: Encodes the peptide sequence at SEQ ID NO. 13013
  misc_feature (516)..(516): n is a, c, t, g, unknown, or other
  misc_feature (528)..(528): n is a, c, t, g, unknown, or other
  misc_feature (529)..(529): n is a, c, t, g, unknown, or other
  misc_feature (547)..(547): n is a, c, t, g, unknown, or other
  misc_feature (548)..(548): n is a, c, t, g, unknown, or other
  misc_feature (555)..(555): n is a, c, t, g, unknown, or other
  misc_feature (556)..(556): n is a, c, t, g, unknown, or other
tggagctccccgcggtggcggccgctctagaactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggcccggcagagccgcagcggcggcgtcgccgtgcgggcgtcgctgttctcgcccaagcccgcggcggccaaggacgcgcggccgaccaaggtgcaggagctgtacgtgtacgagatcaacgagcgggaccgcgagagccccgcgtacctgcgcctcagcgccaagcatacgnagaacgcgctgnncgatcttgtccccttcanncaacagnngaaccacgggcaggctgggacaagagggttgtgggggtaaccccgggggattttgggggtttaaccagaaagccccaaaccagagggagacccgttaaaggcctttttaaggttt

SEQ ID NO: 13013 - protein, 118 aa, Zea mays
  misc_feature: Ceres CLONE 1373027-F
  misc_feature: SWISSPROT Homolog: EC 5.3.99.6 Allene-oxide cyclase
  misc_feature (93)..(93): Xaa is any aa, unknown, or other
  misc_feature (97)..(97): Xaa is any aa, unknown, or other
  misc_feature (103)..(103): Xaa is any aa, unknown, or other
  misc_feature (106)..(106): Xaa is any aa, unknown, or other
MAAALRCPASVRVSGPAAAGLAKVRQASRVVAVSGARQSRSGGVAVRASLFSPKPAAAKDARPTKVQELYVYEINERDRESPAYLRLSAKHTXNALXDLVPFXQQXNHGQAGTRGLWG

SEQ ID NO: 13014 - DNA, 641 bp, Zea mays
  misc_feature: Ceres CLONE 1373029-F
  misc_feature: Encodes the peptide sequence at SEQ ID NO. 13015
  misc_feature (290)..(290): n is a, c, t, g, unknown, or other
  misc_feature (463)..(463): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
tggagctccccgcggtggcggccgctctagaactagtggatcccccgggctgcaggaattcgcacgagaccattacctagaacatcctaatcgaaaaaagcaccacagccggagaaatcctctcgtgtcgtctcttcagctatcaaacggcaagacgatgctgccgctgaggtccgccgccgccgcgccgtgctcggttgcaggacttctgctccaccgattctcatcctactcgtcctcttctgtctattctgtccgccaccacgcctcgtctgctctctcctcccagncctccacccgccccaccaccacctggtcctcttcccccaattccagcagccgcaggatcagggggtttgcggcctgggcttcggcgccggggccggcggggtctgcggattccctcgctacaaagggctagagggctagatcagggagcagctggaggcggacacagcacggnttggggaaactcctggagatggccgcctgtttgctaaaccggattccaggctttgagggaaatctgctgtacacggggaaaatggctacaagggttattggagggggtttcaaagcggggggggggttgnnnacccaaaaatacaaaagcgcggggaggtgtgccccaaaaaaaataa

SEQ ID NO: 13015 - protein, 87 aa, Zea mays
  misc_feature: Ceres CLONE 1373029-F
  misc_feature (45)..(45): Xaa is any aa, unknown, or other
MLPLRSAAAAPCSVAGLLLHRFSSYSSSSVYSVRHHASSALSSQXSTRPTTTWSSSPNSSSRRIRGFAAWASAPGPAGSADSLATKG

SEQ ID NO: 13016 - DNA, 630 bp, Zea mays
  misc_feature: Ceres CLONE 1373036-F
  misc_feature: Encodes the peptide sequence at SEQ ID NO. 13017
  misc_feature (333)..(333): n is a, c, t, g, unknown, or other
  misc_feature (396)..(396): n is a, c, t, g, unknown, or other
  misc_feature (397)..(397): n is a, c, t, g, unknown, or other
  misc_feature (414)..(414): n is a, c, t, g, unknown, or other
aaagctggagctccccgcggtggcggccgctctagaactagtggatcccccgggctgcaggaattcgcacgagaccattacctagaacatcctaatcgaaaaaatcgcaagctcaagcaaaaacacaaagcgcttaaaccacactcaaaccaaccgccagccaacaaacaggcctcctagtcccgaccagaactcgctcgtagccccgagaacccgacagcgcgagatggctcccgagctgatgacagccaagatgaccgccaaggccgccgcggcggcggcggcggcggcggcggcgaagcctgccacgagggcgtacgtgacgttcctggncgggcgacgcgactactggaaggccgtggtggggctggcaagggcctccgcaagtccgctcgnnctaccccctgtggtggncgtgctgcccgacgtgcccgagtcccacgccgcatcctcgtctcgcagggctgcgtcgtgcgcgagatcgagcccgtgtacccgcctgagaaccagacgccagtccgcatggggtactacgtcatcacctactccaggctccgcatctgggagttcctggagtacgagaggatggggtacctggacccggacattcagggggtcaaaaactcgacg

SEQ ID NO: 13017 - protein, 36 aa, Zea mays
  misc_feature: Ceres CLONE 1373036-F
MGYYVITYSRLRIWEFLEYERMGYLDPDIQGVKNST

SEQ ID NO: 13018 - DNA, 690 bp, Zea mays
  misc_feature: Ceres CLONE 1373037-F
  misc_feature: Encodes the peptide sequence at SEQ ID NO. 13019
  misc_feature (325)..(325): n is a, c, t, g, unknown, or other
  misc_feature (379)..(379): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
gctctagaactagtggatcccccgggctgcaggaattcgcacgagaccattacctagaacatcctaatcgaaaaaaaagagactttagggttttagcggcttctatttctgagcgagggtttatccgccaggggcggcgcgacgcggcggcagttgagctgggatttccttcccatcccgttcccttccaggcgaggcgatggacgaggcggcggtcgacgacctcatccggcggctcctcgaggcccgcggcgggcgcaccccgcgcaacgcgcaggtgaccgacgctgagatccggcgcctctgcgccgccgccaaggatgtngtcctctcccagcccaacctcctggagctcgaggcccccatcaagatatgcggngatgtccatggtcagtattcagaccttcttcgattatttgaggatgggggctatccaccagatgcaattatctggtcctcggtgactatgttgataggggaaaacgagcatagaacatatgccttcctgataaaagacaaatttcagacgagcaacatagttgggaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13019 - protein, 117 aa, Zea mays
  misc_feature: Ceres CLONE 1373037-F
  misc_feature: SWISSPROT Homolog: EC 3.1.3.16 Phosphoprotein phosphatase
MDEAAVDDLIRRLLEARGGRTPRNAQVTDAEIRRLCAAAKDVVLSQPNLLELEAPIKICGDVHGQYSDLLRLFEDGGYPPDAIIWSSVTMLIGENEHRTYAFLIKDKFQTSNIVGKG

SEQ ID NO: 13020 - DNA, 651 bp, Zea mays
  misc_feature: Ceres CLONE 1373038-F
  misc_feature: Encodes the peptide sequence at SEQ ID NO. 13021
aaagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgggcaatcttcgttggtctagaacccactgtgaccgaggaggggcgcactgggacggaccgccgggtcttcccccctggcggctctccaggggcaaggaggatgccgttaacaatttcgcccggggccactaccaactggccaaaaaatcctgccccgcgctcacaccgacccgcacagctcgcggaagcggcccgcccccg

SEQ ID NO: 13021 - protein, 130 aa, Zea mays
  misc_feature: Ceres CLONE 1373038-F
MRECISVHIGQAGIQVGNACWELYCLEHGIQPDGQVPGDKTAGHHDDAFSTFFSQTGAGKHVPRAIFVGLEPTVTEEGRTGTDRRVFPPGGSPGARRMPLTISPGATTNWPKNPAPRSHRPAQLAEAARP

SEQ ID NO: 13022 - DNA, 716 bp, Zea mays
  misc_feature: Ceres CLONE 1373041-F
  misc_feature: Translation starting site: 302
  misc_feature (539)..(539): n is a, c, t, g, unknown, or other
aaagctggagctccccgcggtggcggccgctctagaactagtggatcccccgggctgcaggaattcgcacgagaccattacctagaacatcctaatcgaaaatcctcccccctcaacaaccgcgagatcttcagctaccgctctctccggtcgcgtttgcatccgcattcctcagatccagattcgagccccagccccgcttcgagatccagctagctctctatcaagcatccggcggagcgagcagcgggaggctcggcaagagagaagatgaagcggaagacgcggaacagatcatcgtatggacgctggccctggctgcagtggcgattctggtggggtggcacgattggcgcttggggctcacggcgggggacgggggaaggcccagaataaagaagtcccaaggagaagatctgtgaccaagggtggggagtgctcggggagcaaagtactgctgcaacgaaccccatcacccgacttctttaaggttgaaccagttcgaagaacctcttccgccaaggggaaacacccccgtnggggcacggccgtcgggtttctgggaataccagggccttctttcccggccgcggcccttcttcgaagccccaggggtttctggccccaccgggggggaaagcaaaatggcaaatggtggaagcttctggggcctttccctcggggcacggcggggggccaagaatttccatgggggg

SEQ ID NO: 13023 - DNA, 658 bp, Zea mays
  misc_feature: Ceres CLONE 1373042-F
  misc_feature: Encodes the peptide sequence at SEQ ID NO. 13024
  misc_feature (259)..(259): n is a, c, t, g, unknown, or other
aaagctggagctccccgcggtggcggccgctctagaactagtggatcccccgggctgcaggaattcgcacgagaccattacctagaacatcctaatcgaaaaaagtttaggaaaggaagcaccggagcaggcgatacggcgccgacgacaatggcagcaacaagggcttccccagtgcttctcttgctgctcaccgtccagctcagcttgctcttccgcctccccgactccccctccacctcgccctcgccctcgccgnggaaccagaagcacagaacgccagtagcaccgcagcccgcgctgctgtgcagtcacgtgcacttccacagcttctacgacttctggatcgccgggttcgccggcgaaccccgccagttcaacggcgaggtcccgggcctcgggccatcgccgtgtcccccccggaaaaaagcctcccggagggccgccttccctcggaaacccagggaacccggggcaccccgagggggaaccggggttcctccggcctgggccgggaaaaaccccccccccccgaaacggcctgggaaggggccgggttccccccccgaggaggccaaaaaaacccttcggggagagaaaccccccccggaaaaaaccccccgggggggcccccactttttccggggcgcgaaaaaaa

SEQ ID NO: 13024 - protein, 169 aa, Zea mays
  misc_feature: Ceres CLONE 1373042-F
  misc_feature (37)..(37): Xaa is any aa, unknown, or other
MAATRASPVLLLLLTVQLSLLFRLPDSPSTSPSPSPXNQKHRTPVAPQPALLCSHVHFHSFYDFWIAGFAGEPRQFNGEVPGLGPSPCPPRKKASRRAAFPRKPREPGAPRGGTGVPPAWAGKNPPPPKRPGKGPGSPPEEAKKTLRGEKPPPEKTPRGGPHFFRGAKK

SEQ ID NO: 13025 - DNA, 886 bp, Zea mays
  misc_feature: Ceres CLONE 1373044-F
  misc_feature (1)..(1): n is a, c, t, g, unknown, or other
  misc_feature (26)..(26): n is a, c, t, g, unknown, or other
  misc_feature (51)..(51): n is a, c, t, g, unknown, or other
  misc_feature (614)..(614): n is a, c, t, g, unknown, or other
  misc_feature (659)..(659): n is a, c, t, g, unknown, or other
ngtgtccccccccccccccccacctnctaatatatttatagggcccccccnccaagctggggctccccgcggggggggccgctctagaagtagtggatcccccgggctgcaggaattcgcacgagaccattacctagaacatcctaatcgaaaaacatagtcgaaagctacgagcactcgccgccactcaccagcaaattcccaagccgccccttcccccatctctttcgcgccccattagatcgattcctgatggcggccaaggccgagaagaacccccgcggagaagaagcccgggggaggacaaagcccaaaacaagcccaagggcgggataaatcccgtgccctacaaaggagggcgggcgagaagaagggggaaaggaaaaagggggaagaagaggcggcggaggacggaacggagatccgccgtcctttcaggggggctcaaggggggggggcgcccccgggaaatttggggaatgctcgggcccgggggggcaggggcccatccaggggaagcgcgctttcccgtccaccggcacctcccttttcgaaaaaagggttccgccccggccgcaaaggggaagtgccgagggctgccgcccccgccctcnacacccaagaaagaagcgccccacccaattgcgccccccccggangggagaaaagcacgaggaccggctgggggggcgcccgcgccgagcccctcccccgggggaggaggctccgccccggggccagcggcaggtctccccccagagggcgaccccgagcggcgggggcgcaccgcaggggtgtgacctcccccccccgtggggcggccgcccgcggccccgggagcagaggtggaggggcgaagtgctccccaaacaggtggggcgggcgg

SEQ ID NO: 13026 - DNA, 695 bp, Zea mays
  misc_feature: Ceres CLONE 1373045-F
  misc_feature: Encodes the peptide sequence at SEQ ID NO. 13027
  misc_feature (579)..(579): n is a, c, t, g, unknown, or other
  misc_feature (587)..(587): n is a, c, t, g, unknown, or other
gctctagaactagtggatcccccgggctgcaggaattcgcacgagaccattacctagaacatcctaatcgaaaaagatctagggttctctcgtgctctgttctcatcttctgctcgctggtgtcccctccctctcacccatggcttcggcggcggcggcaactcaggtggggacttacttcctgcggaactactacaacctgctgcaacaaacccccgatgtcgtccaccagttctacagcgaagccagcaccatggtccgcgtcgacgacctcaccggcacgaccgcggctgccaacaacatgatggacatacactcactcatcatgtctttgaacttcacccaaattgagatcaagactgccaattttgtgaactcatggggcgatggggtgctagttatggtctctggtctagtgcagaccaaggagtacagccaccaaaggaaatttatccagatggtcttccttgccccctcagagaaggggtactttgtccctcacgattactttcactgcgttgacccagaacatgtgcaggctgcggcagtgatggctcaggaagactacgagaggatttnggcacccnacacagttggtgaggacgcgtcctggagtacgtcccggggaggagctcaacaataacgcctggaggacctgggggggccgaaaatattcttattctgagcacaccggg

SEQ ID NO: 13027 - protein, 167 aa, Zea mays
  misc_feature: Ceres CLONE 1373045-F
  misc_feature (10)..(126): Pfam Name: NTF2 Pfam Description: Nuclear transport factor 2 (NTF2) domain
  misc_feature (147)..(147): Xaa is any aa, unknown, or other
  misc_feature (150)..(150): Xaa is any aa, unknown, or other
MASAAAATQVGTYFLRNYYNLLQQTPDVVHQFYSEASTMVRVDDLTGTTAAANNMMDIHSLIMSLNFTQIEIKTANFVNSWGDGVLVMVSGLVQTKEYSHQRKFIQMVFLAPSEKGYFVPHDYFHCVDPEHVQAAAVMAQEDYERIXAPXTVGEDASWSTSRGGAQQ

SEQ ID NO: 13028 - DNA, 672 bp, Zea mays
  misc_feature: Ceres CLONE 1373048-F
  misc_feature: Encodes the peptide sequence at SEQ ID NO. 13029
  misc_feature (375)..(375): n is a, c, t, g, unknown, or other
  misc_feature (415)..(415): n is a, c, t, g, unknown, or other
  misc_feature (590)..(590): n is a, c, t, g, unknown, or other
  misc_feature (613)..(613): n is a, c, t, g, unknown, or other
  misc_feature (672)..(672): n is a, c, t, g, unknown, or other
aagctggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacngcgggtgtgggcagccgagcgtcatgttccagccgctccnggcacagtgcttgcagcagcagatgaggatgatggacgtgcagtccgtcgcgcagcagctgcagatgatgatgcagcttggagcgtgccgctgcccgcagcagcaggctgtacgagccagctctgatgcagcagcagcagcagctgctggcagcccagggtctcaaccccatggncatgattgatgcgaaaacatgcnggccatgggtggactctaacaatacaggtggccagctaccggaccaaccctggtgggtn

SEQ ID NO: 13029 - protein, 144 aa, Zea mays
  misc_feature: Ceres CLONE 1373048-F
  misc_feature (71)..(71): Xaa is any aa, unknown, or other
  misc_feature (84)..(84): Xaa is any aa, unknown, or other
MKMVIVLVVCLALSAASASAMQMPCPCAGLQGLYGAGAGLTTMMGAGGLYPYAEYLRQPQCSPLAAAPYYXGCGQPSVMFQPLXAQCLQQQMRMMDVQSVAQQLQMMMQLGACRCPQQQAVRASSDAAAAAAAGSPGSQPHGHD

SEQ ID NO: 13030 - DNA, 741 bp, Zea mays
  misc_feature: Ceres CLONE 1373051-F
  misc_feature: Encodes the peptide sequence at SEQ ID NO. 13031
  misc_feature (280)..(280): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
tggagctccccgcggtggcggccgctctagaactagtggatcccccgggctgcaggaattcgcacgagaccattacctagaacatcctaatcgaaaactcttcttttccccctcctcccgctgccctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcgcttgacgcgnaggaggggcggcggcggcgcgaggacaatatggtggagatccgcaagagccgccgcgaggagagccttactcagaggcgccgcgaggggctccagggccaggtccctgcccctccctcgnnngtcgagaagagccttgaaagcctccagctatggccagtggggttattcggatgacaataccctcaggttgagggcacccaccagtttcccaggtggtatcaataggagggaccttccccttggggaattttcaaatccgggggattccacaatttgggcagtgcctcccaaaaaggttttgccccattggggtttcaaggggggggggcctcccaaaaattggcttcggggccttaaaaaaaacacaggggttatattggactggggggttgtcccaaattttgggaaacttttttggcctgggaaaagagatttttcccggggaggggttggggggtt

SEQ ID NO: 13031 - protein, 80 aa, Zea mays
  misc_feature: Ceres CLONE 1373051-F
  misc_feature (4)..(78): Pfam Name: IBB Pfam Description: Importin beta binding domain
  misc_feature (23)..(23): Xaa is any aa, unknown, or other
  misc_feature (63)..(63): Xaa is any aa, unknown, or other
MSLRPSERVEVRRNRYKVALDAXEGRRRREDNMVEIRKSRREESLTQRRREGLQGQVPAPPSXVEKSLESLQLWPVGLFG

SEQ ID NO: 13032 - DNA, 649 bp, Zea mays
  misc_feature: Ceres CLONE 1373055-F
  misc_feature: Encodes the peptide sequence at SEQ ID NO. 13033
cgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatgcccgggattggcaggaacatggtggcgccggctcctggtgctcaccctcatcatgtacatcatcgtcatcggcttcgcgaggctggacctggaacacttcatcaacggcagaccaactaccccgggcgtggccggcaacggggcgacgttctacttcctggttgtcgccatcctgcccggcgtgtgggccccgcctccaagctggcgggcgtgcaccacgtgcgcgcctggcgccacgacagcctggcccaccaacgccgggtcgtccctcaatcgctggggcatcacggggctcgcctttcggctggcctggaaggaaatccacatcgg

SEQ ID NO: 13033 - protein, 92 aa, Zea mays
  misc_feature: Ceres CLONE 1373055-F
  misc_feature (1)..(92): Pfam Name: AWPM-19 Pfam Description: AWPM-19-like family
MYIIVIGFARLDLEHFINGRPTTPGVAGNGATFYFLVVAILPGVWAPPPSWRACTTCAPGATTAWPTNAGSSLNRWGITGLAFRLAWKEIHI

SEQ ID NO: 13034 - DNA, 708 bp, Zea mays
  misc_feature: Ceres CLONE 1373058-F
  misc_feature: Encodes the peptide sequence at SEQ ID NO. 13035
tggagctccccgcggtggcggccgctctagaactagtggatcccccgggctgcaggaattcgcacgagaccattacctagaacatcctaatcgaaaaacatcccaattggaagggcagctaataaggtaaggggcgacgaagatggctccaacgaccgccaccaaggacgacagtggctacggcgactagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcacgaagcccccgtggaggggggagcatgcgctctactcgagggacctcgctcgcaacctgcggcttcgccctccacttcgacctcttcaaggctgctgacagcgactggagcgacaccttcttcctgcgaggtgactccgagcccgcctccgggggaggagctggcggagcactcaggaacgtcatgctgaagtacggcgcgg

SEQ ID NO: 13035 - protein, 43 aa, Zea mays
  misc_feature: Ceres CLONE 1373058-F
MGGMLRGVRQFTKPPWRGEHALYSRDLARNLRLRPPLRPLQGC

SEQ ID NO: 13036 - DNA, 650 bp, Zea mays
  misc_feature: Ceres CLONE 1373063-F
  misc_feature: Encodes the peptide sequence at SEQ ID NO. 13037
aagctggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgcccacctcggcgtccgcggctcctagccgggccgccctgagccgccgcc

SEQ ID NO: 13037 - protein, 108 aa, Zea mays
  misc_feature: Ceres CLONE 1373063-F
MLLTSCRQGRGMASLSCARADGVVRSGALPAKLLLCASCCFPTAAPVADGEVQVLACRQHLHRLPRRQDLRRQRPRRRHPQLVGLHQQPRQRGLVAVQRRAHLGVRGS

SEQ ID NO: 13038 - DNA, 615 bp, Zea mays
  misc_feature: Ceres CLONE 1373066-F
  misc_feature: Encodes the peptide sequence at SEQ ID NO. 13039
  misc_feature (332)..(332): n is a, c, t, g, unknown, or other
tggagctccccgcggtggcggccgctctagaactagtggatcccccgggctgcaggaattcgcacgagaccattacctagaacatcctaatcgaaaaatcaactcgaaccgaagggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccntcgtcttccactcctacatcgccctcggctcctaccagctggtgatcagcgagatcgactcgtcagccgctacctcgctgcaagccggggaagtgctcgcgctgtactcactgaaaacaggaagtgctatctcagcctcagggatgggtgagggatccgcaattggaagcatcctgttctggcggtgatgggtggattggttttttgcctgggccgggctccatgggggttcccaagaacccactctgggggaaaccgggttttcatggcttaaaggggcaca

SEQ ID NO: 13039 - protein, 103 aa, Zea mays
  misc_feature: Ceres CLONE 1373066-F
  misc_feature (42)..(42): Xaa is any aa, unknown, or other
MASPDLLFNLRNLFYLGAYQAAINNSDVPGLDADAAAERDAXVFHSYIALGSYQLVISEIDSSAATSLQAGEVLALYSLKTGSAISASGMGEGSAIGSILFWR

SEQ ID NO: 13040 - DNA, 664 bp, Zea mays
  misc_feature: Ceres CLONE 1373068-F
  misc_feature: Encodes the peptide sequence at SEQ ID NO. 13041
  misc_feature (372)..(372): n is a, c, t, g, unknown, or other
  misc_feature (406)..(406): n is a, c, t, g, unknown, or other
  misc_feature (421)..(421): n is a, c, t, g, unknown, or other
  misc_feature (444)..(444): n is a, c, t, g, unknown, or other
aagctggagctccccgcggtggcggccgctctagaactagtggatcccccgggctgcaggaattcgcacgagaccattacctagaacatcctaatcgaaaaacagaaatccagtcggcggggctgccgcctgccgcatcctcccctcgcccaccgtcgacgacttgatcccctcccaccgttgaggccgcctcctcacggcagcgagccagcgactcctctcttcttcgtctcctacaagtagccagacaccactccgactttgccggcaacccgtcgacagcgacgaggcgcagcataaggcatacgggcacggcggccatggcgaccagctccaaacccgccgcgccccgtggacccatggtcgtgctcngccacgagtttccccgaggtgtcattcgactacnacgagagggatgtancgttgtacgcgctccgggttggntgctggcggcgatgaccccgtcaacgaaaaagaacctccccttcgggtaccacagggatgggcaacccaacataaagaaccctcccaacttttgggtctttattcccccaaaaaaaaaaaaagggctttggatttttgagggggccggggcttaaattttggggggggccctttggggggggggaaaaaaaaaaaagagatttaagggaacccccttggt

SEQ ID NO: 13041 - protein, 92 aa, Zea mays
  misc_feature: Ceres CLONE 1373068-F
  misc_feature (18)..(18): Xaa is any aa, unknown, or other
  misc_feature (29)..(29): Xaa is any aa, unknown, or other
  misc_feature (34)..(34): Xaa is any aa, unknown, or other
  misc_feature (42)..(42): Xaa is any aa, unknown, or other
MATSSKPAAPRGPMVVLXHEFPRGVIRLXREGCXVVRAPGWXLAAMTPSTKKNLPFGYHRDGQPNIKNPPNFWVFIPPKKKKGLWIFEGAGA

SEQ ID NO: 13042 - DNA, 630 bp, Zea mays
  misc_feature: Ceres CLONE 1373083-F
  misc_feature: Encodes the peptide sequence at SEQ ID NO. 13043
  misc_feature (548)..(548): n is a, c, t, g, unknown, or other
tggagctccccgcggtggcggccgctctagaactagtggatcccccgggctgcaggaattcgcacgagaccattacctagaacatcctaatcgaaaatcgcacgagacaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcaaccaactaggttcattgaactctngcttcttatttgcaacaacaacaactaccattcagccagctacctgctgcctacccccagcaatttcttccattcaaccaac

SEQ ID NO: 13043 - protein, 154 aa, Zea mays
  misc_feature: Ceres CLONE 1373083-F
  misc_feature (128)..(128): Xaa is any aa, unknown, or other
MAAKIFCLLMLLGLSASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLGSLNSXFLFATTTTTIQPATCCLPPAISSIQP

SEQ ID NO: 13044 - DNA, 651 bp, Zea mays
  misc_feature: Ceres CLONE 1373117-F
  misc_feature: Encodes the peptide sequence at SEQ ID NO. 13045
tggagctccccgcggtggcggccgctctagaactagtggatcccccgggctgcaggaattcgcacgagaccattacctagaacatcctaatcgaaaaacaccaagaatctcatcataattcacacagcgaactcgtagaatccaacacagcatctagcaaagcagcgatccgacatccgagagatggacgcggtgatgttcgggctggagactcccctgatggcggcgctgcagcacctgctggacgtgccctacggctacgccggcgcggacggcgacaacaagacgggcagcggtgtcagcgccacgcgcacctacgtccgcgacgcgcgtgccatggcggccaccccggccgacgtgaaggagttgtccggtgcgcacgcgttcgtggcggacctgccggggctgggcacgggcgacatccgagtgctcgtggagtacaagagagtgctgttggtcaccgtgaatcgtcgtcgggaggagcgagatgacgacgcctagtacctgcgcatggagcgtcgcatgggcaagctcatgcgcaagttcgtgctgccggacaacaccgacgttgacgaggtctcccccgtgctgtaggcacggtgtgctcacggtgaccgttgataggctgcccccgccggagccccagtaatc

SEQ ID NO: 13045 - protein, 105 aa, Zea mays
  misc_feature: Ceres CLONE 1373117-F
MDAVMFGLETPLMAALQHLLDVPYGYAGADGDNKTGSGVSATRTYVRDARAMAATPADVKELSGAHAFVADLPGLGTGDIRVLVEYKRVLLVTVNRRREERDDDA

SEQ ID NO: 13046 - DNA, 679 bp, Zea mays
  misc_feature: Ceres CLONE 1373134-F
  misc_feature: Encodes the peptide sequence at SEQ ID NO. 13047
  misc_feature (304)..(304): n is a, c, t, g, unknown, or other
  misc_feature (347)..(347): n is a, c, t, g, unknown, or other
  misc_feature (404)..(404): n is a, c, t, g, unknown, or other
  misc_feature (413)..(413): n is a, c, t, g, unknown, or other
  misc_feature (600)..(600): n is a, c, t, g, unknown, or other
tggagctccccgcggtggcggccgctctagaactagtggatcccccgggctgcaggaattcgcacgagaccattacctagaacatcctaatcgaaaaaaaatcctccacaccctggactggagtggctgctgctcgtggccggcgatgagcggcggcgggcccggaggtgcgtgcgggccggactcccgcgtggagaccatctcccggctggcgcagtggcgcatcgataccttcggcccctgctcctaccgccggtcggacccctttaagctcggcatctggaactggtacctggtcggtggnagagaagcgctccatcgttgtgcgcctcttcccggagcccggncggggtggccagagagcagccccctctcgggcgcttcctgctccgcgtcttctgggnccggcccgncgcgaagcttctgcggtctcccctgtgcacgagcatcttctgctaccagcggatgatttttggatggcaagtcccatgcgatgtccccattgggcggtttacgatagggaggtgttagagtttcagagccctggaggtaagccaccgaaacatggctacggatcggtcccattggggggtggccaancgaaaggattgggtgggcaaaagaaccgcgaagcaagagcggcctgggggcctgccttgtcccgccattgcctgccgaa

SEQ ID NO: 13047 - protein, 107 aa, Zea mays
  misc_feature: Ceres CLONE 1373134-F
  misc_feature (68)..(68): Xaa is any aa, unknown, or other
  misc_feature (87)..(87): Xaa is any aa, unknown, or other
  misc_feature (90)..(90): Xaa is any aa, unknown, or other
MSGGGPGGACGPDSRVETISRLAQWRIDTFGPCSYRRSDPFKLGIWNWYLVGGREALHRCAPLPGARXGWPESSPLSGASCSASSGXGPXRSFCGLPCARASSATSG

SEQ ID NO: 13048 - DNA, 625 bp, Zea mays
  misc_feature: Ceres CLONE 1373142-F
  misc_feature: Encodes the peptide sequence at SEQ ID NO. 13049
tccccgcggtggcggccgctctagaactagtggatcccccgggctgcaggaattcgcacgagaccattacctagaacatcctaatcgaaaaaaaccgttcgtctagcttggctgttggttcgtccctgtccggtacccttctctcaactctcaagccgcgcagttgtcgaagtcgaaactatccgctgctgtagtagagatgctctcgatgcggccacccagcaccaccttgtcccgccggccgagacggggtcgcctcgggggagccgccgcgccgcaatatgttagcgctgcggcaccggcgcccgctctggagccagctgcgcctccggagagcgtctcctttccgattctggtgaatggctgcactggtaacatggggttatctgtcgctgaggctgctgctctgaggggccttcacctagtccctgtttcattcagcagtagagagaaggttgaaaaaacaatgcaagttggacaaacagacattcaaatatatggtccttctaaaagagaagatgttctttcatctattgctgatgaattcccagatgtcattgttgtggatacacaggacccggttctgtgaactctaatgctgagctctattgcaagcttggattgc

SEQ ID NO: 13049 - protein, 129 aa, Zea mays
  misc_feature: Ceres CLONE 1373142-F
  misc_feature: SWISSPROT Homolog: EC 1.3.1.26 Dihydrodipicolinate reductase
MLSMRPPSTTLSRRPRRGRLGGAAAPQYVSAAAPAPALEPAAPPESVSFPILVNGCTGNMGLSVAEAAALRGLHLVPVSFSSREKVEKTMQVGQTDIQIYGPSKREDVLSSIADEFPDVIVVDTQDPVL

SEQ ID NO: 13050 - DNA, 615 bp, Zea mays
  misc_feature: Ceres CLONE 1373156-F
  misc_feature (258)..(258): n is a, c, t, g, unknown, or other
  misc_feature (337)..(337): n is a, c, t, g, unknown, or other
  misc_feature (338)..(338): n is a, c, t, g, unknown, or other
  misc_feature (349)..(349): n is a, c, t, g, unknown, or other
  misc_feature (350)..(350): n is a, c, t, g, unknown, or other
  misc_feature (400)..(400): n is a, c, t, g, unknown, or other
  misc_feature (488)..(488): n is a, c, t, g, unknown, or other
  misc_feature (499)..(499): n is a, c, t, g, unknown, or other
ggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgncggcgtgctgctggtcgtagcagccacggccggggcggaggacggagtggtcgaacgggacccgcagggagacctgcgnntgtgcaagcanngcgtgcaagtggcagtaacggaagggacacccccgcgaaaaaggaatgcnaaagcgagtggcggaagcggaacagcaagctgaccggccgaggaggcaaacgggggttggacccctactttccccttcggaaaagggnaaagggccggnccagtgctttgccccccccaaggggccaccgggggaaaaccaaagggtattgaggggggcccccccccggatttggccctaaatgaaaaaaaaaaacgccccgcaaaaaaggcgga

SEQ ID NO: 13051 - DNA, 938 bp, Zea mays
  misc_feature: Ceres CLONE 1373161-R
ttttttttggggggaaaacttgaaagagagtcctggttacagaagctaacgttgagtacagacagtaggcagagattcggattccaacgtgaatggaatagctttatttatctgttcgttattctgctattcaactcgcaaggagatttgggcggatggagtggagatcacttggtatactcgaggacggcatagaaggggtcgagatagatggctcggaaggcggtgaagcctgcggcgtcgacgccgaggtggcggaactcctcctcggagcgctacctcccctgcgtccggtaggtggtcatgacgaagatgtcgttctccagcagcgccctcgtcctggtgctgctgtccgtctcctccggaaccaccggctctcaagtccacaatcttgccgccgtcccgcacagctccgtggcacttcctccgcgatggcctgtgcactctttcgttctgtccaccttcattcagaacccccactttcatgtaaaaatggccatccaccacattgggtgaaaggatattggaatatcttcctccgtccttaaatagctcgttacctcatccgcttatgggggaagcctctatccgctcccacccatccttcttgggtgatgagtacgatacacttttacccccctccttgtattatccgcaccggaggacacacgcaactctatgctcgcctccaccctcccccaaagagttatgtctgaattcattccctcacccacttaacaatcaccaccacgttgcatattgccacttccttcaaaccttcctcaaagtcaatctataattgagaaaatattataatataatgctacttctcaccttaatttaatatcttctcatgacttctcatttcctatttccttccgtgcgctgaatgttcttgcctcttctccctcgcctccccagtgttattcttctcaccg

SEQ ID NO: 13052 - DNA, 649 bp, Zea mays
  misc_feature: Ceres CLONE 1373162-F
  misc_feature: Encodes the peptide sequence at SEQ ID NO. 13053
  misc_feature (444)..(444): n is a, c, t, g, unknown, or other
  misc_feature (445)..(445): n is a, c, t, g, unknown, or other
  misc_feature (557)..(557): n is a, c, t, g, unknown, or other
  misc_feature (630)..(630): n is a, c, t, g, unknown, or other
  misc_feature (631)..(631): n is a, c, t, g, unknown, or other
tggagctccccgcggtggcggccgctctagaactagtggatcccccgggctgcaggaattcgcacgagaccattacctagaacatccaatcgaaaaatccccaaatcggcctacgcccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcgcgtcccgctacactttcgaccggnntcgcgtcatctttcgtcccgtcgcgcgccagtccgattgcatgatcgtcgccggcacgctcaccaaacagatggctccagccctccgccaaaggttatgaccaatgctgggnccctagggggggttatttcattgggcagctgggcccaccggggggggatactaccatactcccaccctcgggnnaaccggggatggaaccga

SEQ ID NO: 13053 - protein, 125 aa, Zea mays
  misc_feature: Ceres CLONE 1373162-F
  misc_feature: SWISSPROT Homolog: EC 1.6.5.3 NADH dehydrogenase (ubiquinone)
  misc_feature (93)..(93): Xaa is any aa, unknown, or other
MALLPRTARLALLSTPRAYSAAAAAGASPTSPAPYGGAPPPAMSKTAEFVVSKVDDLMNWARKGSIWPMTFGLACCAVEMMHAGASRYTFDRXRVIFRPVARQSDCMIVAGTLTKQMAPALRQRL

SEQ ID NO: 13054 - DNA, 654 bp, Zea mays
  misc_feature: Ceres CLONE 1373168-F
  misc_feature (300)..(300): n is a, c, t, g, unknown, or other
  misc_feature (312)..(312): n is a, c, t, g, unknown, or other
  misc_feature (491)..(491): n is a, c, t, g, unknown, or other
aagctggagctccccgcggtggcggccgctctagaactagtggatcccccgggctgcaggaattcgcacgagaccattacctagaacatcctaatcgaaaagagaagaaaggctgagactgaaacgtaggaacaccccgaagtctgaacatactagaagcgtaaccctaagtctcggaccccaaccctcgaggaaggcgaccggagatgcggcgtccctcggcgggtggagaagctcaaggtcctctggggactcgcaggtcaacgacgaggagcagtgggccttgagcttcatcaccgncgagaagatcgncaccatcgtgaaggcggccaacatcgaagtcgagtcctactgggcggcgctcttcgctaagctcctggagaagcgcagagggtgaagatctaatcctctccggtggatctgggtgggggcgctggttcaattgctgcttgcggccaaactgggagtggtggaactggtggtgcgccttnttgtgaaggggaaaaaaagaaaagccccagggggggagtctggatgaggacatggcttttaaagctggtcgaattgaggagagccctcggcgtaaccaggcattagaaaatttcccctattggtggcccagacttatcttacagctatgtctgtgagcccttt

SEQ ID NO: 13055 - DNA, 657 bp, Zea mays
  misc_feature: Ceres CLONE 1373173-F
  misc_feature: Encodes the peptide sequence at SEQ ID NO. 13056
  misc_feature (279)..(279): n is a, c, t, g, unknown, or other
  misc_feature (298)..(298): n is a, c, t, g, unknown, or other
  misc_feature (491)..(491): n is a, c, t, g, unknown, or other
  misc_feature (543)..(543): n is a, c, t, g, unknown, or other
  misc_feature (598)..(598): n is a, c, t, g, unknown, or other
ggagctccccgcggtggcggccgctctagaactagtggatcccccgggctgcaggaattcgcacgagaccattacctagaacatcctaatcgaaaaccaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacnaggaaggcattcccccggnacagcagcggctcatcttcgctggcaagcagctcgaggacgggcgcacacttgccgactatcacattcagaaggagagcaccctccaacttggtctccggctcacgggaggcatgcagatcctcggccagaacctcactggaaagactatcaccctcgaggtgggagtcttcttgagaccatcgacaacgtcnaggggccagattcaggacaagggagggcattccttccggaacaagaagcggntcaatttttgctggcaagcagcttcgaagaacgggcgcaccgctggccgactacnacatttcagaaagagagcaccctccactttggtggtggcgcctcagggggcggcatgcc

SEQ ID NO: 13056 - protein, 158 aa, Zea mays
  misc_feature: Ceres CLONE 1373173-F
  misc_feature (6)..(74): Pfam Name: ubiquitin Pfam Description: Ubiquitin family
  misc_feature (33)..(33): Xaa is any aa, unknown, or other
  misc_feature (39)..(39): Xaa is any aa, unknown, or other
  misc_feature (121)..(121): Xaa is any aa, unknown, or other
  misc_feature (139)..(139): Xaa is any aa, unknown, or other
MQIFVKTLTGKTITLEVESSDTIDNVKAKIQDXEGIPPXQQRLIFAGKQLEDGRTLADYHIQKESTLQLGLRLTGGMQILGQNLTGKTITLEVGVFLRPSTTSRGQIQDKGGHSFRNKKRXNFCWQAASKNGRTAGRLXHFRKRAPSTLVVAPQGAAC

SEQ ID NO: 13057 - DNA, 661 bp, Zea mays
  misc_feature: Ceres CLONE 1373178-F
  misc_feature: Encodes the peptide sequence at SEQ ID NO. 13058
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (418)..(418): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (521)..(521): n is a, c, t, g, unknown, or other
  misc_feature (522)..(522): n is a, c, t, g, unknown, or other
ggagctccccgcggtggcggccgctctagaactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtgggccggcgccgtcgtcgtcccgacggcgcggatggggccggacggcgnnnnncnnntggggttccggaaaagaaagcnttttggtgttgtaccagagcagcgccaaccctctgcccagcggcatcccggcctacaccgtgcagatcatcaacgctgcnnncggagggtgcaccgttgtacnnacgtgcacgtctacctgcggcgacttcgcctccacgggagctcgtcgacccggccagtttccagcgcgtcgccttcgaacgactgacgcagccaagggcggtgccgccttggaacccagcgagaccgtctccttccagt

SEQ ID NO: 13058 - protein, 157 aa, Zea mays
  misc_feature: Ceres CLONE 1373178-F
  misc_feature (67)..(67): Xaa is any aa, unknown, or other
  misc_feature (68)..(68): Xaa is any aa, unknown, or other
  misc_feature (69)..(69): Xaa is any aa, unknown, or other
  misc_feature (77)..(77): Xaa is any aa, unknown, or other
  misc_feature (104)..(104): Xaa is any aa, unknown, or other
  misc_feature (111)..(111): Xaa is any aa, unknown, or other
MGEWCFKKRAALVIIVAIISSLQLLLITAQEAGGDHEVWSSSSSPAGGRGGPAPSSSRRRGWGRTAXXXWGSGKESXLVLYQSSANPLPSGIPAYTVQIINAAXGGCTVVXTCTSTCGDFASTGARRPGQFPARRLRTTDAAKGGAALEPSETVSFQ

SEQ ID NO: 13059 - DNA, 784 bp, Zea mays
  misc_feature: Ceres CLONE 1373179-F
  misc_feature: Encodes the peptide sequence at SEQ ID NO. 13060
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (497)..(497): n is a, c, t, g, unknown, or other
  misc_feature (549)..(549): n is a, c, t, g, unknown, or other
  misc_feature (622)..(622): n is a, c, t, g, unknown, or other
  misc_feature (626)..(626): n is a, c, t, g, unknown, or other
  misc_feature (645)..(645): n is a, c, t, g, unknown, or other
  misc_feature (646)..(646): n is a, c, t, g, unknown, or other
  misc_feature (693)..(693): n is a, c, t, g, unknown, or other
  misc_feature (701)..(701): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnnnnnnnnnnnnnnnnnaaaaattggaactccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcgggcgcgatgcagtcgttgcgccccgtgaagcangcaaagcagcacatgtgcacgttcgcgctgtacgcgcacgacccgaagcggncagtggagaacgcacactacgtctcccgcctcaaccaggacttcctccagtgcggccgtctatgactccgacnaagncgacgcgcgtctcatcggnngtggagtacatccgggccaaggaaaaaacttcgactcgcctggccgncggaggancaaagggcttggggcacctcgcacgggcacggaaattcaagtccaggccttggggacgagcccgcacccggggggggggttgg

SEQ ID NO: 13060 - protein, 90 aa, Zea mays
  misc_feature: Ceres CLONE 1373179-F
  misc_feature (26)..(90): Pfam Name: DUF1264 Pfam Description: Protein of unknown function (DUF1264)
  misc_feature (52)..(52): Xaa is any aa, unknown, or other
  misc_feature (70)..(70): Xaa is any aa, unknown, or other
MASSDGKPLPTPASVGGGGGSSTAPPGQPTTVASKVLDMGAGAMQSLRPVKXAKQHMCTFALYAHDPKRXVENAHYVSRLNQDFLQCGRL

SEQ ID NO: 13061 - DNA, 641 bp, Zea mays
  misc_feature: Ceres CLONE 1373193-F
  misc_feature: Encodes the peptide sequence at SEQ ID NO. 13062
aagctggagctccccgcggtggcggccgctctagaactagtggatcccccgggctgcaggaattcgcacgagaccattacctagaacatcctaatcgaaaaatggaatcctgtagcttccgtgccgcaaccgcgccttctccctttccctccgctccttcttcatcttcatccccgcgcgccccatgccccatactccgatttcccaggccaagaaaagggaggcagattggggtgcggaggagggcgtccggatttgatgccttcgcgtctttcgccggctaggtcttcgtggatgaggcgattggagcggaatatggggagggcttcgaaacatttcgaatggatggaccactcaaggttgatgtgcattatctgaatgaaaaattgcaagagtgcttccttcaaaggataaggcatgctatgaagccgcatgaggcgtttggtctaattttttcgtgggacaatgttattgctgatacagactcgctacagctgaatgcttgcagacaacttgctttggaggaaggtaggatatccccagtgatgctcatgtccgggagagcatattcatggtgctgctgacatgttcatacaaaggtttcgactgggcaaaagaggacgaaacatgaaaaaattgag

SEQ ID NO: 13062 - protein, 80 aa, Zea mays
  misc_feature: Ceres CLONE 1373193-F
MDGPLKVDVHYLNEKLQECFLQRIRHAMKPHEAFGLIFSWDNVIADTDSLQLNACRQLALEEGRISPVMLMSGRAYSWCC

SEQ ID NO: 13063 - DNA, 675 bp, Zea mays
  misc_feature: Ceres CLONE 1373195-F
  misc_feature: Encodes the peptide sequence at SEQ ID NO. 13064
  misc_feature (375)..(375): n is a, c, t, g, unknown, or other
  misc_feature (611)..(611): n is a, c, t, g, unknown, or other
aaagctggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacgganaagaaggacgacgcggtggtgcagccgcagacctttcccgcccttcgaccgcctcggcggcggcgcgtccccggcgttcggcggcctccccggcggcagcattcctggcagcagcattcccgggttcagcatgcccggcagcggcagcagcctacccgggttcagcttgcccggcagcggagatgcccttcttttttgggggggggggttccccggcttcagcgggcttcggcggnaattgcccgggtcgcccacccgccggctcccgtccccgagcacgccaacaagccctgaacgcaa

SEQ ID NO: 13064 - protein, 56 aa, Zea mays
  misc_feature: Ceres CLONE 1373195-F
  misc_feature (36)..(36): Xaa is any aa, unknown, or other
MPGSGSSLPGFSLPGSGDALLFWGGGFPGFSGLRRXLPGSPTRRLPSPSTPTSPER

SEQ ID NO: 13065 - DNA, 652 bp, Zea mays
  misc_feature: Ceres CLONE 1373196-F
  misc_feature: Encodes the peptide sequence at SEQ ID NO. 13066
aaagctggagctccccgcggtggcggccgctctagaactagtggatcccccgggctgcaggaattcgcacgagaccattacctagaacatcctaatcgaaaaatcgatccagtgcaaacaagctcgctcgcaagcgcaacccacccacgtctacggtctaccacacgaagtatcgtagccagccagccagctaaacccacaccacacatggccgggatcgtgggggcgtgcgacttcaacaagacaatcatcgacgtggacagcgacaactgggtgggggacagcctcggcctcaccgacctgtgcgagcgcctcctccccaccacgccctggaacacgctcatgtacaatatgatgggggagctgcacgcgcggggcacgacgctgtgcgagccgacctgatgcttcacgccagctgccatctacccacgcgtgctcgacgccggcagggacagcggcgcgctcttgctgtgacctgagcatgtccacccgatgccgaggcgttctgatctccgccgtccgggaccaccacggcctgatcgtctgcttctcgcagtccaacaccagccgccaccgcgtcgacttgtacgtgcgactccccatctggccttcgcagtacgcggctcctgagcccgcacggctgaggcgtcga

SEQ ID NO: 13066 - protein, 64 aa, Zea mays
  misc_feature: Ceres CLONE 1373196-F
MAGIVGACDFNKTIIDVDSDNWVGDSLGLTDLCERLLPTTPWNTLMYNMMGELHARGTTLCEPT

SEQ ID NO: 13067 - DNA, 657 bp, Zea mays
  misc_feature: Ceres CLONE 1373206-F
  misc_feature: Encodes the peptide sequence at SEQ ID NO. 13068
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgactagatcactggtcggatggcggacgacgacacatggggaagggtagtgtgggtgcatcatggtgggcgttcctcctgctcgccggcgtgctgctggtcgtagcagccacgcccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgttcgaggacggcgacagcggcgtggacgcctacgtctcccgctccgggaggtgcgagtgccggcgccagtgcctgcgccgccacgagggccagccgtgggagacccatgagtgcatgaggcggtgccgccgccgcggactgcccgtcgacatgcagcaagagtacggtcgcggtagtgagagcgcgcataagtgccgtcagatgtgcgagcgccaccacc

SEQ ID NO: 13068 - protein, 149 aa, Zea mays
  misc_feature: Ceres CLONE 1373206-F
MGKGSVGASWWAFLLLAGVLLVVAATPGAEDGVVERDRKEDLRWCKQACEWQYGKDTPRKRECESECRERHQQADAFEDGDSGVDAYVSRSGRCECRRQCLRRHEGQPWETHECMRRCRRRGLPVDMQQEYGRGSESAHKCRQMCERHH

SEQ ID NO: 13069 - DNA, 656 bp, Zea mays
  misc_feature: Ceres CLONE 1373210-F
  misc_feature: Translation starting site: 292
aagctggagctccccgcggtggcggccgctctagaactagtggatcccccgggctgcaggaattcgcacgagaccattacctagaacatcctaatcgaaaaaactactccgtcattttgattgttaagatcctcctcgatccatcgatcactgcaccgagccggcggcaccgcgttcgaagggattatcccaccatacgctatcattggcgtaccgtgaccgcaccgatgtctacagtattgcccacggcacctacggtcataactacattatgcaggaggcctccgcccgatgactgagcaggtgaacgaaatgctccacgaccaggggcctacggtaccacaagcgctgacggtgacgagcctgatcccgctgggtggcctgctgctgctgctgtcgttgctggagctgacgatctccgtgatggggctggacgagaacacaccggtgctacctgatactcagccacgtactgatgcccgacgctgtgctcatcttgacacacgacatgcgtttcctcacgtcagttgctctggggatcggaggtctgtcctcgctcacatgactactgaaaacggtgcggcaagcgctccagcgcataccggagtacgtgcatgacgcctacgtacgatagcgcaagtcctttcatacacgcc

SEQ ID NO: 13070 - DNA, 675 bp, Zea mays
  misc_feature: Ceres CLONE 1373215-F
  misc_feature: Encodes the peptide sequence at SEQ ID NO. 13071
  misc_feature (544)..(544): n is a, c, t, g, unknown, or other
  misc_feature (641)..(641): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctcggaaaaggggcgagtgccggcgccagtgcctgcgccgccacgagggccagccgtggagnacccaggagggcattgaggcggtgccgccgccgccggactggccgtcgacatggagccaaggagtacggtcgcggcagcgagagcgcgggcagtggncccgggaagaagtgcgagcgccccccccgcgggg

SEQ ID NO: 13071 - protein, 115 aa, Zea mays
  misc_feature: Ceres CLONE 1373215-F
  misc_feature (111)..(111): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSEKGRVPAPVPAPPRGPAVEXPGGH

SEQ ID NO: 13072 - DNA, 664 bp, Zea mays
  misc_feature: Ceres CLONE 1373216-F
  misc_feature: Encodes the peptide sequence at SEQ ID NO. 13073
  misc_feature (516)..(516): n is a, c, t, g, unknown, or other
  misc_feature (521)..(521): n is a, c, t, g, unknown, or other
  misc_feature (538)..(538): n is a, c, t, g, unknown, or other
  misc_feature (592)..(592): n is a, c, t, g, unknown, or other
tggagctccccgcggtggcggccgctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggaaaaacaggtgaaggaaattgtgttgaaggctatgggacaggctataagcaaggcagtggctattgctgagatcataaagaagaggattcctggttngcatncagatacaataatcagntctgtcaggattactgatgtatgggagcccattgaggaaggacttgtacaaggnagatgactcggcatgttccaatgaaatcgatttccttggcccctaagggagataacaaaattcccctgggaa

SEQ ID NO: 13073 - protein, 101 aa, Zea mays
  misc_feature: Ceres CLONE 1373216-F
  misc_feature (18)..(88): Pfam Name: Alba Pfam Description: Alba
  misc_feature: SWISSPROT Homolog: EC 3.1.26.5 Ribonuclease P
  misc_feature (75)..(75): Xaa is any aa, unknown, or other
  misc_feature (77)..(77): Xaa is any aa, unknown, or other
  misc_feature (82)..(82): Xaa is any aa, unknown, or other
MDRYQRVEKPPPEAAAIGENEIRITTQGLVRNYVTYATSLVQEKQVKEIVLKAMGQAISKAVAIAEIIKKRIPGXHXDTIIXSVRITDVWEPIEEGLVQGR

SEQ ID NO: 13074 - DNA, 624 bp, Zea mays
  misc_feature: Ceres CLONE 1373218-F
  misc_feature: Encodes the peptide sequence at SEQ ID NO. 13075
aagctggagctccccgcggtggcggccgctctagaactagtggatcccccgggctgcaggaattcgcacgagaccattacctagaacatcctaatcgaaaaaccacacatattattgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggcgtcttcagtatgtgaaaacccaattcttcaaccctacaggatccaacaggcaatcgcagcaggcatcttacctttatcacccttgttcctccaacaaccgtcagacctattacagcagttacctttgaagcatttgttggcacaaaacatcaaggcacaacaactacaacaacttgtgctaggaaaccttgctgcctactctcagcaacagtagtttcttccattcaaccaactggctgcattgaactctgctgcttatttgcacaactactaccattcagtcacctagctgctgcctacgcccaggaaattctgcaatcaaccaaatggcagga

SEQ ID NO: 13075 - protein, 114 aa, Zea mays
  misc_feature: Ceres CLONE 1373218-F
MAAKIFCFLMLLGLSASAATATIFPQCSQAPIASFLPPYLSPAASSVCENPILQPYRIQQAIAAGILPLSPLFLQQPSDLLQQLPLKHLLAQNIKAQQLQQLVLGNLAAYSQQQ

SEQ ID NO: 13076 - DNA, 660 bp, Zea mays
  misc_feature: Ceres CLONE 1373229-F
  misc_feature: Encodes the peptide sequence at SEQ ID NO. 13077
caagctggagctccccgcggtggcggccgctctagaactagtggatcccccgggctgcaggaattcgcacgagaccattacctagaacatcctaatcgaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtccctaacgagccggagccggcggagcccgacactgagactgacaccttggaggccgaggccgtcgcctcacccaccgaggcacagccaaaggaatcatagcccggacgccgccgccaccccagcaccaacccagctccccgcaacagagaccgcaggccagcctccccctcgcaccagcacaccaacgctgcctccttcccccccatcgacggcctgctcgaccccgtccattccccgcccgtagacccaattagtccgcccccctcctcccaccttccccccacaccctcg

SEQ ID NO: 13077 - protein, 76 aa, Zea mays
  misc_feature: Ceres CLONE 1373229-F
MAAVEVQVPTAAPVEEAAQLAAASAVETPNEETAAPAVETEVVVPNEPEPAEPDTETDTLEAEAVASPTEAQPKES

SEQ ID NO: 13078 - DNA, 712 bp, Zea mays
  misc_feature: Ceres CLONE 1373232-F
  misc_feature: Translation starting site: 627
cccagctgaagctccccgcggtggcggccgctcatacatagtggatcccccgggctgcaggatttcccacgagaccattacctagaacatcctaatcgaaaactaatcgagcatcgcatagatccgcgtcttcgtactcgcctacctccgcggctcaaacctttcccccttctcccaattccctccgtcggccgccgctccatcccgtacgacgacaccatgagggagtgtatttcgatccacatcggccagctcggcatccaggtcgcaaacgcgtgctggaagctgtactgccttgagtatgccatcccccgctcccccccacctgccgggagggaagaccactgacgacaatcagatgatcatatctcacacaaatccgggggcactccagtgcgagcttcaaccgcccccccccccagctcggcggcgtccccccctccccctccccactcacccctccccaccccgcgcccgcccacgcggccgccgccccgtgatggccccccccccctctccatgggacgttccccccatcaataccactacaatcaaccgccacactcaccccaaccccccccttatccgccgcctcgccgcccccgcctgagtccgcatgaatacacatggccggcgtactccgcccccgctgtactcccgcggacctcgggtatacagttactcttgcttcttcgctgtgcccctccccccg

SEQ ID NO: 13079 - DNA, 687 bp, Zea mays
  misc_feature: Ceres CLONE 1373233-F
  misc_feature: Encodes the peptide sequence at SEQ ID NO. 13080
  misc_feature (31)..(31): n is a, c, t, g, unknown, or other
caagctggagctccccgcggtggcggccgcnctacaactagtggatcccccgggctgcaggtaactcgcacgagaccattacctagaacatcctaatcgaaaactaatcgagcatcgcagagataggcgtcttcgtactcgcctacctccgcgggtcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggccagatgcccggtgacaagaccattgggggaggtgatgttgcctccaacacctacacgcaggagagaccgcccccgctaggcacgtatcccgtccccctgtctctcgacgccgacacaactgtaatcgaacgaccaggagaagcggcaacgcccggggaccgcggggccccccccccccccccatccctagacaacaaaggcacgaaatagactatatgagcgaccaagccgccacgctccaccgcctgcggatgcgagatgccccccgccaccagagcgccgtggtaagttacgcccgccccacacgcgcggtgagaggcgggctcggagagaaggcatcctctgctgctccctctcccccctcc

SEQ ID NO: 13080 - protein, 103 aa, Zea mays
  misc_feature: Ceres CLONE 1373233-F
MRECISIHIGQAGIQVGNACWELYCLEHGIQADGQMPGDKTIGGGDVASNTYTQERPPPLGTYPVPLSLDADTTVIERPGEAATPGDRGAPPPPPSLDNKGTK

SEQ ID NO: 13081 - DNA, 657 bp, Zea mays
  misc_feature: Ceres CLONE 1373234-F
  misc_feature: Encodes the peptide sequence at SEQ ID NO. 13082
  misc_feature (657)..(657): n is a, c, t, g, unknown, or other
aaagctggagctccccgcggtggcggccgctctataactagtggatcccccgggctgcaggaattcgcacgagaccattacctagaacatcctaatcgaaaaattccccgtttgccttgtttaccattcctccccaaaacacatcctgcgatcctcgaaacctccgccgagcatcgatcatgtcgggctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgggagctcctgttctgctgccctggtgccctccagtacatcagcggtgtgatcctcttcgaggagaccctctaccagaagaccaaggatggcaagtcttttgtcgatgtcctccaggagggaggcgccctgcctggcatcacggtcgacaagggctgccattgatgttgtccgctgcaagaaggaaaacactccccagcgtccagaggacctccgtcccggatgccctaaggactacgaccacttgaccgcatctttctttggcagatgggtttacctaaccggcacattgtgactttgcctgtggcccccn

SEQ ID NO: 13082 - protein, 109 aa, Zea mays
  misc_feature: Ceres CLONE 1373234-F
  misc_feature (11)..(109): Pfam Name: Glycolytic Pfam Description: Fructose-bisphosphate aldolase class-I
  misc_feature: SWISSPROT Homolog: EC 4.1.2.13 Fructose-bisphosphate aldolase
MSGYCGKYADELIKNAAYIGTPGKGILAADESTGTIGKRLSSINVENVEENRRALRELLFCCPGALQYISGVILFEETLYQKTKDGKSFVDVLQEGGALPGITVDKGCH

SEQ ID NO: 13083 - DNA, 722 bp, Zea mays
  misc_feature: Ceres CLONE 1373236-F
  misc_feature (34)..(34): n is a, c, t, g, unknown, or other
  misc_feature (722)..(722): n is a, c, t, g, unknown, or other
ccaagtggagctccaccgcggtggcggccgctcnatactagtggatcccccgggctgcaggaattcccacgagaccattacctagaacatcctaatcgaaaaataatcgacaatgggagatatggccgtcttcgtaatcgcctacctacgggggtcaaacctttcccccttctcccagttccctccgtcggccgccgctccatcccgtacgacgacaccatgagggagcgcacttccatccggatggtgcaggagggtatccacgacggaaacgcgagctgcgagctggacggcgtgtgaagatggccctcaagctgacaactccagggccgccgacacgaccggacggggggaggcggcgatgcttcatcccgccgtatgataaaaccataaaggcgccagagaaaacaaccgccaacctttgctccgccagaccccaccccacaggccgagtacccccggcagtggggggtggatcaccacagcgtcgattcgcggcacccgccccccccccccccgtccagcttcgccgcaggtcgtggcgcgccaattgtgggtgtggcacaccgcttactcagccgcgccccccggagcggcggcgacatgctgacacgacccgtgacgacagagggctgagcagccggcccgcactcctcgcggcgctcccggtctggggagtcggcgctccacgcgggcactgctcgttccttagttggctcccn

SEQ ID NO: 13084 - DNA, 688 bp, Zea mays
  misc_feature: Ceres CLONE 1373239-F
  misc_feature: Encodes the peptide sequence at SEQ ID NO. 13085
aaagctggagctccccgcggtggcggccgctctataactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttccttcccccatacctttccatcatgatagcttcagtatggggaaaacccgctcttcaaccccataggttccaacaaggaattgcaggaagcaacataacttttttccccctgggtttaaaaattccccacgccctttcttttggggggggatttggggcaaaaaccttcaggggccaaccaattgtgggcaaactcgggggtcccggggggacaacccaaaaaatttttgggaaaaatcttttcccccctctcttccaagaaaaaaaatttttttttcttttttacccacccgtgttccatttgtacccccgcgggtggtttttttttgtgcgaaaaaaaatatattcccccttttttgcgccccccctctaacccgtgcccctcattctctccaaaaaaccaaacaatttct

SEQ ID NO: 13085 - protein, 56 aa, Zea mays
  misc_feature: Ceres CLONE 1373239-F
MATKIFSLLMLLALSACVANATIFPQCSQAPIASLPSPIPFHHDSFSMGKTRSSTP

SEQ ID NO: 13086 - DNA, 751 bp, Zea mays
  misc_feature: Ceres CLONE 1373240-F
  misc_feature (751)..(751): n is a, c, t, g, unknown, or other
cccgctggagctcaccgcggtggcggccgctctataactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagccgccgtcgtcctcgagctcggcgcaccggccacctgccgcactgctcctggccgtcgtcgtgttgaccgctctccccggcgtcccccctgttcccgcccccctctccgtcgcgtcgctcctcttacgccccgccccccccccgccccccccccccttttccccctcccccctcccccccccccctcgcccccccgctcaacacccccacgaatatcttcctcccttcctcgtccccccgcccgctcccctctttgtgtctcctgctcatttttatacagtccccccctccccctgccctccctcatttatcttccctccgccgccccctcgctacggtccgtttttggtgtccccccccacaccccctcccctttcttcctctcgtctcactcccttcgtccccccccccccccacactccgccccacgtacaaccaaccccagactcggcgcccccccccctcgtccccatcctttcccccccacgatccgcgctcccccccccccccctcccgccttcccgtctcccatcccccctcatatactctaaccactaccctcctccctcctcctn

SEQ ID NO: 13087 - DNA, 803 bp, Zea mays
  misc_feature: Ceres CLONE 1373243-F
cccgctggaagctcacgcggtggcggccgctctagtactagtggatcccccgggctgcaggaattcgcacgagaccattacctagaacatcctaatcgaaaaagagaaagtcagatccgtgttccgtgtccgcgtccagtgtgtccgctactccgctccccctcagtcctcagttcctcacctagcggtagtgtgcgcgcgggagacgtatatggcgcccttcggaggcgtcaccgatcccttgcaacaccggcgacgcctacacatcccacgcctggtcccgcgcccacccccctatgcagtggagcaatggtgatctaacaacccctttttctcccccttaccgcgtccgcttgtgtcttcgcccttgttgagttgtgtgtggagtatgaggtctacaaaccatgcctcccccccccctccctcctctctttctccatcttaccttctccttatacgtcaccacttccttcatcaacactcttaccccctattacatcatccaccctcccatgagatacagcagtacaacatcagaaactattcagtttcctcctccccactcctcccgtccccgctttcctcttcccgttacatcctccttcaccttcacccccaatacagccacaccttccccccatcactaccacaccacctcccatccatgcacctcagtgggtcttgatcacgtacaccctcccgcctcccccgtcatgactcaactccgcgcaacttctataaacttacccgctgcatacacccacacatcccaccatacccctaccatctcgcgctcacctccg

SEQ ID NO: 13088 - DNA, 645 bp, Zea mays
  misc_feature: Ceres CLONE 1373244-F
  misc_feature: Encodes the peptide sequence at SEQ ID NO. 13089
ccccgctggagctccccgcggtggcggccgctctataactagtggatcccccgggctgcaggaattcgcacgagaccattacctagaacatcctaatcgaaaaacactctgcccagctaagctaagctccctccgtccatcggcatggcgactaccactactaccatcctcctcctcctcctcgtcgcagccacagccgtctcggcggccgacctctccgtgtaccacaacgtgcacccgccgtccccgtccccgctcgagtccatcatcgcgctcgcccgcgccgacgacgcgcggctcctcttcctctcatccaaggcggcctcgtccggcggcgtcacctccgctcccgtcgcctccggccagactccgccctcgtacgtcgtccgcgcggggctcggcaccccggtccagtagctgctcctcgcgctcgacaccagcgccgacgccacctggtcgcactgcgcgaagtgcgacacgtgccccgccggcagccgcttcatcccggccacctcctcctcgtacgccctcttcccgtgccgcctccgactggcgcccgctcatccacggcccgccgggcccgcagacacacgacccctcccccgccgcgcccggcctgccgtcctcgccaaggcatacgcccct

SEQ ID NO: 13089 - protein, 90 aa, Zea mays
  misc_feature: Ceres CLONE 1373244-F
MATTTTTILLLLLVAATAVSAADLSVYHNVHPPSPSPLESIIALARADDARLLFLSSKAASSGGVTSAPVASGQTPPSYVVRAGLGTPVQ

SEQ ID NO: 13090 - DNA, 770 bp, Zea mays
  misc_feature: Ceres CLONE 1373247-F
ccagctggagctcaccgcggtggcggccgctcttgcactagtggatcccccgggctgcaggtattcgcacgagaccattacctagaacatcctaatcgaaaaaccaccaccactggacgtcagcctagcaattagctcatcgactccagattggagaactcgacaccatgaaggtgctgatcgttgcccttgctctcctggcgctcgcagcgagcgccgcctccagcattgtggtgtgtgtggctgccacccccccccgccccgtctaccgccccccgtcgatgtggctggctccgtgtgtatctgcccccccccgcacctgttggcacacctgaggacgacccgaggccgacgacctgctgatttgttgggggtcgcgcccccgccccccccctgtgctcgccactgtgcccgcaaatagcccaccccccccgcactccaccgccgccgtcagtcgcctgctggttcccctccccccccctcccctcgcgcggcgccgcccctcgcccctcgttggactctctcagcccccccccccaccaaacacaccaggcaatgcacatccgcagaccccgccacaccacgccccccttctctctcctctgtctcccaggacttctcctccccccccgcgcgcagctcctgctttcccttcgtccttgccctggagccccgaggccgctccctcccgcgctctatcgtggcacccgctcccccccctcttcccgcgcacctacgcttgtccagcgaccacgctgcccacccccacg

SEQ ID NO: 13091 - DNA, 642 bp, Zea mays
  misc_feature: Ceres CLONE 1373248-F
  misc_feature: Encodes the peptide sequence at SEQ ID NO. 13092
caagctggagctccccgcggtggcggccgctctagaactagtggatcccccgggctgcaggaattcgcacgagaccattacctagaacatcctaatcgaaaaatctccagcggcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactgcgctttatgggtggtgccaagggcccccacctcacactcaccatgcctgcctccatgaacatgcagagcacgaccctaccgaacgcctcctgggggctgcttagccccccactgccaccctcctgcgcaggaacagatgctgccccgaacgcctggtcggccctccctcatattaccctccccc

SEQ ID NO: 13092 - protein, 146 aa, Zea mays
  misc_feature: Ceres CLONE 1373248-F
  misc_feature: SWISSPROT Homolog: EC 2.5.1.47 Cysteine synthase
MGEASPSIAKDVTELIGNTPLVYLNKVTEGCVGRVAAKLESMEPCSSVKDRIGYSMITDAEEKGLITPGVSVLIEPTSGNTGIGLRFMGGAKGPHLTLTMPASMNMQSTTLPNASWGLLSPPLPPSCAGTDAAPNAWSALPHITLP

SEQ ID NO: 13093 - DNA, 703 bp, Zea mays
  misc_feature: Ceres CLONE 1373249-F
cccgctgaagctcaccgcggtggcggccgctctagactagtggatcccccgggctgcaggaattcgcacgaaaccattacctagaacatcctaatcgaaaaatcagtagtaaccactcctcgtcgtctctctcgcggtctcgcctcctgcagctagcgctcgccagaaagggaaaccgcatctgctccagcctcccgtcccgtctcggcgccgccgcctgatcgaccagagcccagcgcggggcgtcgaggccgcccgggccgggtccggcgctcagatctgaggcgagtagtgagcgaaccacctgccgcacgcccgcccccacgacgcccccccccacagcccgccgcgcccgcgcccccgccctcccaccccctcccccccgcccccgcggcgcgcccgctcgcggcccgcggccgcgcgccgcgggcccgccgggccgtcccgcgcccccgcgcccccctccgcagccccgcgcgccggggcgcggaggggtcgggtgccgcccccccccccccccccccccccccccggccgcgcgcccccccgcgcgcgcgcccccccacccgcacccgtccgggcgcccccctctccccgacccccgtggtggcgccccggccgccccaccgctgtattgccgccccgcccccccgccccccccccgcttccgcccccctccgcgcgccgtgccggcagcccgccc

SEQ ID NO: 13094 - DNA, 682 bp, Zea mays
  misc_feature: Ceres CLONE 1373253-F
  misc_feature (571)..(571): n is a, c, t, g, unknown, or other
cccagctggagctcaccgcggtggcggccgctctataactagtggatcccccgggctgcaggaattcgcacgagaccattacctagaacatcctaatcgaaaaatcccatccccgcaggtctcagtagtcaggccctcacacacctcactatacactgatctgctgcagtgagaaggaagaagcgtagcggctccctagctctcgttgtcagtaatggacaccaccgccgcgtccagcctcctcaagtcctccttcgcgggctcccggctcccttcggtcacgggcaccaccaccccgtcgtccgtggacgaggccaccccgggcgccggcgctggtcccatccacgcggccatcacctcctcccccacccagccctacgacctgacgagcttccggaaccctcccatgacggaggccatcgagtacggcaagaagaccccgcctgtcatgacgcacccgctcgccgtggctacacacccatctcgccgactggggagacccgcctccaccgtctcctccggcgcccctgctcttcccccgcccaccctctcgaccaaccccccccaccgncgtcggggagtggtgctattcccgcggagaccaacgggaatatcgcgctgcctccgccaccccaccctagcggggctttaccagcccgctccgctacgccccccccgcccg

SEQ ID NO: 13095 - DNA, 696 bp, Zea mays
  misc_feature: Ceres CLONE 1373254-F
  misc_feature (32)..(32): n is a, c, t, g, unknown, or other
cccgctggagctccccgcggtggcggccgctncttactagtggatcccccgggctgcaggaattcgcacgagaccattacctagaacatcctaatcgaaaaatccaccatattacttgagaccaacgagttatatagaaagtcggctccctgtagtcacactcagagcaacactggttgaccaatatattttctcctcgttatgctccttgctctttctgcatgtgtccgctaacgccaccattttccctcaatgctcacaagcacctatagcttcccttcttcccccataccttccatcaatgatagcttcactatgtgaaaacccagctcttcagccctataggctccaacaagccaccgcagcaagcaacatacctttatcacccttgttgtttcaaccatcgccagccctatctttggtgcactcattgctacaaaccactaagccccagcagctgcagcaactcgtcctacctgtgattaacccagtagctccgccccccctcttctccccactgccagtcgcccccctcctcctccccccccatccccctgccccacacccgcctcccccccacacacatttgaatttcccccccgcagtcactatgccacaccaaaatcactccacccgaccacctccagacgcctcttcctctgtttcctctccgaccccaatcccccccagcgcccc

SEQ ID NO: 13096 - DNA, 685 bp, Zea mays
  misc_feature: Ceres CLONE 1373256-F
  misc_feature: Encodes the peptide sequence at SEQ ID NO. 13097
aagctggagctccccgcggtggcggccgctctataactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccaccgctttgatctgcccgccgccaccatgcccctaccttactcaaccggccggggctcagcctcatccccacccacacccatccccgtgacaaacgcgccgctccaagtgtgccccccctccccggcaccctggcgtcgtccgctcacacccctcccctcgggccccagcgcgcgcgggcgtgctgaggcttggaccgcctccccgccagccacccccgccccctcgctctgcccccacccgaccacagacaccactgtcctcggcttaccaccacttcgccccccagcgacc

SEQ ID NO: 13097 - protein, 76 aa, Zea mays
  misc_feature: Ceres CLONE 1373256-F
MRVLLVALALLALAASATSTHTSGGCGCQPPPPVHLPPPVHLPPPVHLPPPVHLPPPVHLPPPVHLPPPVHVPPPL

SEQ ID NO: 13098 - DNA, 668 bp, Zea mays
  misc_feature: Ceres CLONE 1373257-F
cccgctgaagctccccgcggtggcggccgctctatcactagtggatcccccgggctgcaggaattcgcacgagaccattacctagaacatcctaatcgaaaaaccctacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggcgccgacgccggcggcaccctcttcagcgacactggccccccccacccccgtcctccgtgcccgccttgtcgcccccgcgctcattgccaccccccccccactcgcatggccccccccgctcgggcccccccccccccccccctctccatcgacgacgaccccacgaccccaccacctcccccccccgtccgtcttgtgcttgccccccccccgccgctaacccagtcccatgcacagcaacactccccctggctggtgcgctgccctgcctcccttctgccccacccacatcaccccccgcc

SEQ ID NO: 13099 - DNA, 651 bp, Zea mays
  misc_feature: Ceres CLONE 1373258-F
  misc_feature (21)..(21): n is a, c, t, g, unknown, or other
  misc_feature (257)..(257): n is a, c, t, g, unknown, or other
  misc_feature (263)..(263): n is a, c, t, g, unknown, or other
ccccgctggagctccacgcgntggcggccgctctatactagtggatcccccgggctgcaggaattcgcacgagaccattacatagaacatcctaatcgaaaacccgatgccctaacccacggttacgactccgacgacgccaccccggcggcctgctgcccagctccctctgccttcgcgcagtgcctcctacccttttgaatccgcgccgtgccacccgagtccaggccggcaggcccccagggtgcgagggcggnaccggngcaggcgaaccgcagtccgcgcctccgcactccgccccatccgaagctccgagcagagcacgagcagcaaagcaagcgagcgccagactggctgaatcgagaggtggaggcagtaaccaacaagggagcactatgaaggccgagattcttcactggcatgcagcggctccttgcacgtgggacgcctcggcatgagacctgtgctatatggatgccccccccccgccgcaccgctgtgctggcctgccacctcccctgttcgcatgcctgtattactctttcgttggtgttcctataagaattgctctatctccctcccctccccccgcccccacctgccctctccacccccattcccccccccctctcgtttctcctcccctcctgc

SEQ ID NO: 13100 - DNA, 718 bp, Zea mays
  misc_feature: Ceres CLONE 1373259-F
  misc_feature: Encodes the peptide sequence at SEQ ID NO. 13101
gccggctggagctcaccgcggtggcggccgctctatacactagtggatcccccgggctgcaggaattcgcacgagaccattacctagaacatcctaatcgaaaaaccagagagtcagagtgcggaggtgaacgtgacgtgacgctcctcctctataaaaggagacgcctgtgctgcagtgtgcacagcacagcccgtcgcgcgccgctgcgttgaggttgagccaaggcgcaatggcaacctccacctcagttcccgtcctcctgctcctcgccgccgccgccggcctcctcctgctccccggctcgctggcgtgccagagcatcaactgtgcaccgggcgcgcccggcagcgcctcgccgacgtggccttcacccccgctccggctccggcggcgaccaccgccccccccaccccagcaagccgccccaagcacccccatgcgcaacccgaccaagtgccccgccctggcaccccacccgtacgtgctcttcgcacgcctccccccttctccgtccatatgcttccctctttatgtttctggctcgaccccctctcttccttctccatcccccgttaccctgtccccccatatccccccccgcaccccccccccaacccctattgaaccctcctcccacccctacctcgtcccccctttaccctccccccccccacccccccgaccccccctcccgcccccctccacctctctgcgt

SEQ ID NO: 13101 - protein, 35 aa, Zea mays
  misc_feature: Ceres CLONE 1373259-F
MLPSLCFWLDPLSSFSIPRYPVPPYPPPHPPPNPY

SEQ ID NO: 13102 - DNA, 669 bp, Zea mays
  misc_feature: Ceres CLONE 1373260-F
cccgctgaagctcaccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggccgcccgatgggtgagcacctgaagggcatgctccacgacaacgggccgacggcgccccagggcgctgacggtgctgacaccgttaccgatgggggggctggagctgacgctgtcgcccccccccccccccccttccgacccggggcggcccgcgtcaacccccctcccccaaaccccccactgcccgcgggacgtccccggcgtgcaggcccccaccaccgcaccacagccgtacccaacgctcatctgcggcggcggcgacagtcccaagcccgcccccgggggcgacggtcccgccgcgctggggggcacggcgacccccgccccccccagccgagacaccccccgcaggcagccggcgcgtagggcagcaaccccacccc

SEQ ID NO: 13103 - DNA, 728 bp, Zea mays
  misc_feature: Ceres CLONE 1373261-F
ccagctggagctcaccgcggtggcggccgctctataactagtggatcccccgggctgcaggaattcgcacgagaccattacctagaacatcctaatcgaaaaattttttcttccccatcttggagaagaagaaggcccgacgccctcgccgctgccaccaaaatcgcacgcgagccccaaagatccccaaaccctacacccgcccgccggcgcactcggggaccgtcgaatcgagcaggttgacggaggagaggaagcctcgaagatgctccggaaccagcacgacaccgacgagaccgaatggcagtcccaaggggtgactgacccccgccgaaagtatatacatgccacccccccaagccacgccctcagattggggttagggctccggcttaagccgcttattgggggtcccgcccgccgccccccaacacccgactcccagagtattttctactccttctccatgaaaataacgcccaaggtgttaacgccgcgagcatcggttcgggttccccccccccaccagcgcccaacgaaccgcgacgacctcgcgctccccctccgcccccctccgcctctcccactccgtccttgtcctcctcctcgactgtctttctttccctccccccactcccgcgtacttctccgtgcgacgcaccccacctccctccgcgcagctcctccccatccgtcccccgccacccctccttcttcttacccctatt

SEQ ID NO: 13104 - DNA, 719 bp, Zea mays
  misc_feature: Ceres CLONE 1373262-F
gccggctgtagctccaccgcggtggcggccgctcttgcactagtggatcccccgggctgcaggtttccgcacgagaccattacctagaacatcctaatcgaaaaacaaagaagccggtgtacggagagcagagagcttcagcgcaactgcgctcaatcgtttcttcgtctttagctggcgcttggtctccctccgtcctctgcttcccaaactgacgtcgtctcagctgactcttttgcttgctagcaccacagcacactcctctctctagagctgagcacctccttgctgaaggtagctagttagcgacaaccctgcccccctcgtacaccattccccccggcgatccgcgtgatcgattatgctacccttcctgttgcttattcctctttctcgctcgtctactctcatcccccccctggcacgcacgccccccccgccccccccacatcatccattctcctgtctgcacacccctcttgttactcccacgtcgcgcccatgtcgtggtgcccccccccccccccccccctttcctctttatgctttcgcatcggtctttaatgatccgcctccatcagcctccccaccccctgcacttgttgtaccatctccaatctgttctaatcacacccgaccgcccctttctccctctcgttccttctcctcctccgcccctccctcatcacccccccccctcccgtccctctccccgcctc

SEQ ID NO: 13105 - DNA, 490 bp, Zea mays
  misc_feature: Ceres CLONE 1373263-F
  misc_feature: Encodes the peptide sequence at SEQ ID NO. 13106
  misc_feature (52)..(52): n is a, c, t, g, unknown, or other
  misc_feature (73)..(73): n is a, c, t, g, unknown, or other
ccagctgagctccccgcggtggcggccgctctatcaactagtggatcccccngggctgcaggtaattcgcacngagaccattacctagaacatcctaatcgaaaaaacgctcctgctcacagcgtgggggatcttcgcagagatggcgaggactcgttcctgcagaagctggagcacagggctggaaggcgcccccccccccccactttcgcagcaaacacacaaccccctccccccccccacccccggccccccctcccgcgggacacctcccccccccgcccaccccccgcccccccacagccccccccaccaaaagtacgcctccccccgcccccttcctctctctccccccaccaccccacctccccccccgccaccccccccccccccccccccccccccccccccccctcccaccgccccccctctcccccatacccccccccccccccccccctccttgccacccccccccccctccaccccc

SEQ ID NO: 13106 - protein, 116 aa, Zea mays
  misc_feature: Ceres CLONE 1373263-F
MARTRSCRSWSTGLEGAPPPPLSQQTHNPLPPPTPGPPSRGTPPPPAHPPPPHSPPHQKYASPRPLPLSPPTTPPPPPPPPPPPPPPPPPPPTAPPLPHTPPPPPPSLPPPPPSTP

SEQ ID NO: 13107 - DNA, 686 bp, Zea mays
  misc_feature: Ceres CLONE 1373269-F
cccgctgaagctcaccgcggtggcggccgctctataactagtggatcccccgggctgcaggaattcgcacgagaccattacctagaacatcctaatcgaaaaactcacaaagaagccggggacggagagcagagagcttcagcgcaactgtgctcaatcgtttcttcgtctttagttggtgcttggtctccctccgtcctctgtttcccaaacagaggcgtctcacctgactcttttgcttgctacccccataggacagtctctctctagagctgaccaccaccttgctgaaggtagttagttagcgaccaccatggtctcctcgcaccccatccgcccggccctcggtgtcatcgtccatggtatcggtcctagtgccctttcctctccccggagccttacatttattccgcttcccgcaatcaagccccccctgcaggttcgcctttgtgggttctttcccctctacctctctccccccggacatgtctcccttctgtctgtcatctcccgctccgcccccttctcctccccccatcctccttctcctccccccccctctctccccccgcttcctcctacctctcctcccccctcgcgctttccacccgcccctcctcccctcaactttccttgtctctcttcccccctctcacttccaccctcccacccccccccccctcccc

SEQ ID NO: 13108 - DNA, 655 bp, Zea mays
  misc_feature: Ceres CLONE 1373271-F
  misc_feature (206)..(206): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (230)..(230): n is a, c, t, g, unknown, or other
  misc_feature (231)..(231): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (246)..(246): n is a, c, t, g, unknown, or other
  misc_feature (306)..(306): n is a, c, t, g, unknown, or other
  misc_feature (310)..(310): n is a, c, t, g, unknown, or other
  misc_feature (311)..(311): n is a, c, t, g, unknown, or other
  misc_feature (371)..(371): n is a, c, t, g, unknown, or other
gcttgctggagctcaccgcggtggcggccgctctagcactagtggatcccccgggctgcaggaattcgcacgagaccattacctagaacatcctaatcgaaaatctgatgccgtaacacaaggctgaatttttgttcggtctagccgacccgacgatggcgtccagcgacgggaaaccactgccaaccccggcctctgtgggcggngnnnnnnnnnnnnnnnnnnnnncnnccnnncnnncccccnccccccccccccccgcgccggccccgggcgcggcggcgccgccggccccgcgccccgcgncccnngccccccccccgcgcgcccccccgcgcgggccgcgcgcgccccgcgggggggggcgcgcncgcccccccgcgccccccgcccccgccggcgcgcccccccgcgcgccggccgcgcccccgacccccccgacgcgcgccgccccgccgcgccgggcggcgggccgggggaggaccccccccccccccccccccccacgagcggccgcgcggcgccgcccgcccggcgcgccaccccccgcccccgccgccccaccaaccccgcccccggccccccccgcgccgagacggcgcgagcccccccccccagcgccggccccgggcgggagaacacccgcccccccccc

SEQ ID NO: 13109 - DNA, 733 bp, Zea mays
  misc_feature: Ceres CLONE 1373272-F
  misc_feature: Encodes the peptide sequence at SEQ ID NO. 13110
cccgctggaagctcacgcggtggcggccgctctagcactagtggatcccccgggctgcaggaattcgcacgagaccattacctagaacatcctaatcgaaaattcacgccaagagaccccgctcccgatcccgtctcctcctcgcagtcgctgcttcgcgaggagccgaagatgctgctcctgcgggcgtcgacgccgttcgcgtacgccaaggcggacaaggtggacgcggaggaggtgtggaatctcagggcgcacttcctcttccactcggcgctgcagtctgatatgtcttgggttgaagaagatgataaggctgtgcctccttgatgtgccctctccccgaccgcccgcagggaagtcttctcctcgcccccacaccgccgcccgtgattcctgcccccctgcgcccctccccccccccggacacccgtgccctccctcgcttccgggttttgtatgggtcgcgcgccccggcgcctcatggcgcgggggcctccgctgggggcatcggcggaggtgttgccaccccctaccgcgtggcaccctctcccgtgagaagggggtgccgcgcccgctccggcgcccgggtggtgccatcacgagaccgaacctcggttggcgtcccgagtcgacggctcgcagctacgcgtgctgatgcgcgcggcttactccttttccgctctcgctcgcctctcaccctccctcacccattccctccgtcactcccccg

SEQ ID NO: 13110 - protein, 109 aa, Zea mays
  misc_feature: Ceres CLONE 1373272-F
PAGSSRGGGRSSTSGSPGLQEFARDHYLEHPNRKFTPRDPAPDPVSSSQSLLREEPKMLLLRASTPFAYAKADKVDAEEVWNLRAHFLFHSALQSDMSWVEEDDKAVPP

SEQ ID NO: 13111 - DNA, 744 bp, Zea mays
  misc_feature: Ceres CLONE 1373273-F
ccagctggagctcaccgcggtggcggccgctctatactagtggatcccccgggctgcaggaattcgcacgagaccattacctagaaaatcctaatcgaaaaggagcatcaccgttcactggataattcgctcgctccgctcgatgcccgcttgtttgcggtgaagcctccggcgaacagccgtagcggaaacgccgcccgagatgcctgctccctccgccccaccccgcacggtgatgtgtgtgccccacactcaccgccacatcacacccccgccacagccctcgccccaacccccaggtgagaagtacccgaggacgccttcaccactgccccgggacaccctcgcccagcaaacacaacgacccgcccccctgcacaccccgcccggtcgtaccacttacctcctagagggtcgccacaccgctattgcagcgacaccgcccccacccccccccccgccaccacaaccacgacattctaccgttccccaccgcctccacgccgggtccgggtatagggccaccccgccatatccccccaccccacgctcccggctgcgcgtgggagacccccgcaccaacaacccacacaccccccccccaacgaccccccaccccccccacaccccgcgcaatcatcacgccacatccccctcacctgacggcaacgcacccccggaagcgatccacaacctaatcgattcccactcgaaatccaacacacaacccacacacaacgatac

SEQ ID NO: 13112 - DNA, 730 bp, Zea mays
  misc_feature: Ceres CLONE 1373276-F
  misc_feature: Encodes the peptide sequence at SEQ ID NO. 13113
  misc_feature (1)..(1): n is a, c, t, g, unknown, or other
ncccgctggagctcaccgcggtggcggccgctcttgcaactagtggatcccccgggctgcaggtatttcgcacgagaccattacctagaacatcctaatcgaaaacttttcctagggttttgtcgcctccagccgccgccgcgtccgcctcgccaagcgcagcagccgccgcagcacatcgctctcttgatctcagccatggcggaggtggagcagcaacaggacacgccgaagctcttcaaccgctggaccttcgatgatgcccaggcgaacgacatctcgctgaacgactacctcgctgtgaacgccccgaattacgcgatgtacctgccgcacaccgcgcggcgcgctacgcctcgacgcggtttccgttagggcccccctcccggagcgctgggccgccctacgcagtcggtcgaggacgcaccgccgccacccaccgccgatgacgggcgtggcccgtcccgcaacccccccgccagagcctgggagaacccatgccgccggcgcccggggccccccccccccccccccaggtctggccgacgtcccccctccacatcacgagaggggccgcgcaccccgggcctcgctggcgattaccgcgcccccccctctccgcctggtcgctactcttcccgccagccggcaacaacctcccccccgcacgcccccgcgcgctcagaccctccaaccacgctgccaccccattcctcccgcgtgttccgac

SEQ ID NO: 13113 - protein, 58 aa, Zea mays
  misc_feature: Ceres CLONE 1373276-F
MAEVEQQQDTPKLFNRWTFDDAQANDISLNDYLAVNAPNYAMYLPHTARRATPRRGFR

SEQ ID NO: 13114 - DNA, 654 bp, Zea mays
  misc_feature: Ceres CLONE 1373282-F
  misc_feature: SWISSPROT Homolog: EC 2.4.1.215 Cis-zeatin O-beta-D-glucosyltransferase
ccccgctggagctcaccgcggtggcggccgctctatcactagtggatcccccgggctgcaggaattcgcacgagaccattacctagaacatcctaatcgaaaaatacttttcctccttcagtttttatcacacgtcaatggagtggggctagcaatggcatggtaacttttccaatctttttgcattaaaaaagaaatcctaaagaaaaaggattactaaacgagcacgctcgccggcgctgggaccaggctctgggtctcgcatcacgatcagatccaatccaaggccgcgccccagcccggcggatggattccgccgccgtggccatcgtgacggtgccgttcccggcgcagggccacctgaaccagctgctgcacctgtccctgctcctggcatcgcgggggcttcctgtccacttcgccgcgccggagccgcacctccgggaggcccgcgcgcgcctgcacggctgggggcccgaccccccccccccgtgcttccgcgcgctggaggtgtccccgcacgactccccctccccggagccgtcccccaccttcccggcgcccatgcccacccctctccaaggccttcctccaccggcccgcgtgccctccccagcccccccctcccgccccacctggaccacacccaccacc

SEQ ID NO: 13115 - DNA, 661 bp, Zea mays
  misc_feature: Ceres CLONE 1373285-F
  misc_feature: Encodes the peptide sequence at SEQ ID NO. 13116
  misc_feature (361)..(361): n is a, c, t, g, unknown, or other
  misc_feature (398)..(398): n is a, c, t, g, unknown, or other
  misc_feature (428)..(428): n is a, c, t, g, unknown, or other
  misc_feature (503)..(503): n is a, c, t, g, unknown, or other
  misc_feature (504)..(504): n is a, c, t, g, unknown, or other
aaagctggagctccccgcggtggcggccgctctagaactagtggatcccccgggctgcaggaattcgcacgagaccattacctagaacatcctaatcgaaaaattcacacaccacacctcccgaactacaagtttcgcttctcgtcgcgacgactgggcgagaccgccgccgccgcctgagttctgtagaaatggctgatggtgaggacatccagcctcttgtctgcgacaatggcactggaatggtcaaggctggttttgctggcgacgatgcaccaagggctgttttccctagtattgttggccgtcctcgccacactggtgttatggtagggatgggacagaaagatgcgtatgttgncgacgaggcacagtccaagagaggtattctcacgctncagtatccgatcgagcatggtattgtgagncactgggatgacatggagaaaatctggcatcacacttttctacacgagcttcgtgttgccccagaggagcacccnntgtgtgctcactgagctccctttgacccaaagcccacagggagaagatgacccagattatgttcgagactttcaatggtcctgccatgtaccgtgcaattcaagcagtgctgtcactctatgccaggggacgtactactggtattgttctccactct

SEQ ID NO: 13116 - protein, 108 aa, Zea mays
  misc_feature: Ceres CLONE 1373285-F
  misc_feature: SWISSPROT Homolog: EC 2.7.10.2 Non-specific protein-tyrosine kinase
  misc_feature (57)..(57): Xaa is any aa, unknown, or other
  misc_feature (79)..(79): Xaa is any aa, unknown, or other
  misc_feature (105)..(105): Xaa is any aa, unknown, or other
MADGEDIQPLVCDNGTGMVKAGFAGDDAPRAVFPSIVGRPRHTGVMVGMGQKDAYVXDEAQSKRGILTLQYPIEHGIVXHWDDMEKIWHHTFLHELRVAPEEHPXCAH

SEQ ID NO: 13117 - DNA, 710 bp, Zea mays
  misc_feature: Ceres CLONE 1373287-F
  misc_feature: Encodes the peptide sequence at SEQ ID NO. 13118
  misc_feature (440)..(440): n is a, c, t, g, unknown, or other
agagctggagctccccgcggtggcggccgctctagaactagtggatcccccgggctgcaggaattcgcacgagaccattacctagaacatcctaatcgaaaaaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcacaatcgccagccctatctttggtgcagtcattggtacaaaccatcaggncacagcagctgcagcaactcgtgctacctgtggaacaccaaagaagcttcggcaaacccttttctcctaactctccagaaaaaaaaaatttcttccatttcaacccaattgggttaacactggacccccggggggttattttgccaaaacacaaattattaccccttttccgcccgcgttgttccggggcaatccctcaagaaaaaaaaacattttttcccatttaaaacatattggggccgcaacgaaacccccgcctggtttattttg

SEQ ID NO: 13118 - protein, 129 aa, Zea mays
  misc_feature: Ceres CLONE 1373287-F
MATKIFSLLMLLALSACVANATIFPQCSQAPIASLLPPYLPSMIASVCENPALQPYRLQQAIAASNIPLSPLLFHNRQPYLWCSHWYKPSGHSSCSNSCYLWNTKEASANPFLLTLQKKKISSISTQLG

SEQ ID NO: 13119 - DNA, 639 bp, Zea mays
  misc_feature: Ceres CLONE 1373288-F
  misc_feature: Encodes the peptide sequence at SEQ ID NO. 13120
  misc_feature (417)..(417): n is a, c, t, g, unknown, or other
  misc_feature (613)..(613): n is a, c, t, g, unknown, or other
aaagctggagctccccgcggtggcggccgctctagaactagtggatcccccgggctgcaggaattcgcacgagaccattacctagaacatcctaatcgaaaaattaaagcacgcgcgcgccctgagctccccctcagtcctccctagtcctttctccatcacaaaagctattcttttttccctaaagctcggagaccgccggaagcgagcgatggcgtgctagactaaaaccctgctgttggcgctcagcgaagcggtgctggtcggggtgcagtctgactcccacggactgtcggacttcacgagcgagagtggtgaggcgacgacggcgccggagatgcagaccttcttcaagccccagctcgctgcaatgctcccggaggacctcgacgcctccatgcccgctaagacagaggngcgcgacggtgtgccacacgtacaataggagggcggcactggacgcgataaacacgaagggatggatgtagcctctgctgtcaacaagtgctgttatgcaatcgccgaggacatcttagagactgcttgcaccaggacaaccatgaagttcgccacgtgctgcataatccaccatgcactccgctttcatcacctngacccacatccagagaagactctgtt

SEQ ID NO: 13120 - protein, 35 aa, Zea mays
  misc_feature: Ceres CLONE 1373288-F
  misc_feature (27)..(27): Xaa is any aa, unknown, or other
MQTFFKPQLAAMLPEDLDASMPAKTEXRDGVPHVQ

SEQ ID NO: 13121 - DNA, 611 bp, Zea mays
  misc_feature: Ceres CLONE 1373289-F
  misc_feature: SWISSPROT Homolog: EC 4.1.1.33 Diphosphomevalonate decarboxylase
  misc_feature (262)..(262): n is a, c, t, g, unknown, or other
  misc_feature (276)..(276): n is a, c, t, g, unknown, or other
  misc_feature (287)..(287): n is a, c, t, g, unknown, or other
  misc_feature (331)..(331): n is a, c, t, g, unknown, or other
  misc_feature (352)..(352): n is a, c, t, g, unknown, or other
aaagctggagctccccgcggtggcggccgctctagaactagtggatcccccgggctgcaggaattcgcacgagaccattacctagaacatcctaatcgaaaaaatccatttacctgtccaccaaaccagtctgtagtgttttttccctccctaatgaacagaccacggaggtgacgaagcagcggtagagacaaattagcgagcagagaaggggtactggcgatgacacaccttgccattgagccacatgcggtcggaaggnaatgaggggctgancgcgacagtgntggtggcgcaaagatgggtcgggtcgagcgttacgctgatgctngtcgtgatggggaaggatgancgcctcgtcccgcttccccagtaactgatccccgaaatgttggtcgggtccccccccttggcatgaagacccattgccccctcggccgccgcatttgaaatcctcggtttcgggtgggtttttggccgaaaattccctttgcaaggggaagttataagggcataatcccccacatctttttaagaccggggggggaaggggagaccccggggggcccttttttttcgaccacccccccaagtgtcccctgcgggagaaa

SEQ ID NO: 13122 - DNA, 653 bp, Zea mays
  misc_feature: Ceres CLONE 1373299-F
  misc_feature: Encodes the peptide sequence at SEQ ID NO. 13123
  misc_feature (513)..(513): n is a, c, t, g, unknown, or other
  misc_feature (543)..(543): n is a, c, t, g, unknown, or other
  misc_feature (556)..(556): n is a, c, t, g, unknown, or other
  misc_feature (592)..(592): n is a, c, t, g, unknown, or other
aaagctggagctccccgcggtggcggccgctctagaactagtggatcccccgggctgcaggaattcgcacgagaccattacctagaacatcctaatcgaaaagttgtcttggcggctgcggcggagcacggaggcgaaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatcccccagacaatggagaactacaggctgctttatgacaccnaggggcgcttccgtcttcaccccatcaggnatgaggatgcccnagtcaagctctgcaaggtgaggtctggtcagttggnccagaaaggcatcccctacctgaacacctacgacggccgcaccatccgctaccccgacccg

SEQ ID NO: 13123 - protein, 152 aa, Zea mays
  misc_feature: Ceres CLONE 1373299-F
  misc_feature (3)..(40): Pfam Name: RS4NT Pfam Description: RS4NT (NUC023) domain
  misc_feature (94)..(152): Pfam Name: Ribosomal_S4e Pfam Description: Ribosomal family S4e
  misc_feature (106)..(106): Xaa is any aa, unknown, or other
  misc_feature (116)..(116): Xaa is any aa, unknown, or other
  misc_feature (120)..(120): Xaa is any aa, unknown, or other
  misc_feature (132)..(132): Xaa is any aa, unknown, or other
MARGLKKHLKRLNAPKHWMLDKLGGAFAPKPSSGPHKSRECLPLILIIRNRLKYALNYREVISILMQRHVLVDGKVRTDKTYPAGFMDVISIPQTMENYRLLYDTXGRFRLHPIRXEDAXVKLCKVRSGQLXQKGIPYLNTYDGRTIRYPDP

SEQ ID NO: 13124 - DNA, 642 bp, Zea mays
  misc_feature: Ceres CLONE 1373301-F
  misc_feature: Encodes the peptide sequence at SEQ ID NO. 13125
  misc_feature (499)..(499): n is a, c, t, g, unknown, or other
  misc_feature (529)..(529): n is a, c, t, g, unknown, or other
  misc_feature (570)..(570): n is a, c, t, g, unknown, or other
aaagctggagctccccgcggtggcggccgctctagaactagtggatcccccgggctgcaggaattcgcacgagaccattacctagaacatcctaatcgaaaactagccgcatcccttctttcattcgccgccgccgcctgctctctgctgccgtcgccatggggagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccttccatgtccctcgtatcaacaagatgctttcgtgtgctggggctgataggctccagactgnaatgagggggtgctttggcaagcctcaggncacctgtgctagggtggacattggtcaggtcctcctttctngtcgatgcaggaacaacaatgctgcacatgccagtgaagctctgcgtcgcgccaaagtcaagtcccctggcc

SEQ ID NO: 13125 - protein, 161 aa, Zea mays
  misc_feature: Ceres CLONE 1373301-F
  misc_feature (5)..(159): Pfam Name: Ribosomal_L16 Pfam Description: Ribosomal protein L16
  misc_feature (114)..(114): Xaa is any aa, unknown, or other
  misc_feature (124)..(124): Xaa is any aa, unknown, or other
  misc_feature (138)..(138): Xaa is any aa, unknown, or other
MGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVPRINKMLSCAGADRLQTXMRGCFGKPQXTCARVDIGQVLLSXRCRNNNAAHASEALRRAKVKSPG

SEQ ID NO: 13126 - DNA, 655 bp, Zea mays
  misc_feature: Ceres CLONE 1373302-F
  misc_feature: Encodes the peptide sequence at SEQ ID NO. 13127
  misc_feature (486)..(486): n is a, c, t, g, unknown, or other
  misc_feature (516)..(516): n is a, c, t, g, unknown, or other
  misc_feature (529)..(529): n is a, c, t, g, unknown, or other
  misc_feature (592)..(592): n is a, c, t, g, unknown, or other
aaagctggagctccccgcggtggcggccgctctagaactagtggatcccccgggctgcaggaattcgcacgagaccattacctagaacatcctaatcgaaaaaagcattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagaccaaggatggcaagccttttgtcgatgtcctcaaggaggggagcgtcctccctggncatcaggtcgacaagggcaccatttgaggntgttgcaccgacnaggagaccacaccccaggccacgatgacctcggcaagcgctgcgctaagtactacgaggccgntgcccgctttgccaagtgcgtgctgttctcaagatggccccacgagccgtcacagcttgcatt

SEQ ID NO: 13127 - protein, 109 aa, Zea mays
  misc_feature: Ceres CLONE 1373302-F
  misc_feature (11)..(110): Pfam Name: Glycolytic Pfam Description: Fructose-bisphosphate aldolase class-I
  misc_feature: SWISSPROT Homolog: EC 4.1.2.13 Fructose-bisphosphate aldolase
MSAYCGKYADELIKNAAYIGTPGKGILAADESTGTIGKRLSSINVENVEENRRALRELLFCCPGALQYISGVILFEETLYQKTKDGKPFVDVLKEGSVLPGHQVDKGTI

SEQ ID NO: 13128 - DNA, 712 bp, Zea mays
  misc_feature: Ceres CLONE 1373311-F
  misc_feature (358)..(358): n is a, c, t, g, unknown, or other
  misc_feature (375)..(375): n is a, c, t, g, unknown, or other
  misc_feature (376)..(376): n is a, c, t, g, unknown, or other
  misc_feature (386)..(386): n is a, c, t, g, unknown, or other
  misc_feature (417)..(417): n is a, c, t, g, unknown, or other
  misc_feature (491)..(491): n is a, c, t, g, unknown, or other
aaagctggagctccccgcggtggcggccgctctagaactagtggatcccccgggctgcaggaattcgcacgagaccattacctagaacatcctaatcgaaaactcccgcgaccgcccggtgtctgtccgtcgccaagtcgtgctgggctgccgagcggagctccagctcgtttgtcctctcggctcctgcgactggcctccggcaaagtgggagccgcgtcctcagcatccgtgccaaggttgccactggcctgcagagggcctgcattgcggatgatggagcggaaaggccgtggaagctcagtgatgctcgtcttgtcctggaagatggatcagtgtggacggccaagtcttttgntgcttcaggaacacaanngtggtgaagntgttttcaacacatcactgacaggctatcangagatttttgaccgatcccagttatgctgggcaggttggccctattgaccattccctcatattgggaaaccctngcgttaaatccgggtggtggaaaaatccaacccaagggtttcttgggggggtttatccttaaaaactctaaagctttggttccttcccaacgggggggggcaaaaaaaaccctttgaaaaaaaatttgttttaaaaaggaaaaccccgggggaataattaatggggggaccccccccccttttcccccccaatattaagaaaggaaagagaactttttttt

SEQ ID NO: 13129 - DNA, 650 bp, Zea mays
  misc_feature: Ceres CLONE 1373319-F
  misc_feature: Encodes the peptide sequence at SEQ ID NO. 13130
aaagctggagctccccgcggtggcggccgctctagaactagtggatcccccgggctgcaggaattcgcacgagaccattacctagaacatcctaatcgaaaaacacactgctcgttctcacgacaaattcgattcatcaaaatctacaaacgtagtagtatttacgagaatagatattacaggcccaaacagctgctgcttctgttgaagcacgccgcaccggcagacgttacccctccaatgggcgaatgcagaacggagtacaggggcctgcccgacgccaatggcgaggacgcggggacggtgccggccgcgctccgcaaggtgtccatagtcccgctcgttttcctcatcttctacgaggtctccggcgggccgttcggcatcgaggacagcgtgggcgcagcggggccgctcctcgccatcgtcggcttccttgtcctccccgtcatctggagcatcccggaggcgctgattaccgcggagctgggcaccatgttcccggagaacggcgggtacgtcgtgtgggtcgcctcggcgctcggcccctactggggattccagcaagggtgggtgaagtggctcagtggcgtcatcgacaatgccctgtaccccgtcctcttcctggactacctcaagtccgccgtgcc

SEQ ID NO: 13130 - protein, 136 aa, Zea mays
  misc_feature: Ceres CLONE 1373319-F
MGECRTEYRGLPDANGEDAGTVPAALRKVSIVPLVFLIFYEVSGGPFGIEDSVGAAGPLLAIVGFLVLPVIWSIPEALITAELGTMFPENGGYVVWVASALGPYWGFQQGWVKWLSGVIDNALYPVLFLDYLKSAV

SEQ ID NO: 13131 - DNA, 686 bp, Zea mays
  misc_feature: Ceres CLONE 1373326-F
  misc_feature: Encodes the peptide sequence at SEQ ID NO. 13132
  misc_feature (276)..(276): n is a, c, t, g, unknown, or other
  misc_feature (292)..(292): n is a, c, t, g, unknown, or other
  misc_feature (300)..(300): n is a, c, t, g, unknown, or other
  misc_feature (301)..(301): n is a, c, t, g, unknown, or other
  misc_feature (311)..(311): n is a, c, t, g, unknown, or other
  misc_feature (313)..(313): n is a, c, t, g, unknown, or other
  misc_feature (314)..(314): n is a, c, t, g, unknown, or other
  misc_feature (320)..(320): n is a, c, t, g, unknown, or other
  misc_feature (323)..(323): n is a, c, t, g, unknown, or other
  misc_feature (330)..(330): n is a, c, t, g, unknown, or other
  misc_feature (333)..(333): n is a, c, t, g, unknown, or other
  misc_feature (354)..(354): n is a, c, t, g, unknown, or other
  misc_feature (358)..(358): n is a, c, t, g, unknown, or other
  misc_feature (359)..(359): n is a, c, t, g, unknown, or other
  misc_feature (361)..(361): n is a, c, t, g, unknown, or other
aaagctggagctccccgcggtggcggccgctctagaactagtggatcccccgggctgcaggaattcgcacgagaccattacctagaacatcctaatcgaaaagaaaatctctgctcatttcacatcgaacgctccgcctacaatcctgtactgcacgcgctccccatccgcacaacttcccgcctcccatggcggcgccggcgccgggggccacccgcctccaccccccgttcctcctgcttccttccccgccgcgaccccatcctccactccggntccgcttccctctggncgtcccgnncgctctccgncnntcgcgncgnttcccgntgntcgctgcccgcgccgtctccnccgnngncgccgctgcaggggaagaagccgccgcaggaaagccgaataggccacgcagctgcaaaacggggtcctcgtggccgccccatcggggtgggccaaggcggaatcgtgtcccccggggtttggtggttccaaacccccctcaaattttttccttttggcgttcccgggaaaaatttaaatttctccccaaaaatggcagggggggggggcccccccccccccaaaaaaatggtccccgcgggggtccccacaatgggggcctttgggcccctctttttgggttaaaaaagaccccgggggggttccccggggtttttttctccctc

SEQ ID NO: 13132 - protein, 166 aa, Zea mays
  misc_feature: Ceres CLONE 1373326-F
  misc_feature (30)..(30): Xaa is any aa, unknown, or other
  misc_feature (35)..(35): Xaa is any aa, unknown, or other
  misc_feature (38)..(38): Xaa is any aa, unknown, or other
  misc_feature (42)..(42): Xaa is any aa, unknown, or other
  misc_feature (48)..(48): Xaa is any aa, unknown, or other
  misc_feature (49)..(49): Xaa is any aa, unknown, or other
  misc_feature (56)..(56): Xaa is any aa, unknown, or other
  misc_feature (57)..(57): Xaa is any aa, unknown, or other
  misc_feature (58)..(58): Xaa is any aa, unknown, or other
MAAPAPGATRLHPPFLLLPSPPRPHPPLRXRFPLXVPXALRXSRRFPXXAARAVSXXXAAAGEEAAAGKPNRPRSCKTGSSWPPHRGGPRRNRVPRGLVVPNPPQIFSFWRSREKFKFLPKNGRGGGPPPPQKNGPRGGPHNGGLWAPLFGLKKTPGGFPGVFFSL

SEQ ID NO: 13133 - DNA, 671 bp, Zea mays
  misc_feature: Ceres CLONE 1373330-F
  misc_feature: Encodes the peptide sequence at SEQ ID NO. 13134
  misc_feature (490)..(490): n is a, c, t, g, unknown, or other
  misc_feature (495)..(495): n is a, c, t, g, unknown, or other
  misc_feature (601)..(601): n is a, c, t, g, unknown, or other
  misc_feature (602)..(602): n is a, c, t, g, unknown, or other
aaagctggagctccccgcggtggcggccgctctagaactagtggatcccccgggctgcaggaattcgcacgagaccattacctagaacatcctaatcgaaaaattcctcggagaggagaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctcgctcgcaagtacaacccaggacagatgatctgccgcaaatgctatgcacggctgcaccctaggnctgtncactgccgcaagaagaagtgtggtcacagcaaccagctgagggccaagaagagatcaagaactgaggtgttgctgctagtcagtttcatggacaatgttgtttggnntgtgacccgtgtttggttaccgaactattggccttatggtatgttttaccatgttggcgatgacacata

SEQ ID NO: 13134 - protein, 166 aa, Zea mays
  misc_feature: Ceres CLONE 1373330-F
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature (107)..(107): Xaa is any aa, unknown, or other
  misc_feature (144)..(144): Xaa is any aa, unknown, or other
MQIFVKTLTGKTITLEVESSDTIDNVKAKIQDKEGIPPDQQRLIFAGKQLEDGRTLADYNIQKESTLHLVLRLRGGIIEPSLQALARKYNPGQMICRKCYARLHPRXVHCRKKKCGHSNQLRAKKRSRTEVLLLVSFMDNVVWXVTRVWLPNYWPYGMFYHVGDDT

SEQ ID NO: 13135 - DNA, 658 bp, Zea mays
  misc_feature: Ceres CLONE 1373333-F
  misc_feature: Encodes the peptide sequence at SEQ ID NO. 13136
  misc_feature (408)..(408): n is a, c, t, g, unknown, or other
aaagctggagctccccgcggtggcggccgctctagaactagtggatcccccgggctgcaggaattcgcacgagaccattacctagaacatcctaatcgaaaagttcggacttccgccgcgcttcgccctctcgctccagccgcttcacagcgccgccgctcgcctctccgactgccgcgagaatgccgttcaagaggttcgtggagatcgggcgcgtggcccttgtgaactacggcaaagactacggccgcctcgtcgtcatcgtcgatgtggtcgaccagaacagggcacttgtggacgcccctgatatggtcaggtgccagattaacttcaaacggctctcacttaccgacatcaagattgacatcaaacgtgtccccaagaaagtcaccctttgatcaagctatnggagaagctgatgtgaagactaagtgggagaacagctcatggggcaagaagctgattgtccaaagaggagggctgcactcagtgactttgacaggttcaagtcatgctggaaggatcaaaagggtgttggtatcaggaaaaactttccaggtgaagaaggggcccactgttaaagccctttggggggagaaaggtaagtttttggttccagggggaaccaaatttggtttgaagggtgcaaaacccaaaa

SEQ ID NO: 13136 - protein, 71 aa, Zea mays
  misc_feature: Ceres CLONE 1373333-F
MPFKRFVEIGRVALVNYGKDYGRLVVIVDVVDQNRALVDAPDMVRCQINFKRLSLTDIKIDIKRVPKKVTL

SEQ ID NO: 13137 - DNA, 674 bp, Zea mays
  misc_feature: Ceres CLONE 1373334-F
  misc_feature: Encodes the peptide sequence at SEQ ID NO. 13138
  misc_feature (579)..(579): n is a, c, t, g, unknown, or other
aaagctggagctccccgcggtggcggccgctctagaactagtggatcccccgggctgcaggaattcgcacgagaccattacctagaacatcctaatcaaaaaatcccccggtgaggtgagcagaccacacctcccctccctctcgtgtcggagcctccgcctcggcttgtccccaccaacccgcagctcgctcccaccaaacccacacccgaacaatggcgtcggcgtccaaggaggaggtgatcgggaagctcaacgtccgcgtggtgcggggcaacaacctggtcatcgccgacccgctcacccacaccagcgacccctacgtcgtcctccagtacggcgctcagaaggtgaagactagtgtccacaagaagaactccaatccagtgtggaacgaagtactgcagctctcagtaacacatcctaacaaagcagtgcaccttgaaagtttttgatgaagacaagttcacagcaaacgacagcatggggtgttgctgacatcaacttaactgacctctacaatgctgcaaaactggaccctgaagcacgcctcctgatgggaacaggatcaagaccgtnctaccctggccgaataaaaatacccttggccggcgaaaacccatgttcacagggaaagaatggaaaagggggtcccaggaattggattcctgaaa

SEQ ID NO: 13138 - protein, 79 aa, Zea mays
  misc_feature: Ceres CLONE 1373334-F
  misc_feature (13)..(77): Pfam Name: C2 Pfam Description: C2 domain
MASASKEEVIGKLNVRVVRGNNLVIADPLTHTSDPYVVLQYGAQKVKTSVHKKNSNPVWNEVLQLSVTHPNKAVHLESF

SEQ ID NO: 13139 - DNA, 567 bp, Zea mays
  misc_feature: Ceres CLONE 1373339-F
  misc_feature: Encodes the peptide sequence at SEQ ID NO. 13140
aaagctggagctccccgcggtggcggccgctctagaactagtggatcccccgggctgcaggaattcgcacgagaccattacctagaacatcctaatcgaaaaatcgcccataatattttgagcattcaaaaacacacaaagggaagtgcactagcaacttcctaacaacaatggctaccaagatattagccctccttgcgctcctttccctttcagtgagcgcaacaactgcattccattattccacaatgctcacttgctcctaatgccattattccacagttcctcccatcagttacatcaatgggcatcgaacaccctattgtgcaagcctataggctacaaacagcgcttgcggcgagcgtcttacaacaacccggttgccaattaccacaacaatccttggcacatcctaccatacaaaccatcgcaccacaactagagcaacagtttgggcccccattgaaccaactagccgcgggggcccctggctcctacttggaacagcaaaaggttggaacccaacccattgggtctgggaaaaaaaagccgaataccaaaaaaaag

SEQ ID NO: 13140 - protein, 88 aa, Zea mays
  misc_feature: Ceres CLONE 1373339-F
MGIEHPIVQAYRLQTALAASVLQQPGCQLPQQSLAHPTIQTIAPQLEQQFGPPLNQLAAGAPGSYLEQQKVGTQPIGSGKKKPNTKKK

SEQ ID NO: 13141 - DNA, 687 bp, Zea mays
  misc_feature: Ceres CLONE 1373343-F
  misc_feature: Translation starting site: 102
  misc_feature (488)..(488): n is a, c, t, g, unknown, or other
aagctggagctccccgcggtggcggccgctctagaactagtggatcccccgggctgcaggaattcgcacgagaccattacctagaacatcctaatcgaaaaatggctcgccgactctgccgtctccctcgcctctttcccctcgtctcgtctgcatccgcctccgccgccccaagacctcatcacctccccttcgccgtgaaccctaaccccgcgcccctcgccccctccttctcgtcgtcatcgccgcccgcttttccgggcccccatcgcctcttctcttccacgagtggttcaagcatggtggtcgtgggctccgcggactccttcaacagcatcttttccaaggtgcaagatgaaaagctaccagctgtcttttactacacggcggtgtgggtgtggaccatgtagggcgatcgcacctttagtatcaaagctgagcagccagtatccccagatacgggtgtaacaaagttgacattgatttgnaaggactgggaaacaaaatcccggattcaaacttatgttaaggggccaaagtttcccttttattccaaggggggaaaaaaataagggaaaccggggggggggtggccaaaaaaaattgggactctccggggaaaagcccccccacggccctttagaaattttcaaaaaaaagcccccccccccccccaggggggagggg

SEQ ID NO: 13142 - DNA, 583 bp, Zea mays
  misc_feature: Ceres CLONE 1373347-F
  misc_feature: Encodes the peptide sequence at SEQ ID NO. 13143
  misc_feature (331)..(331): n is a, c, t, g, unknown, or other
  misc_feature (407)..(407): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (570)..(570): n is a, c, t, g, unknown, or other
gctggagctccccgcggtggcggccgctctagaactagtggatcccccgggctgcaggaattcgcacgagaccattacctagaacatcctaatcgaaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaaggttcggtccttcttctcgcgctcccgcagcggcaagcgcggcagcgcccggagagcaggctcgtcctcgccgcactcctccgcggncagcgcgccgccgtccccgtccccactcccgaagaggtcaccgtcgtcgtcgtcaaccacaccagggacgagacgnagcgcgtggttccgcaagttcgacgcgaaccggcgaacgggaaaatctcgcggtccgaggtgggggcggctgttccgaagggccggggcccaccccgggacccaaaaaaagggccgtttatttttttttgagaaagggggggggggnnnnnnnnnnntnnntnttttttttttttt

SEQ ID NO: 13143 - protein, 115 aa, Zea mays
  misc_feature: Ceres CLONE 1373347-F
  misc_feature (32)..(32): Xaa is any aa, unknown, or other
  misc_feature (107)..(107): Xaa is any aa, unknown, or other
  misc_feature (108)..(108): Xaa is any aa, unknown, or other
  misc_feature (109)..(109): Xaa is any aa, unknown, or other
  misc_feature (110)..(110): Xaa is any aa, unknown, or other
  misc_feature (111)..(111): Xaa is any aa, unknown, or other
  misc_feature (112)..(112): Xaa is any aa, unknown, or other
MGKVRSFFSRSRSGKRGSARRAGSSSPHSSAXSAPPSPSPLPKRSPSSSSTTPGTRRSAWFRKFDANRRTGKSRGPRWGRLFRRAGAHPGTQKKGRLFFFEKGGGGXXXXXXFFF

SEQ ID NO: 13144 - DNA, 658 bp, Zea mays
  misc_feature: Ceres CLONE 1373348-F
  misc_feature: Translation starting site: 172
  misc_feature (232)..(232): n is a, c, t, g, unknown, or other
  misc_feature (420)..(420): n is a, c, t, g, unknown, or other
  misc_feature (421)..(421): n is a, c, t, g, unknown, or other
  misc_feature (526)..(526): n is a, c, t, g, unknown, or other
  misc_feature (528)..(528): n is a, c, t, g, unknown, or other
  misc_feature (609)..(609): n is a, c, t, g, unknown, or other
  misc_feature (627)..(627): n is a, c, t, g, unknown, or other
  misc_feature (628)..(628): n is a, c, t, g, unknown, or other
aagctggagctccccgcggtggcggccgctctagaactagtggatcccccgggctgcaggaattcgcacgagaccattacctagaacatcctaatcgaaaaatttctctcctctctccgtcgccgcctcgggccaaaccctacgcagggagttgattgatcgattgcagccatgagtaagttgcattccgagcttctcaaggattgcatctcccagatagttcaggatgccnagaagaataggaagttcactgagactgttgagcttcagattagtctgaagaattatgatccacaaaaggacaagcgtttcagtggctctgttaagttgcctcacatccctcgtccaaagatgaaggtgtgcatggcttggtgatgcccagcacgttgaggaggctgagaagatgggacttggactacnntggatgttgaggccctcaagaaaatgaacaagaacaagaagcttgttaaaagctttgccaagaagtacccatgctttttttggcatcagagacccatcatcagcnanatttccccgtctcctttggccctgtcttcacaagcgcaggcagttccccactctggtcactcaccagaaatcctgggattncaggtgaatgagacgaanngctacagtcagttcaactgaagaagtcttt

SEQ ID NO: 13145 - DNA, 662 bp, Zea mays
  misc_feature: Ceres CLONE 1373354-F
  misc_feature: Encodes the peptide sequence at SEQ ID NO. 13146
aaagtggagctccccgcggtggcggccgctctagaactagtggatcccccgggctgcaggaattcgcacgagaccattacctagaacatcctaatcgaaaaattccccgccgcctcgcgcccccgctcgcttcacttctctaggtgcgcaccgatcagaaggtgcctgcctcctcctcgtcggcgaaaagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgcccaacattggttatggttctgacaagtcgaccaggcactacctccccagcaagttcaagaagtttgtggtccacaacgtttctgagctggagttgctcatgatgcacaacaggacctactgcgctgaaattgctcacaacgtgtccaccaagaagcgcaaggagatcgtggagcgtgctgcacagctcgacattgtggtcaccaacaagcttgctaggctccgcagccaggaggacgagtagtctggtttcttgtcttaacgacgaactggatgttgccattcctttctgtagggaactactttgcttgtgt

SEQ ID NO: 13146 - protein, 133 aa, Zea mays
  misc_feature: Ceres CLONE 1373354-F
  misc_feature (14)..(123): Pfam Name: Ribosomal_L32e Pfam Description: Ribosomal protein L32
MAVPLLTKKIVKKRVKQFKRPHLDRYKCLKPSWRRPKGIDSRVRRKFKGCTLMPNIGYGSDKSTRHYLPSKFKKFVVHNVSELELLMMHNRTYCAEIAHNVSTKKRKEIVERAAQLDIVVTNKLARLRSQEDE

SEQ ID NO: 13147 - DNA, 667 bp, Zea mays
  misc_feature: Ceres CLONE 1373355-F
  misc_feature: Encodes the peptide sequence at SEQ ID NO. 13148
aaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgcccacctcggcgtccgcggctcctaagccggccgccctgagccgccgccgcgccgcaccgtcg

SEQ ID NO: 13148 - protein, 108 aa, Zea mays; identical to SEQ ID NO: 13037
  misc_feature: Ceres CLONE 1373355-F

SEQ ID NO: 13149 - DNA, 644 bp, Zea mays
  misc_feature: Ceres CLONE 1373366-F
  misc_feature: Encodes the peptide sequence at SEQ ID NO. 13150
  misc_feature (354)..(354): n is a, c, t, g, unknown, or other
  misc_feature (398)..(398): n is a, c, t, g, unknown, or other
  misc_feature (399)..(399): n is a, c, t, g, unknown, or other
  misc_feature (446)..(446): n is a, c, t, g, unknown, or other
  misc_feature (465)..(465): n is a, c, t, g, unknown, or other
  misc_feature (469)..(469): n is a, c, t, g, unknown, or other
  misc_feature (512)..(512): n is a, c, t, g, unknown, or other
aagctggagctccccgcggtggcggccgctctagaactagtggatcccccgggctgcaggaattcgcacgagaccattacctagaacatcctaatcgaaaactggtcctccattcaagctccactactccacacctagacttcccaatcctccattgggcaacctgtcacacagtacgccgtcgcctgtggtttggtttgtggagtgagagagaaagagagagagagacatagactcggactcggagagaaggagatgatgtcgagggagcgcaagaaggcggctgctcttcaggagaagctgaagatcctccgctccatcactcactcccacgctctgagcaacacgtcgatnatcatggacgcgtcggcgtacatcagggagctgaagcagaaggnntgtgagctgaacaggagattgcgtgcgcgcaggacgcgctgagacancaggcatcatcctatcccnacgntggacgtggaagcccctagagtgcaggggtcgtccgtcctggntgaacgtggtcctcgaacagagctgccccggggctgctcgtcgccctgctggaaggcctcccaagagctggggcttaggggtgttcaaggcaaccgggtcctggggcgaatccctttcgcctcgagggcggg

SEQ ID NO: 13150 - protein, 61 aa, Zea mays
  misc_feature: Ceres CLONE 1373366-F
  misc_feature (33)..(33): Xaa is any aa, unknown, or other
  misc_feature (48)..(48): Xaa is any aa, unknown, or other
MMSRERKKAAALQEKLKILRSITHSHALSNTSXIMDASAYIRELKQKXCELNRRLRARRTR

SEQ ID NO: 13151 - DNA, 656 bp, Zea mays
  misc_feature: Ceres CLONE 1373372-F
  misc_feature: Translation starting site: 181
  misc_feature (421)..(421): n is a, c, t, g, unknown, or other
  misc_feature (461)..(461): n is a, c, t, g, unknown, or other
  misc_feature (608)..(608): n is a, c, t, g, unknown, or other
  misc_feature (636)..(636): n is a, c, t, g, unknown, or other
tggagctccccgcggtggcggccgctctagaactagtggatcccccgggctgcaggaattcgcacgagaccattacctagaacatcctaatcgaaaactcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcacccggncttggggggcggccgccatcgcgctggcgtccatgggcgnccgggttcgtcacctccggcggcctcggcgtcgctgcgctgtccgtgttctcctggatgtacaagtacctgacgggcaagcacccgccgggcgccgaccagctggaccacgcccaggcgaggctggcgtccaaggccgcgacatcanggatgcagcacagcaccgcatcgaccangcgcaggggtcttgagagaa

SEQ ID NO: 13152 - DNA, 678 bp, Zea mays
  misc_feature: Ceres CLONE 1373376-F
  misc_feature: Encodes the peptide sequence at SEQ ID NO. 13153
  misc_feature (245)..(245): n is a, c, t, g, unknown, or other
  misc_feature (262)..(262): n is a, c, t, g, unknown, or other
  misc_feature (386)..(386): n is a, c, t, g, unknown, or other
  misc_feature (408)..(408): n is a, c, t, g, unknown, or other
  misc_feature (428)..(428): n is a, c, t, g, unknown, or other
  misc_feature (507)..(507): n is a, c, t, g, unknown, or other
  misc_feature (516)..(516): n is a, c, t, g, unknown, or other
tggagctccccgcggtggcggccgctctagaactagtggatcccccgggctgcaggaattcgcacgagaccattacctagaacatcctaatcgaaaatgcggtctgcctctgcccttaccgctacgctttcctcccggattccagcagcgaaacacgcgcggggcaaggacggagctggtaagccgatcgagccggcgagggtggacaagatgatgatggccgaggtggccgccaaccacagcanaaggagccacaacgacngctacttcagtgccaaagccgccgccgccgccgccgcgagcccagagggagtggggagcatgtccatgtcctcgaagaaagcgaggaatagcaacagcccgagaaccgcgcccgtatcgcccanggagaaaaggacaggatcggcnagagagtcccggcgctccancagttagtgtcgccgttcgggaagacgacccgcttccgttctgcaggaggggtcggggtacataggtgtctgaaccagnagctccggncctcagctcccctaaatggggggttcctcccggtggcggggcccggcctgaagataaccaaaataacccctccggaaccccgggtttgccctggggcccgggaaaccaaaattggattttacccaaaaaagggggcccactgggggggccgcgaaaaaaaaa

SEQ ID NO: 13153 - protein, 112 aa, Zea mays
  misc_feature: Ceres CLONE 1373376-F
  misc_feature (50)..(50): Xaa is any aa, unknown, or other
  misc_feature (56)..(56): Xaa is any aa, unknown, or other
  misc_feature (97)..(97): Xaa is any aa, unknown, or other
  misc_feature (111)..(111): Xaa is any aa, unknown, or other
MRSASALTATLSSRIPAAKHARGKDGAGKPIEPARVDKMMMAEVAANHSXRSHNDXYFSAKAAAAAAASPEGVGSMSMSSKKARNSNSPRTAPVSPXEKRTGSARESRRSXS

SEQ ID NO: 13154 - DNA, 667 bp, Zea mays
  misc_feature: Ceres CLONE 1373377-F
  misc_feature: Encodes the peptide sequence at SEQ ID NO. 13155
  misc_feature (371)..(371): n is a, c, t, g, unknown, or other
  misc_feature (379)..(379): n is a, c, t, g, unknown, or other
  misc_feature (414)..(414): n is a, c, t, g, unknown, or other
  misc_feature (425)..(425): n is a, c, t, g, unknown, or other
  misc_feature (440)..(440): n is a, c, t, g, unknown, or other
  misc_feature (453)..(453): n is a, c, t, g, unknown, or other
tggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagctaaaatattttgcctccttatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgntccctccnacatcatcagccctataacagcagttacctttggntgcattattgncacaaaacatcaggncacaaacactacnacaacttgtgctagcaaaccttgctgcctactctcagcaacagaagtttctttccattcaacccaactagctgcatggaactctgcttcttatttgccacaacaaacactaccatcaagcccggtttttcctggctacccccaggaattttttcccttcacccattgaaaggtttggaacttcccggttttttacgggggaaaaaaataaaact

SEQ ID NO: 13155 - protein, 80 aa, Zea mays
  misc_feature: Ceres CLONE 1373377-F
  misc_feature (73)..(73): Xaa is any aa, unknown, or other
MAAKIFCLLMLLGLSASAATATIFPQCSQAPIASLLPPYLSPTVSSVCENPILQPYRIQQAIAAGILPLSPLXPPTSSAL

SEQ ID NO: 13156 - DNA, 658 bp, Zea mays
  misc_feature: Ceres CLONE 1373380-F
  misc_feature: Encodes the peptide sequence at SEQ ID NO. 13157
  misc_feature (170)..(170): n is a, c, t, g, unknown, or other
  misc_feature (261)..(261): n is a, c, t, g, unknown, or other
  misc_feature (559)..(559): n is a, c, t, g, unknown, or other
  misc_feature (567)..(567): n is a, c, t, g, unknown, or other
  misc_feature (605)..(605): n is a, c, t, g, unknown, or other
  misc_feature (628)..(628): n is a, c, t, g, unknown, or other
tggagctccccgcggtggcggccgctctagaactagtggatcccccgggctgcaggaattcgcacgagaccattacctagaacatcctaatcgaaaactccccaactcgccgtctgccttctgcgcctccatttcggcctctgtcccttgcaagttcaatctcacctccnaccatgggtaaagagaagtcccacatcaacattgtggttattggccatgtcgactctggcaagtcgaccaccacaggacaccttatctacnagcttggaggcattgacaagcgtgtgatcgagaggtttgagaaggaggctgctgaaatgaataagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctccccagctgactgtgctgtccttatcattgactccacccactggtggttttgagggctgtatctccnaggatggncagacccgtgaacatgctctcctttgcgtcacccttgnagtgaagcagatgatttgctgcntgcacagatggatgcaccactcccaatact

SEQ ID NO: 13157 - protein, 123 aa, Zea mays
  misc_feature: Ceres CLONE 1373380-F
  misc_feature (5)..(124): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (30)..(30): Xaa is any aa, unknown, or other
MGKEKSHINIVVIGHVDSGKSTTTGHLIYXLGGIDKRVIERFEKEAAEMNKRSFKYAWVLDKLKAERERGITIDIALWKFETTKYYCTVIDAPGHRDFIKNMITGTSPADCAVLIIDSTHWWF

SEQ ID NO: 13158 - DNA, 664 bp, Zea mays
  misc_feature: Ceres CLONE 1373387-F
  misc_feature: Encodes the peptide sequence at SEQ ID NO. 13159
  misc_feature (170)..(170): n is a, c, t, g, unknown, or other
  misc_feature (261)..(261): n is a, c, t, g, unknown, or other
  misc_feature (279)..(279): n is a, c, t, g, unknown, or other
  misc_feature (307)..(307): n is a, c, t, g, unknown, or other
  misc_feature (308)..(308): n is a, c, t, g, unknown, or other
  misc_feature (364)..(364): n is a, c, t, g, unknown, or other
tggagctccccgcggtggcggccgctctagaactagtggatcccccgggctgcaggaattcgcacgagaccattacctagaacatcctaatcgaaaactccccaactcgccgtctgccttctgcgcctccatttcggcctctgtcccttgcaagttcaatctcacctccnaccatgggtaaagagaagtcccacatcaacattgtggttattggccatgtcgactctggcaagtcgaccaccacaggacaccttatctacnagcttggaggcattgacnagcgtgtgatcgagaggtttgagaaagnnagctgctgaatgaataagcggtcctttcagtacgcgtgggtgctcgacaagctcanggctgagcgtgagagagtatcaccatggatttggctctggtgaagttggagaccccaaggtactactgcccggtcattgatgcccctgaacacggggattcatcaggaacatgatccctgtaccctcccagtggaatgggctgccttaacattgaccccccatggggggttttgagggtggattccccgggatggccaacccgggaaattttttcccttggtttcacccttggagagaaaaaaaaatttttctggtccaaccaagtgtgtggcccccccccccaaaatccccgggggggt

SEQ ID NO: 13159 - protein, 47 aa, Zea mays
  misc_feature: Ceres CLONE 1373387-F
  misc_feature (30)..(30): Xaa is any aa, unknown, or other
  misc_feature (36)..(36): Xaa is any aa, unknown, or other
  misc_feature (45)..(45): Xaa is any aa, unknown, or other
MGKEKSHINIVVIGHVDSGKSTTTGHLIYXLGGIDXRVIERFEKXSC

SEQ ID NO: 13160 - DNA, 653 bp, Zea mays
  misc_feature: Ceres CLONE 1373388-F
  misc_feature: Encodes the peptide sequence at SEQ ID NO. 13161
  misc_feature (540)..(540): n is a, c, t, g, unknown, or other
  misc_feature (653)..(653): n is a, c, t, g, unknown, or other
caaagctggagctccccgcggtggcggccgctctagtactagtggatcccccgggctgcaggaattcgcacgagaccattacctagaacatcctaatcgaaaaaagatccaccaccccaccaaccaactactctcacagtctcacctcccgctcctgccccctccctctcgttctcttcctaaatggcggccgagtccgccaggccgccctcgccgccgcgcgactccggctgccccgcgggcgcgggagactccaccagctcccagctgaccgcgacctacctcggcgtcagcttcgcgctcttcctcgccacgctcccgtcgggcaccgcggcgcgccacgtggcctcgctccagtcgcggggccgcctcctcgcctcgcgcctgctggccgccgaggaccagctgcggcagctgcgcgcgcgccgccgcgaggactcccgcgccaacgcccgcgcccgcgagatcttcgcgggccaccgcgccgcctggatggaggccgagcgccgcctgcaggaccgcgcccgccgcgccgaggangaagccgactccctccgcgcgcacctcgacgacgccgaaggcgacgccgctgctctgcgcgccccgcgcgagcgactcaagcgcgaggccgccgagcgggatgagctgctccn

SEQ ID NO: 13161 - protein, 156 aa, Zea mays
  misc_feature: Ceres CLONE 1373388-F
  misc_feature (119)..(119): Xaa is any aa, unknown, or other
MAAESARPPSPPRDSGCPAGAGDSTSSQLTATYLGVSFALFLATLPSGTAARHVASLQSRGRLLASRLLAAEDQLRQLRARRREDSRANARAREIFAGHRAAWMEAERRLQDRARRAEXEADSLRAHLDDAEGDAAALRAPRERLKREAAERDELL

SEQ ID NO: 13162 - DNA, 641 bp, Zea mays
  misc_feature: Ceres CLONE 1373396-F
  misc_feature: Translation starting site: 375
  misc_feature: SWISSPROT Homolog: EC 6.3.2.19 Ubiquitin--protein ligase
aaagctggagctccccgcggtggcggccgctctagaactagtggatcccccgggctgcaggaattcgcacgagaccattacctagaacatcctaatcgaaaaaaaagcggctctctcccccataaatatggcactctcctccggaggtgctaaagtactcgtcgttgccaaaaccctagccctgcttctttgccgtggcgagcgacgatagacaggtgagccacgtgctccagacatatgtcaaggatcttgagaacaaccccgcgaatgagttctccgccgagatcgaagacagaaataacatcttcgagaggtaggtcaccttcagcgaacagcatgacaccctataggatggaggctacttcaacggaataatgagcttcccccagaactatcccaactggccgtcatcattacgagttacttctgagaatgagttctccaaaggtcaaaccagatgcaccggggtgcatgtctattcttcctccacctactgaatattgctctgcttattagcctgcaagctggcgatggacaaccaagcacacggttgagactatagtgtctcgactgtcattacgatggtctgtacacccaaaggcgagtctccaccgaatatcggagctgccaagggagtggag

SEQ ID NO: 13163 - DNA, 670 bp, Zea mays
  misc_feature: Ceres CLONE 1373401-F
  misc_feature: Encodes the peptide sequence at SEQ ID NO. 13164
  misc_feature (383)..(383): n is a, c, t, g, unknown, or other
  misc_feature (410)..(410): n is a, c, t, g, unknown, or other
  misc_feature (422)..(422): n is a, c, t, g, unknown, or other
  misc_feature (423)..(423): n is a, c, t, g, unknown, or other
  misc_feature (456)..(456): n is a, c, t, g, unknown, or other
  misc_feature (457)..(457): n is a, c, t, g, unknown, or other
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcgaaaaaacaaaaaacctcggagctagcagcaagatcttagcacaaacaccacaccccacaggctgattaatcactccaagactaatcaaacgaacgcttagctaatagcgcgcgatctttttttcccctccccctcttgagcgtgcgagaagagatggcgctgaacggcggcaagacattggtgcaggacgaggagaagcagcagcttctcctagagaagcacaccgagaagcacttcaccgccggcgaggtggtccgggacatcatcatcggcgtctccgacggnctcaccgtgcccttcgcgctcgccgcngggctgtccggnngcaacgcctcctccgcgctcgtgctcaccgcgnngctcgccgaggtcgccgccggcgccatctccatggggctcggagggtacctggcggcgaagagcgaggctgaccactacaaccgggagctgcagcgcgagcaagacgagatcgacaccgtccccgacgtccaggcccgccgagatcgccgacatcctgtcgcagaacgggttggggcccggaggataacgccccgtgggtgacctccctcccn

SEQ ID NO: 13164 - protein, 135 aa, Zea mays
  misc_feature: Ceres CLONE 1373401-F
  misc_feature (58)..(58): Xaa is any aa, unknown, or other
  misc_feature (69)..(69): Xaa is any aa, unknown, or other
MALNGGKTLVQDEEKQQLLLEKHTEKHFTAGEVVRDIIIGVSDGLTVPFALAAGLSGXNASSALVLTAXLAEVAAGAISMGLGGYLAAKSEADHYNRELQREQDEIDTVPDVQARRDRRHPVAERVGARRITPRG

SEQ ID NO: 13165 - DNA, 603 bp, Zea mays
  misc_feature: Ceres CLONE 1373403-F
  misc_feature (547)..(547): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (582)..(582): n is a, c, t, g, unknown, or other
aaagctggagctccccgcggtggcggccgctctagaactagtggatcccccgggctgcaggaattcgcacgagaccattacctagaacatcctatcgaaaaagccacgcgcccacgcgccccaagttcacgccggacctgctcctctccgacggcggcatcggcttcgtgctccgctacttccccaaggcgttcaagccccgcgcccgcccaggccacgaggtggacgaccgacctcgccaacctcatcaagctctacgcggactggcactcccgcctgatcccctactactccttcgaacagttcgtgcgcaaagtcgagaaatcgggacgatggtgggcctctctgaaggggagaaacacttcatccgcggcggcattgcacaagaccttcgcactgatggacgtaggcggctgcagttcccgttccctctcccggtcaaaacccgggggtcttttcccacagggggaaagtggggttctcaccccgggtttttattatttgtgggggggccccccccccccaaaaaaaaaaaaccccccacccncnnncccgggcggggggcgggggggtgtttttttnaaaaaaccacaaaaatcccca

SEQ ID NO: 13166 - DNA, 626 bp, Zea mays
  misc_feature: Ceres CLONE 1373413-F
  misc_feature (425)..(425): n is a, c, t, g, unknown, or other
  misc_feature (440)..(440): n is a, c, t, g, unknown, or other
aaagctggagctcaccgcggtggcggccgctctagaactagtggatcccccgggctgcaggaattcgcacgagaccattacctagaacatcctaatcgaaaaacatattattgagaccaactagcaacatagaaagcacaatagtgtaccaacaatggcagccaaaatattttgcctccttatgctccttggtctttctgcaagtgctgctacggcgaccattttcccgcaatgctcgcaagcttctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattgncacaaaacatcaggncacaacaactacaacaacttgtgctagcaaacctttgctgctactctcagcaacagcagtttcttccattcaaccaactagctgcattgaactctgctttcttattgaaacacaaacactaccattcagccaggtacctgctgcctacccccagaattttctccattcaccaattggaagaattga

SEQ ID NO: 13167 - DNA, 607 bp, Zea mays
  misc_feature: Ceres CLONE 1373415-F
  misc_feature: Encodes the peptide sequence at SEQ ID NO. 13168
  misc_feature (194)..(194): n is a, c, t, g, unknown, or other
  misc_feature (245)..(245): n is a, c, t, g, unknown, or other
  misc_feature (267)..(267): n is a, c, t, g, unknown, or other
  misc_feature (293)..(293): n is a, c, t, g, unknown, or other
  misc_feature (328)..(328): n is a, c, t, g, unknown, or other
  misc_feature (341)..(341): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggntcggtggcggacgacgacacatggggaaaggtagtggtggtgcatcatggntgggcgtcctcctgctcgccgncgtgctgctggtcgtaacacccacgnccggggcggaagacggattggtcaaacggaacgcnaagaggactgcgngggggcaacaagcgttggcaatgcaataacgaaaagaaacccccgggaaaagggaatgcaaaagaatgcccccaagggaccccaaaaatttaaccgggaagaaacgggaaagggggggggaacccaaaactcccccctcccggaggggggaagggggggggccaaggtgttggccccccccaaggggcaccccggggaaaacccccaagggtttaggggggggcccccccccgggaaatgtggccccaaaatggaaaaaaaaaaac

SEQ ID NO: 13168 - protein, 51 aa, Zea mays
  misc_feature: Ceres CLONE 1373415-F
  misc_feature (11)..(11): Xaa is any aa, unknown, or other
  misc_feature (18)..(18): Xaa is any aa, unknown, or other
  misc_feature (27)..(27): Xaa is any aa, unknown, or other
  misc_feature (43)..(43): Xaa is any aa, unknown, or other
MGKGSGGASWXGVLLLAXVLLVVTPTXGAEDGLVKRNAKRTAXGQQALAMQ

SEQ ID NO: 13169 - DNA, 691 bp, Zea mays
  misc_feature: Ceres CLONE 1373421-F
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (626)..(626): n is a, c, t, g, unknown, or other
aagctggagctccccgcggtggcggccgctctagaatagtggatcccccgggctgcaggtaattcgcacgagaccattacctagaacatcctaatcgaaaaattcccataccatgagttctaggctgtctgaaatctcccttgttgtatcctgtttatctcctggcgtgagtctgtggcactagtgagatgccttctcgtagctcatggattacggttggccatccctaatcctgatctcacttaagcgctcgagagctctctccagcggctacagattgtcgatttgagttataggtccaacaaacgtgtgtcgttccgcccttggaggtgcagcccacaaaaaagggttgttggtgggttagggatctatccccccatggccaaaaagcccgccaggggacggttttcccggccgaccggggttccgcccccctttggcaacacggggcgctggggggaaaaactcgggaagggcaacccccaggtgtcccccccggattggaaatctcccgcccgcggaatgccggtttttccccccccaagggtggttgttcccccggggccctcccnnnnccacatagatagtgcaagtctgatccagtcatcccgtacannnnnnnnggnccccacaaatgcggtgaggtcggagtccaaaaaaaaaaaggccttctcaaaaaagaacatatttg

SEQ ID NO: 13170 - DNA, 560 bp, Zea mays
  misc_feature: Ceres CLONE 1373423-F
  misc_feature (19)..(19): n is a, c, t, g, unknown, or other
aaagctggagctccaccgncggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaaaggcgtggcaagaaatcgggaaaaaatagcaggggggctaattacctaactcccgggcccaaaaaaggcccgaaattggcaaaaaatggggggcccccccccggggccaccccccagggaaaaacccccccccctttcaagggggaacccaaccccctcttaggggggaccccccccccccggggggggcaaaaaagggaaaaattatttttggggggccccccccccgggcgggggggggggggggggggcaccccaaaggggggggggcacccccccc

SEQ ID NO: 13171 - DNA, 677 bp, Zea mays
  misc_feature: Ceres CLONE 1373428-F
  misc_feature: Encodes the peptide sequence at SEQ ID NO. 13172
  misc_feature (332)..(332): n is a, c, t, g, unknown, or other
  misc_feature (356)..(356): n is a, c, t, g, unknown, or other
  misc_feature (364)..(364): n is a, c, t, g, unknown, or other
  misc_feature (368)..(368): n is a, c, t, g, unknown, or other
  misc_feature (451)..(451): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (461)..(461): n is a, c, t, g, unknown, or other
tggagctcaccgcggtggcggccgctctagaactagtggatcccccgggctgcaggaattcgcacgagaccattacctagaacatcctaatcgaaaaaaccttgcaggaaaaaaaaagagacgaccccccaaatcggaatccgcacacccatcatccatggccgccgccctgctccgccgctcgccggcggcgcgcgcgctcctctcgccggcactctcgtcccgcctcgtcgcgtccaagccccactcctcgtcccccgcgccgccgccacctgcgaaggccgactccagcacgaagaccttctcgatctaccggtgggacccggactcgncgtcgacgaagccgcacctcaggnactaccangtgnaccctgtcgactgcgggccgatggtgctggacgcgctgctcaagaatcagaacgagcaggacccgtcgctcaccttcccgcgnannntgcggnagggcatctgcgggagctggcccatggaacatcgacggggaaaacggccttcgcttgcctcaccaaaaattcggggcccccttccggggccaagggtttccccgttcccccaaagtgtccgcccaaaggaccccgggggtgggaaatgaccaactttccacggcccaaaaaaaaaggtcaaaacttgggttcaaggaaaggacccccccccccaaa

SEQ ID NO: 13172 - protein, 150 aa, Zea mays
  misc_feature: Ceres CLONE 1373428-F
  misc_feature: SWISSPROT Homolog: EC 1.3.5.1 Succinate dehydrogenase (ubiquinone)
  misc_feature (59)..(59): Xaa is any aa, unknown, or other
  misc_feature (67)..(67): Xaa is any aa, unknown, or other
  misc_feature (69)..(69): Xaa is any aa, unknown, or other
  misc_feature (71)..(71): Xaa is any aa, unknown, or other
  misc_feature (99)..(99): Xaa is any aa, unknown, or other
  misc_feature (100)..(100): Xaa is any aa, unknown, or other
  misc_feature (102)..(102): Xaa is any aa, unknown, or other
MAAALLRRSPAARALLSPALSSRLVASKPHSSSPAPPPPAKADSSTKTFSIYRWDPDSXSTKPHLRXYXVXPVDCGPMVLDALLKNQNEQDPSLTFPRXXRXGICGSWPMEHRRGKRPSLASPKIRGPLPGPRVSPFPQSVRPKDPGGGK

SEQ ID NO: 13173 - DNA, 700 bp, Zea mays
  misc_feature: Ceres CLONE 1373429-F
  misc_feature: Encodes the peptide sequence at SEQ ID NO. 13174
aagctggagctccccgcggtggcggccgctctagaactagtggatcccccgggctgcaggaattcgcacgagaccattacctagaacatcctaatcgaaaaatcacattcccaaaccctccgtcgacccctcctcctcgatctacaccggcgatcggcggcgagtgatggggtgggcgacgcggttcctggcggcggtgtgcttctttgctgcgggtgtcctcttcgtcccggagctctccttggttccccctccggcgcaggcgccgtcaccgctgccaagctggcccacgtcctctcctttggcacttctgggggggcgccctctggggccactttatcgggggcatcttcatggtcaaaaacttgccgaggcacatgttccggaattttgcaaaaaaagaagttcccggcctatttacgtttatttttggcgtggggaccattttgggggggcaccttttcccaccttcccccggggaaaaaggggggcccccgggggggggtaaccgctttgtggttccccccaaaagggggggggggtgggaattccctccaaccggggttaactttccccccccttgggaattgggaagttggaaaaaaggaggcccaaatttgtgggggggccccctgattttgggggggggaaggggggggggggaaaaaaaaacccgggggggggtaaaaacccccccccc

SEQ ID NO: 13174 - protein, 113 aa, Zea mays
  misc_feature: Ceres CLONE 1373429-F
MGWATRFLAAVCFFAAGVLFVPELSLVPPPAQAPSPLPSWPTSSPLALLGGRPLGPLYRGHLHGQKLAEAHVPEFCKKRSSRPIYVYFWRGDHFGGAPFPTFPRGKRGAPGGG

SEQ ID NO: 13175 - DNA, 654 bp, Zea mays
  misc_feature: Ceres CLONE 1373435-F
  misc_feature: Encodes the peptide sequence at SEQ ID NO. 13176
  misc_feature (454)..(454): n is a, c, t, g, unknown, or other
  misc_feature (511)..(511): n is a, c, t, g, unknown, or other
  misc_feature (549)..(549): n is a, c, t, g, unknown, or other
  misc_feature (589)..(589): n is a, c, t, g, unknown, or other
  misc_feature (590)..(590): n is a, c, t, g, unknown, or other
aaagctggagctccccgcggtggcggccgctctagaactagtggatcccccgggctgcaggaattcgcacgagaccattacctagaacatcctaatcgaaaaaactctagtctctagccacaactcgaagtacgagtacctccggagtccggatggctgcagcgatggacgtcgacgaagccggcggcgaggagaggcgaccgtcggagaaggagctcttccgcgccgccgagtccggcgacgccgccgcgttcgcctccctcgcccccgccgacctctccctgcgcaacgaggacggccgctccctcctccacgtcgccgccgctgccggccatccccaggtggtgctcgcgcttgcccagtgcggtggtgacgccgcggctagcgtgctgaatgcgcaggacgaggaggggtgggcgccgatccactccgccgcgagctccggcaactctcnaatcgtcgacatcctgcttgagcgaggtgctgatgttaacctggttactgatggtgntcgaactgcccttcattatgctgcgagtaaagggagcntaacatagctgaaaactaatagcccatgggtgctatgtcnnacagaaagaaagtttggctgcacacctttgcatagagctgcagcactggaaacgcggagctgtg

SEQ ID NO: 13176 - protein, 134 aa, Zea mays
  misc_feature: Ceres CLONE 1373435-F
  misc_feature (86)..(118): Pfam Name: Ank Pfam Description: Ankyrin repeat
  misc_feature: SWISSPROT Homolog: EC 2.7.11.1 Non-specific serine/threonine protein kinase
  misc_feature (101)..(101): Xaa is any aa, unknown, or other
  misc_feature (120)..(120): Xaa is any aa, unknown, or other
  misc_feature (133)..(133): Xaa is any aa, unknown, or other
MAAAMDVDEAGGEERRPSEKELFRAAESGDAAAFASLAPADLSLRNEDGRSLLHVAAAAGHPQVVLALAQCGGDAAASVLNAQDEEGWAPIHSAASSGNSXIVDILLERGADVNLVTDGXRTALHYAASKGSXT

SEQ ID NO: 13177 - DNA, 460 bp, Zea mays
  misc_feature: Ceres CLONE 1373438-F
  misc_feature: Encodes the peptide sequence at SEQ ID NO. 13178
aagctggactccccgcggtggcggcgctctagaatagtggatcccccgggctgcaggaattcgcacgagaccattacctagaacatcctaatcgaaaaccccgccgccgaagccaccgtgccgctagccttccccgccgccgcaaaatggccgcctccgcgcgacccctggttaccgtgagggccctggagggcgacatgggcacggactccgccggtggttcggttgggggaagtcctccggggcaccgattccgcccgggaaatcgttcggtttcgtccaaaaagttccctggtccttggaaaaagccccccaaaacccaaatggggggggcccccgtcccccccccccaaaaacacaaaaaaaccccccccggaaaaacccctggggggaaaacaaagggggggggggggggggaaaaatccccaaaaaaccccccccccccggttgtttttttttg

SEQ ID NO: 13178 - protein, 104 aa, Zea mays
  misc_feature: Ceres CLONE 1373438-F
MAASARPLVTVRALEGDMGTDSAGGSVGGSPPGHRFRPGNRSVSSKKFPGPWKKPPKTQMGGAPVPPPQKHKKTPPGKTPGGKTKGGGGGEKSPKNPPPPVVFF

SEQ ID NO: 13179 - DNA, 699 bp, Zea mays
  misc_feature: Ceres CLONE 1373442-F
  misc_feature: Encodes the peptide sequence at SEQ ID NO. 13180
  misc_feature (519)..(519): n is a, c, t, g, unknown, or other
  misc_feature (574)..(574): n is a, c, t, g, unknown, or other
cgctctagaactagtggatcccccgggctgcaggaattcgcacgagaccattacctagaacatcctaatcgaaaaaagttgtttctcttctcttgctccgcaaaccagcgcaagcccttccctgacagcggcggcgacatggtgctcgaggcgacgatgatctgcatagacaactcggagtggatgcggaacggcgactacgccccgtcgcggttccaggcgcaggccgatgccgtcaacctcatatgcggtgccaagacccagtcgaacccggagaacacagtaggcgtgatgacgatggccgggaagggcgtccgcgtgcttgtcactcccaccagcgacctcgggaagattctcgcctgtatgcacgggttggaagttggtgctgaggcaaacttggctgcggcaatccaggttgctcagcttgcgctaaagcatcgccagaacaagaggcagcagcagaggattatagcatttcatcggaagtcctgtgaagtacgacaagaaaattttggagancaatcgggaagaagctgaaaaagaacaatgttgctctttgacattgtttgacttntggtgaatctgatgatgaaaagcctgagaaactggaagcatgtgatcgctgttgttaacagcagtgatagcagcccccattggtcatgtcccctccctggtgaaatggctcctctctgatgtctc

SEQ ID NO: 13180 - protein, 132 aa, Zea mays
  misc_feature: Ceres CLONE 1373442-F
  misc_feature (127)..(127): Xaa is any aa, unknown, or other
MVLEATMICIDNSEWMRNGDYAPSRFQAQADAVNLICGAKTQSNPENTVGVMTMAGKGVRVLVTPTSDLGKILACMHGLEVGAEANLAAAIQVAQLALKHRQNKRQQQRIIAFHRKSCEVRQENFGXQSGRS

SEQ ID NO: 13181 - DNA, 751 bp, Zea mays
  misc_feature: Ceres CLONE 1373444-F
  misc_feature (751)..(751): n is a, c, t, g, unknown, or other
cgcggtggcggccgctctagaactagtggatcccccgggctgcaggaattcgcacgagaccattacctagaacatcctaatcgaaaagaggtggagagatcgcacgcgccctctgccgcttgttcgttcctcgcgcttgccaccaggcaccaccacacacatcccaatctcgcgaggcggcgagggcaagcagcagggtctgcggcgtgattaacactaccgggactccagacccaagaagaaggcgaccacccctaataaacagcggcgaatatttgaaccgaaacagagcacgaagggcaactacctaaccccgtaaacaaactaaagggcgtgacactctcaatcggacgcccgggcacagtggggctcgacacaccatttaaaacactctcatccacacacaataagcactcaagatgaacaagttccacaccttgcgaaaaaacgaacccccgatatgccacggcaaggggcgcaatattacaacttaccagcagaggtgtccttccctgcccgcgagagcgaagtcccaagagagaccaatcccccaggacggtcaaacaagtatcgaagacgaggccgcccccttcacctaggtggttgtaacacccccttggcggaatgggccattcttgtggtgaaaaacccttttaccggaacaggaggatcacccctccaaaattgattaccccttgactccaattgagccccggtcgcggcctaacaccttcccggaaaggcactccan

SEQ ID NO: 13182 - DNA, 946 bp, Zea mays
  misc_feature: Ceres CLONE 1373458-F
cccccccctccccccccccccctcctctgcagagcgtccccctctcaacatctagctccccgctctgggggccgctctagaactagtggatcccccgggctgcaggaattcgcacgagaccattacctagaacatcctaatcgaaaaatcgatgagatcatccatggctagttctctacttcagcagctgctgtctctgctgctgctcctgatgtcctctcctcctcgtctccgggtagcatctatcaggaaaccatgctgtcagtgccaacaacttccaccccatctttctggcatctggggcgacctgcagctcactgcaggcacgcctcctcgatgcctatcgtgccacggtgtggcactgcccccccacgccgcgtttcccggtggaaccacctgttggaagaccggtgcgtcgctgctcgtcacctgtcttacctcggcctgctttcatggagtatcccccacgcaccgcgccccagcccttggcatacaatcgggaaccacgcatccgtcccccgggtgcttcatttattgaagtgcctcaccccttccctcttccccccctcatcttttgctgtctcctcaactcatccccttcatacaaataatagaagccccacgccactccctcaaactctcgcatactccccgctgcattggaacgtacacttgctactcttatctcacacccgtcgcgtggctaactatggctctccagagcccgcagctcccccccgactcctccttctaccgcaggccccctcgcgcgccctcccacctctcactgcgtctccccctcgaccggccgcgcgccctctgatattcgtgttctaggcgagagcttgcgccatagaacgctcctgtccacaccatggactgggagagaagtcttttcacgccgtccgctatcgtccgctttatggtctgcgtcctctccctcgct

SEQ ID NO: 13183 - DNA, 724 bp, Zea mays
  misc_feature: Ceres CLONE 1373460-F
  misc_feature: Encodes the peptide sequence at SEQ ID NO. 13184
  misc_feature (724)..(724): n is a, c, t, g, unknown, or other
tccccgcggtggcggccgctctataactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggcccccgggaggatgccacccgtattggttccgctggggttgtgagaaagcaggccgtggatatctcacccctgaagagggggaaccaggccatctaacctcctcacactggtggcaggggaaatgcctttccggaacatcaaaactttggccagaggccttgcaaaagaacttgatcaccgctggccaagggcttan

SEQ ID NO: 13184 - protein, 146 aa, Zea mays
  misc_feature: Ceres CLONE 1373460-F
  misc_feature (44)..(147): Pfam Name: Ribosomal_S7 Pfam Description: Ribosomal protein S7p/S5e
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATRIGSAGVVRKQAVDISPLKRGNQAI

SEQ ID NO: 13185 - DNA, 696 bp, Zea mays
  misc_feature: Ceres CLONE 1373461-F
  misc_feature: Encodes the peptide sequence at SEQ ID NO. 13186
  misc_feature (696)..(696): n is a, c, t, g, unknown, or other
ggcggccgctctagaactagtggatcccccgggctgcaggaattcgcacgagaccattacctagaacatcctaatcgaaaaacatattattgaaacccactagtaacatataaagcacaataatgcaacaccaatgtgaggcaaaatattttgactcctctagtgctccttggtcttctcgtgcaagggctgctacggcaaccattttcccacaatggtcacaagctcctatagattcccttcttccctcgtacctctcaccagcggtgtcttcggtatgtgaaaacccaattcttcaaccctacaggatccaacaggcaattgcagctggcatcttacctttatcacccttgttcctccaacaatcatcagccctattacagcagatacctttggtgcatttattggcacaaaacatcagggcacaacaactacaacaacttgtgctagcaaaccttgctgcctactctcagcaacatcagtttcttccattcaaccaactagctgcattgaactctgcttcttatttgcaacaacaacaactaccattcagccagctatctgctgcctacccccagcaatttcttccattcaaccaactgacagcattgaactctcctgcttatttacagcagcaacaactactaccattcagccagctagctggtgtgagccctgctaccttcttgacacaan

SEQ ID NO: 13186 - protein, 191 aa, Zea mays
  misc_feature: Ceres CLONE 1373461-F
MQHQCEAKYFDSSSAPWSSRARAATATIFPQWSQAPIDSLLPSYLSPAVSSVCENPILQPYRIQQAIAAGILPLSPLFLQQSSALLQQIPLVHLLAQNIRAQQLQQLVLANLAAYSQQHQFLPFNQLAALNSASYLQQQQLPFSQLSAAYPQQFLPFNQLTALNSPAYLQQQQLLPFSQLAGVSPATFLTQ

SEQ ID NO: 13187 - DNA, 701 bp, Zea mays
  misc_feature: Ceres CLONE 1373468-F
  misc_feature: Encodes the peptide sequence at SEQ ID NO. 13188
accattacctagaacatcctaatcgaaaatcctcccccctcacattcgtgagatcttcagctagcgctctctctggtctgcgtttgcatcagccttcctcagatcgagattctagccccagccccgctgcgagatccagatagctctctatcaagcattcggtgtagcgagtagccgtaggctcggtaagagagaagatgaagcggaagacgcggaacaagatcatcgtatggacgctggccctggctgccagaggcgatgtctggtggatggcacgattgcgctgggtgctgcacgtcgggcacgtggaaggccaagataaagaagtctcaggagaagatctgcaacaaggagttggtgagtgctcggggcagcacgtactgctgccaactaccccatcgaccgacttcttcaaggtgtaccagcttcgagaacctcttcgccaagcgcttcaccccacggtcgtgcaagccgtcctgtttatggggataaccattgcttcattcaccggcgcgggcctctttcgagcccaatggtttctgccccaccgggggtaacgcccatggctaataagggagctcttgcgccttcctacgggcaccccacctcctaaaactttatggtggataccattgtgggtttaccggcgcggccgcacggagaggcgttcccggtgcttaaatcggacagattggaccccc

SEQ ID NO: 13188 - protein, 119 aa, Zea mays
  misc_feature: Ceres CLONE 1373468-F
MKRKTRNKIIVWTLALAARGDVWWMARLRWVLHVGHVEGQDKEVSGEDLQQGVGECSGQHVLLPTTPSTDFFKVYQLREPLRQALHPTVVQAVLFMGITIASFTGAGLFRAQWFLPHRG

SEQ ID NO: 13189 - DNA, 719 bp, Zea mays
  misc_feature: Ceres CLONE 1373473-F
  misc_feature: Encodes the peptide sequence at SEQ ID NO. 13190
acccgcggtggcggccgctctataactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagaccccaggagttgcatgaggcggtgccgccgccgcggactgtccgtcgacatgtaacaagagtacggtcgcggcagcgagagcgcggtcaagttgccgggaagaggtgcgagcgccaccaccgcgttggaattgtcgggaagagcagcgcttgctgatggactgaaaaaaaccggaacgggaaatag

SEQ ID NO: 13190 - protein, 115 aa, Zea mays
  misc_feature: Ceres CLONE 1373473-F
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETPGVA

SEQ ID NO: 13191 - DNA, 748 bp, Zea mays
  misc_feature: Ceres CLONE 1373477-F
  misc_feature: Encodes the peptide sequence at SEQ ID NO. 13192
  misc_feature (421)..(421): n is a, c, t, g, unknown, or other
tccccgcggtggcggccgctctagaactagtggatcccccgggctgcaggaattcgcacgagaccattacccagaacatcctaatcgaaaacactgaaacgaaattaccctatagggatgagatttaaaatgaggtttgaaggtgaagaggctccagaacaaaggttcactgggaccattgttggaaatgtggatcctgatcaagctggatgggctgaatctaaatggcgttacctcaaggtgaggtgggatgaagcttcctccattccacgtcctgaaagggtttctccctggcaaatagaacctgcagtcagccctccccctatcaacccgcttccagtgcacagacccaagagaccgcgctctaatgctgtagcttctctgcccgagtcttcagctccaacaaaagaagctgctcccnaggtcacattagagacctcacaacatgccctgcaaaaggcctttgcgaaccaggaataatgtggccccgaaaagggtttttgggagaaaacggggaattggactcgggtcaaaagtccccccctgggaccgcagggttttgatttgggacaaaaacccattggaattgaaaagagaactggggttcaaaaatttttgatggcaaaagaacaggcccctgtggtttacaggggaaaatgttttcgggattacccccccccctagggaagggtgcggaaattccccggggttttttgtttttttaacagaaaaaaatggccgcgggagc

SEQ ID NO: 13192 - protein, 120 aa, Zea mays
  misc_feature: Ceres CLONE 1373477-F
  misc_feature (1)..(41): Pfam Name: Auxin_resp Pfam Description: Auxin response factor
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Functional homolog of the protein sequence given in SEQ ID NO 96873
  misc_feature: Useful for making plants with modulated seed size
  misc_feature: The sequence is a functional homolog of SEQ ID NO 298 in the 10/412,699 US patent application
  misc_feature: The sequence is a functional homolog of SEQ ID NO 300 in the 10/412,699 US patent application
  misc_feature (102)..(102): Xaa is any aa, unknown, or other
MRFKMRFEGEEAPEQRFTGTIVGNVDPDQAGWAESKWRYLKVRWDEASSIPRPERVSPWQIEPAVSPPPINPLPVHRPKRPRSNAVASLPESSAPTKEAAPXVTLETSQHALQKAFANQE

SEQ ID NO: 13193 - DNA, 834 bp, Zea mays
  misc_feature: Ceres CLONE 1373478-F
  misc_feature: Encodes the peptide sequence at SEQ ID NO. 13194
  misc_feature (568)..(568): n is a, c, t, g, unknown, or other
gctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcacggtgggcgttcctcctgctcgccggcgtgctgctggtcgtaccagccacggccggggcggaggacggagtgctcgaacgggaccgcaaggaggaccctgggtggtgcaagcaggcgtgcgagtgacagtacgggaaaggaccccccgcgcgaaaagggaatgccaagagccaatgcccgagccggcccccacaaagcctgcacgcgggcggaggaaccggcaaacagccgtcggtggaaccgccttaacgctctccccgcttccccgtaagaggggcgaagttgccccggcttcccaaagggcccggcgccccccccaccgggtgggcccacacccggcgggggaaaaacccccanaagggggcttgtgaacgcggggcgcccccccgcccgcggaacatgcggccggtccacaattgtgaacaaaaaaacacccggtccgccggctactcccaagaggaccggcacacatgtccccctataaacagggcccacccccctcccccccccgccgagactccggggggcaatacagcccccccgcctcccctgtggcgagacttccaaacaaccggcgtaacacggtctggagaagtgcgccaaaagcgggggctcctccccgg

SEQ ID NO: 13194 - protein, 50 aa, Zea mays
  misc_feature: Ceres CLONE 1373478-F
MGKGSVGASRWAFLLLAGVLLVVPATAGAEDGVLERDRKEDPGWCKQACE

SEQ ID NO: 13195 - DNA, 740 bp, Zea mays
  misc_feature: Ceres CLONE 1373483-F
  misc_feature: Encodes the peptide sequence at SEQ ID NO. 13196
ccccgcggtggcggccgctctagaactagtggatcccccgggctgcaggaattcgcacgagaccattacctagaacatcctaatcgaaaaatacatttcgactctcaactcccaaggtccctttttttttctcgatctggaagcgccgcagtagcagccatggacgtgagcggagcaggcggtaaggcgaagaagggcgcggcggggcgcaaggccggcgggccgacaaagaagtcggtgtcgcggtcctccagggccgggctgcagttccccgtcagccgcgtcgggcggaacctcaaaaagggccggtacgcgcagcgtgtaggcacgggtgcccccgtctacctcgccgcccgcctggagtacctcgcgggcgaggtgcttgagctcgccggaaacgcgccaaggtaccacaataagacccgcatcatcccgcgccacgtgctcctccccatccgcaacgaacacagaaattcggaagctgtttgcccgccgtcaacatccgccaacgggggcggccttccccgacatccaacactggggctcccctcccaaaaaagggggccgacaaaaggggcccacggaacccctggaaggccgctaaccccccccaagaaatggggaaacgggggccccctggcttttaaaacaattttccctttaccgaagcgggaaatttaaaccaaaatctgccttatggggaaaccccgcacaggcctttggccccggcccacctctgg

SEQ ID NO: 13196 - protein, 173 aa, Zea mays
  misc_feature: Ceres CLONE 1373483-F
  misc_feature (29)..(102): Pfam Name: Histone Pfam Description: Core histone H2A/H2B/H3/H4
MDVSGAGGKAKKGAAGRKAGGPTKKSVSRSSRAGLQFPVSRVGRNLKKGRYAQRVGTGAPVYLAARLEYLAGEVLELAGNAPRYHNKTRIIPRHVLLPIRNEHRNSEAVCPPSTSANGGGLPRHPTLGLPSQKRGPTKGAHGTPGRPLTPPKKWGNGGPLAFKTIFPLPKREI

SEQ ID NO: 13197 - DNA, 771 bp, Zea mays
  misc_feature: Ceres CLONE 1373484-F
  misc_feature: Translation starting site: 193
tggagctccccgcggtggcggccgctctagaactagtggatcccccgggctgcaggaattcgcacgagaccattacctagaacatcctaatcgaaaaatttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtcaggcggccatgcgctcgcgcttgcgcttgggccccctcgcagcgaccgcagcaaggggcactcgtcagcctcaagccttgcgcctcactggcaccacaagctcccccccccccccggcggagttccgattcctctgtcttttgggcccccccccccgcttatcatctgtgtcctcccatcctggattaagccttcaattattttcccgtccccacaggcttctagcctctcctccgcacgtaatttccttctcacctctcccctctttttacccgtggctaccaaactcccacccctactcatcctttctatacacaccttgtgcccttcccctcccctactgttccgttttcgctccccgtgcgcgtatggactcgccctcctcgttatgtatatcctccgcttgcacaactcgccgcacccccagtcctcacgtgcagtcgtgactagaccacgcgtaccgctatagtctcgggctttgcgtttatgggtcttcggttcgtgttg

SEQ ID NO: 13198 - DNA, 715 bp, Zea mays
  misc_feature: Ceres CLONE 1373487-F
  misc_feature: Encodes the peptide sequence at SEQ ID NO. 13199
  misc_feature (318)..(318): n is a, c, t, g, unknown, or other
tggcggccgctctagaactagtggatcccccgggctgcaggaattcgcacgagaccattacctagaacatcataatcgaaaactttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcngggcgctactccaagaagcggttccgcaaggcgcagtgcccgatcgttgagcgccttacaaactccctcatgatgcacgggcgcaacaacggcaagaaggtcatggctgtccgcatcatccagcaataccctgaagatcattcacctgctccacgatgccaaaccccatccaggtcggcgtcaacgcgatcatcaacgggggccccgggggggatgccaccccaatgggttcccctgggtgttggaaaaggaaggcccggggaattccccccccgggggaggggaaaaaggggattttacccccccaccctgggggccaaggaaaaggtttttccggaaaacaaaaaactttcccagagcctttaaaaaaaatagaaaaccgcgccaagggcccccc

SEQ ID NO: 13199 - protein, 169 aa, Zea mays
  misc_feature: Ceres CLONE 1373487-F
  misc_feature (44)..(142): Pfam Name: Ribosomal_S7 Pfam Description: Ribosomal protein S7p/S5e
MAEVEQQQDTPKLFNRWTFDDVQVNDISLNDYLAVNATKHAMYLPHTAGRYSKKRFRKAQCPIVERLTNSLMMHGRNNGKKVMAVRIIQQYPEDHSPAPRCQTPSRSASTRSSTGAPGGMPPQWVPLGVGKGRPGEFPPRGRGKRGFYPPTLGAKEKVFPENKKLSQSL

SEQ ID NO: 13200 - DNA, 719 bp, Zea mays
  misc_feature: Ceres CLONE 1373489-F
  misc_feature: Encodes the peptide sequence at SEQ ID NO. 13201
tcttaactagtggatcccccgggctgcaggaattcgcacgagaccattacctagaacatcctaatcgaaaaatatccactattctctaggaagcaaggtaatcacatcgacatgggagccaacatgattgcattgtttgcgctcctaactctttgtgcaaccgccactagtgtgagccggatcccaaggcacttgtcaccactactgatgacattggctaccatgaacccatggatgcactactgcatgaaccaacaggtgtgtggcaacttgctacctgtgccaagcctgatggtgcaggaactgttgatctcaccgcttcgaccgtgccagatgccaatgatgatgccgggtatgatgccaccgagtgactatgatgccgatgccaaatatgatggcgtcgatgatctggccgactatgatgtcaccaataacgagtggctaggatgatgacggcgatgatcatgccaaacatggtttcgccactgatgagtggcggagtatgatgccttccacgtattacgccgagtatgatgcccccgagcatgatgccgagtatgataccaccgatgatgatggcgagcaatggtgtcgtcaatgataaaggccaaaatgatgacaatggccacaatggtactcttaagtccatcccgccaattatacaaggtccaccatttaccatttctgggggaggcccccggcccggggcgtacttcgcc

SEQ ID NO: 13201 - protein, 112 aa, Zea mays
  misc_feature: Ceres CLONE 1373489-F
MGANMIALFALLTLCATATSVSRIPRHLSPLLMTLATMNPWMHYCMNQQVCGNLLPVPSLMVQELLISPLRPCQMPMMMPGMMPPSDYDADAKYDGVDDLADYDVTNNEWLG

SEQ ID NO: 13202 - DNA, 731 bp, Zea mays
  misc_feature: Ceres CLONE 1373491-F
  misc_feature: Translation starting site: 432
ccccgcggtggcggccgctctagaactagtggatcccccgggctgcaggaattcgcacgagaccattacctagaacatcataatcgaaaactctcctagagtttcgacacttccagccgccgacgcggccgcctcgccaagcgcagaaaccgccgcaacgcactcgctctattgatctcatccatgacggacgtggagcagcaacaggacacgccgaagctcttcaaccgcctgcaacgtccatgatgtccaagagaacgacatctcgctgaatgactaccacgctgtaaacgcgacgaatcacgcgatgtacctgccgcacaccgcggggagctactccaagaagcggctccgaaaggagcactgcccgatcggtgagcgccttacaaactccctcaagatgcacggcagcaacaacgacaagaacagtcatggctgtccgcatcatcaagcatacgctgcagatcattcacctgctcaccgaggccaaccccatccacgactgcgtcgacgcgatcatcaaccgtgtcccccgcgaggatagcccccagattggtgccgatggggttgagaaaaaggaagccgtggataatctacccctgaggagtcgcacccagaacaactacctcctcaccaacgaggtccaggcaaagaggtcccccggaataattaaacccttgacaaaaggacttggcagatagagccggatcgactgctgcaaaagggttctt

SEQ ID NO: 13203 - DNA, 733 bp, Zea mays
  misc_feature: Ceres CLONE 1373492-F
cgcggtggcggccgctctagaactagtggatcccccgggctgcaggaattcgcacgagaccattacctagaacatcctaatcgaaaaatccgtctctgtcgctcttatctactacactatactctaggaagcagggacaccaccgccctggcttccaagatgcttgcatagatccctctacaacatatttgcctgcacgcctctagtgcaaaccatattccaggcctgttgaccccgtgctcgccgttgggtaccctgaccactagtttggcatcccccatgatgaacccgtgaccggccttattgatggctcgaccgtacgtgatgatgctccaccagtatggacttaccgcttgaaactgagccgaggatgctgcacagataatctagtatgagtgcctacctggttccttcatgtcgatgctagacgacacctcgggcttgccgagcccctaggctaggtgaagatgccccaatgaacgccgtaagccgtgtcggaaatcatactgccacgatcacacaccattccttgtctgacccacctgcgcatgacgacatgcaccgctgctgcataaccgaaccccctaggttgccgggggcctttctacattcccataaagccggcgtcgggatcggacccaacaaggtttgccttgccccccagggggtgtgtggtccctctcgtttaccggcctagggaacccggctatccgacgcaaaaacacccgcgggg

SEQ ID NO: 13204 - DNA, 1026 bp, Zea mays
  misc_feature: Ceres CLONE 1373492-R
gggtacggggccccccctcgaggtcgacggtatcgataagcttttttttttttttttttctttttttttttaaaaagattataagaggaaacttgttttattgttaataatgagtcacacgcgatatcatgtcaactcatttttcaatacaacaaaaatatttctatctataatgcagcacctacaaagggttgctgtaagaacatgggtggaatcgtcatggccattgggttgaacatgaatggtaactgctgttgcaaaataatctgggagacggcgtctcagtgacattgtggcatcatcatttgccacatcttgctcggcaagaccattggtgacaacatgctcgggatcattaatgggtgacatcatgttaggggtcatcatctgtgggattatagggtgcccccatctgaaggtggaaaggtcaacatttgcttgcagggataagggaaagagacccccccctccaagctggctaagccccccgttgccattaaagcatctaactgcttcgcattgggatttctttggtaacccctattgggtacggacttggttgtgagagggggcccttggaaatataagggttgcgtaattagttggcccgcctttgcaccacataaaaccttaggggtaaaggggaaaatatatgtgaagccatttctttgggccttcccaatagtggcggtgggagcttgctcccttcggactttgctctaggagatgtgtaaggggatgagggtaggaagtgtggtaatgggcaacttgaaaggtcacaaagttttgtatgcgaaattccgggcagtggtctccttaaggcgatctatggtataccatgcccctcctaaacagtctcatgtaatggatcgccgtgtgaggaatatttctttctatatattctttaagaatggtaaatatctcattatggaaattgtcgtcgctcgatcacccatagagaactttgtgagtgtgggccctagtacgtcggagaggggggactgtagtgagtgggctgcgccgtgg

SEQ ID NO: 13205 - DNA, 733 bp, Zea mays
  misc_feature: Ceres CLONE 1373493-F
gctctataactagtggatcccccgggctgcaggaattcgcacgagaccattacctagaacatcctaatcgaaaaaattttctgaatcttgggcgagatctcgggtcgcctccgtccatctctatggcgccacggagccaccagctggtggaggtgggcctcctcgcctctgattcgtaggacctcggaggcgcaggcgcgcgggagagagagaagaaggtgtgatactttctcgcaggaaagactgaatggacaagaccgcctggatctacttactggtacggcctgattgatggaggctgtgctgacgccttagaacctctcgtcgggaagattcaggaatgaacaacatggaggggaggatggctgaggagccttgggctgaacacacatcccgtctggcgccggggggcgccaccggccacagggggcggaacggtttcaccttgggatggcgtgaacggcaagaggccgaggggaccggttatgtccccggctacgtggaggaccctaggggaccccgggggaaccccctagggtcgcagagctcgtgcccacgtccggagcggacaaatctcgggggggaatgggcaaggccaacccgaaataatgcaccgggggtcggagactcaaaacagggggcgtgcgcgtgggaaggaaggggtgcgcgggacaatacggggaagaacagggagatcaccccccgccggacggggggaaggagtgccgtgaga

SEQ ID NO: 13206 - DNA, 858 bp, Zea mays
  misc_feature: Ceres CLONE 1373498-F
ggagctcaccgcggtggcggccgctctagaactagtggatcccccgggctgcaggaattcgcacgagaccattacctagaacatcctaatcgaaaagcatcacacactcgactctcctctctcgcatccgcagcctttcgagctctactccaccccctcgatctcgaagcgcagcagcagcagtcagggggccatggacgccgagcgcagccggaggccggcgggaaggcaaagaacggcgcggccggccgcaaggccgccgcgcccaggaacaagtctgggaccacgtcccgtaagggccggcgtgaagtttccggtcggccgcatcgggcgggaacctgaaaaaagggcccggaaccccaagggcggtcaggaccggggcgccccccatcatacctgagccccccgtcctcaaaggcccccccgcccccggaacgtgcttggaaccttggccggcaaacccggcgcctgggcacaagcgaaaaaggccccgcttgtctcgccccgccgcatgcgtgtctccctttggccaaatcccggagatgtaacgagggagcccccgcgctcaggcctagtttggccacggcgctccccccggacgcgcccccacgacggcgcctattcaccgccaagacagaaaacccggggttggcgtacaagccgccaccaaaaatcgtacctcaccaaggggcgccggccgccagggggcggcacccatccccgcccacagaaaggaaccgcataacagatctcaccaacaagaacgagcagacggagacgcggtgaacgacgaaaacgcgggaggcccgatgtcaggatagcgccccctcccgtcagacccagcgctttgcgcccccc

SEQ ID NO: 13207 - DNA, 907 bp, Zea mays
  misc_feature: Ceres CLONE 1373507-F
cccccccccctccccctcccctccccggcgccccaacccacccccaaactggtactccaccgcggtggcggccgctctagaactagtggatcccccgggctgcaggagttcgcacgagaccattacctagaacatcctaatcgaaaaaccgctgctccacacgggcacacctttgcctcgcccaaccgctgcctcgctcgcgtccgccattccccagacctcgagagctaccgcctggcccgatcggacggaccccttcacgcgccccagagatttcagggacggtgctgcaccaaaacatgccagaggcaagaggtgggcacgcagagcttattcggttccgggcacccttctggtggttccggtggccttggtacaaccacgagagcctcacggcctgcgtttttttgggggcggagacgccccttgcacgacccttttctttccaacagccccgtctgggacgccaggccacccacagtaacctctctcccacccccccgtttcagccggcccacggaacgcccacccacagcgtatgcatgggaacccccctttcgcgcccatcgccacgacgacaaacctcaagccttctctctagggaccctcagatacactcggttcgcgcggccccccccggggcacttctctccccccggcgtagcccgctgccttcgcacaacaccctactacacccgctcgtccaggtgccaccggggcatccaatacccacagcggtcaaccgcgcttctccctttgtccggcccacgggcgcccccccgccgaacaccatcgcgcgttgtgaacgagaaaccgggtcctactactcccccgaccccgtaatcccgcgcccccgacgtcgtagacgcaaagtgatctacccgctcccgtcgcggccatccgccgg

SEQ ID NO: 13208 - DNA, 961 bp, Zea mays
  misc_feature: Ceres CLONE 1373514-F
ttcccccccccccccatcccccgcccctctccccactccacccccccaaactgggactccccgcggtggcggccgctctagaactagtggatcccccgggctgcaggaaggcgcacgagaccattacctacaacatcctaatcgaaaagagactcctcgcaaccgccggccgactcgagcagcgccccagcagcctctgctccgctgcctctggcgacgcccggacccgatcccgccgattcggcaacatctcgctcgatccaaggacgcgagtaccagacgatgagctcccccccccccgaggtacaccgtgcacccgctccgccactacgccctcagccccccggagccccacgagggacaaggactcctccggtttcctaccgcctccccccgcatgaaggtcacgtaacgtgaatagacggccccgccccacaaacggcgcgcacccgacgccctaggtggatggccaagcgtacccacccactcccccgcaacaacacgaccccatgggctgaatctggctaagacactgatcgtccgcgcgcgaactttgtcctggcgcggcacgcgttccaaaagcaccctggcaccaacacagcgcaaacctgatgccgatctactccgagtcaccgcacaagctctaggcgcgccgcccccccaccgcttgatggctgtccatactccaccgctcttatatctcatgaactactaccgccaagacttgcagccaaacatgtaaacgaccgtacgcgatcgcctgctgccgcccgggctagcagaccgcccgacaaccccggcggccaggctggccttgtacctatcgcggcgctcccgcgcccccctccgccacttggggacctctcgcgtccctctcggtgagccccgaggtgtagcagcccagtacaccacgtgctcccctcctgtatacgggaacgaccgccggtcctcgctcagcgcg

SEQ ID NO: 13209 - DNA, 685 bp, Zea mays
  misc_feature: Ceres CLONE 1373523-F
  misc_feature: Encodes the peptide sequence at SEQ ID NO. 13210
  misc_feature (451)..(451): n is a, c, t, g, unknown, or other
  misc_feature (476)..(476): n is a, c, t, g, unknown, or other
  misc_feature (483)..(483): n is a, c, t, g, unknown, or other
aaagctggagctccccgcggtggcggccgctctagaactagtggatcccccgggctgcaggaattcgcacgagaccattacctagaacatcctaatcgaaaaaggattttgtttcgggtgaggtggggggcggcatggcgccacccgccgctcaggctcagctcctcctctccaaccacccctcgccgttgctgtcgccgccgcaacgtcgtcgcctcctcggtggaccgccgcctcgctcacacacctgcgccatccggcaccaccacggccacgacaagtgcgcctcctcctcctccactcgccttcgccacgccctccgcccgcccgccgccaccgccgtggccatcgcgcccggcgaccactggggaaactgggccttcctcctctccgccgccgcgttcggaacatggggcgaggagaacacgtcgtggggcgccgcgctcagcgncgcgctggttagcatcatggccggnctggctngcacgggcgtcggcctcgtcacccccgggggcgccgcgcacgacgccgtcatggagtacctgctggcgggccgccgtcccgctggtactcctcggggccgacctccggcggggtgttcggacaacgggggacctcctaagggaattcctgctggaatctgttgcacatgaactcggccaacgggggcctatcggttgaaccc

SEQ ID NO: 13210 - protein, 172 aa, Zea mays
  misc_feature: Ceres CLONE 1373523-F
  misc_feature (106)..(106): Xaa is any aa, unknown, or other
  misc_feature (117)..(117): Xaa is any aa, unknown, or other
MAPPAAQAQLLLSNHPSPLLSPPQRRRLLGGPPPRSHTCAIRHHHGHDKCASSSSTRLRHALRPPAATAVAIAPGDHWGNWAFLLSAAAFGTWGEENTSWGAALSXALVSIMAGLAXTGVGLVTPGGAAHDAVMEYLLAGRRPAGTPRGRPPAGCSDNGGPPKGIPAGICCT

SEQ ID NO: 13211 - DNA, 674 bp, Zea mays
  misc_feature: Ceres CLONE 1373524-F
  misc_feature: Translation starting site: 297
  misc_feature: SWISSPROT Homolog: EC 1.14.99.33 Delta(12)-fatty acid dehydrogenase
  misc_feature (492)..(492): n is a, c, t, g, unknown, or other
  misc_feature (516)..(516): n is a, c, t, g, unknown, or other
  misc_feature (537)..(537): n is a, c, t, g, unknown, or other
  misc_feature (550)..(550): n is a, c, t, g, unknown, or other
  misc_feature (674)..(674): n is a, c, t, g, unknown, or other
aaagctggagctccccgcggtggcggccgctctagaactagtggatcccccgggctgcaggaattcgcacgagaccattacctagaacatcctaatcgaaaaggaaccgaggcggtcaggctccctcctccttcctcctccctgcaaatcctgcaggcaccaccgctcgttttcctgtccgggggacaggagagaaggggagagaccgagagagggtgaggcgcggcgtccgcccgatctgctccgccccccgaagcagcctgtcacgtcgtcctcactctcagcaaccagcgaaaatgggtgccggaggcaggatgaccgagaaggagcgggagaagcatgagcaggagcaggtcgcccgtgctaccggcggtggcgcggcagtgcagcggtcgccggtggagagccgccgttcacgttggggcagatcaagaaggcgatcccgccgcactgcttcgagcgctccgtgctgaggtccttctcgtacgtggnccacgacctgtcgctcgccgcggngctcctctacctcgcggtggnccgtgataccggngctaccctggccgctccgctacgcggcctggccgctgtactgggtggcccaggggtgcgtgggcaccggcgtggtgggtgatcgcgcacgagtgcgggcaccaagccttctccgaccacgggtn

SEQ ID NO: 13212 - DNA, 838 bp, Zea mays
  misc_feature: Ceres CLONE 1373525-F
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
ccccacccatccccctcaccttcccacannncncggggcctgcccagagctggagctccaccgcggtggcggccgctctagaactagtggatcccccgggctgcaggaattcgcacgagaccattacctagaacatcctaatcgaaaaactactccgtcgctttgtttgaaaagctcctcctcgatccatcgatcactgcaccggccgacggaaccgcgctcgcaggtgctagccaaccacacggtagcaatggcggaccgtgaccgcagcggcatctacagcggcgcccacgccaccctacgggcagcagcagcagcaggcaggaggcgggcgcccgatgggtggagcagcggaagggcatgctccacgacaaggggccgaccggcgccgcaaggccttgaacggtggcggaccttgtttcccgctgggggggctggtgcctgggctgtcggggcttggcccctaaaccccctcccggggtgggggttgggcccggggcccccgcccggtgttcctgaatttttccccccccgtgttgggtctcccaccggagctgtgcatttcgggcgaccggggcgctattggggggttccccctacgcttatggggggcactagggcgccccaggggggtccgggcacccggaacacaaggggccccggccaaacaaagggggcgcggggggggttttcgacgccccccccccggccatacacggtgggtgagaggccccccccccccaaaactggggtgaggaccccgatcctacacccggctccccttaaaaaccccccggggggacgaccgacctcccacgggagggaggcgcgcccaaaa

SEQ ID NO: 13213 - DNA, 652 bp, Zea mays
  misc_feature: Ceres CLONE 1373526-F
  misc_feature: Translation starting site: 188
  misc_feature (303)..(303): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (339)..(339): n is a, c, t, g, unknown, or other
  misc_feature (357)..(357): n is a, c, t, g, unknown, or other
  misc_feature (358)..(358): n is a, c, t, g, unknown, or other
  misc_feature (399)..(399): n is a, c, t, g, unknown, or other
  misc_feature (401)..(401): n is a, c, t, g, unknown, or other
  misc_feature (402)..(402): n is a, c, t, g, unknown, or other
  misc_feature (450)..(450): n is a, c, t, g, unknown, or other
  misc_feature (503)..(503): n is a, c, t, g, unknown, or other
aaagctggagctccccgcggtggcggccgctctagaactagtggatcccccgggctgcaggaattcgcacgagaccattacctagaacatcctaatcgaaaattcccttctgtcgctgctcccacctctagcccgacaggtgaagccgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattanccaagacannnaacagtacatacaccaaatacagantttgtgtgcgatttaccnnacaggacatcacagcacaaatcatctctgctagtatagcangnngatatggtcttgcttctgcttactcgcatgaggtgccacgatatgggncttgaagttggtctgaccaactatgcagctggctactgcactggccttctggntggctcggcgggtgctcaagaccgggtggttaaataaagaattggagggccatgttgaggcccttggtgaggactttccctgttgacccaactgataaaagaggcctttcccggctcccttgaatgtgggccttattagactacaatgg

SEQ ID NO: 13214 - DNA, 579 bp, Zea mays
  misc_feature: Ceres CLONE 1373527-F
  misc_feature (218)..(218): n is a, c, t, g, unknown, or other
  misc_feature (222)..(222): n is a, c, t, g, unknown, or other
atagctggagctccccgcggtggcggccgctctagaactagtggatcccccgggctgcaggaattcgcacgagaccattacctagaacatcctaatcgaaaaatcacaattcacagcgctcaagttctcgcgcccacagccaaatttttctccactcaatcgcggcataagctgcactgcagccatggacgccagcggagcccggtagcaaggcgaanaaangggcggtgggcgcaaggctgcggcccagaaagagtcggtgtcgcggtcgtcaaggcgggctgcagttccccgtcgggcggatcgggcgctacctcagaaagggcggaacccccagggggtggggaacgggggccccccggttattttcggcgccgggggttttgggaaccccccccccccgcaaaagtggttggaaaacttgggcccggaaaaaaccggggcaaaaaaaaacaaaaaaaaaaaaaaaagggggaaaattttcccccccgaaaaaattttttttcccccccgggggaatttctaaaaaaaaaacttttttgaaaccccccccaaaaagaagtgggtttgttttggggg

SEQ ID NO: 13215 - DNA, 567 bp, Zea mays
  misc_feature: Ceres CLONE 1373529-F
  misc_feature (274)..(274): n is a, c, t, g, unknown, or other
  misc_feature (275)..(275): n is a, c, t, g, unknown, or other
  misc_feature (363)..(363): n is a, c, t, g, unknown, or other
  misc_feature (379)..(379): n is a, c, t, g, unknown, or other
agagctggagctccccgcggtggcggccgctctagaactagtggatcccccgggctgcaggaattcgcacgagaccattacctagaacatcctaatcgaaaaactaccagtccaccaccaccactgctaccatcggttccccaaaccctagccaagggacacggtggccagcgatggacggcgacagagaaggcgctgcggcggtgcaccaccacgcgcgctccccccgaggacgtcttcccgcgattttccggcgcggggcccggggcccggnnattggttcaagggcccctccccccccggggtgggggggggaaaaaaatttctctttctccgagggggtgggggggggccccccccccnggagaaaaaaaaaaanacaaaaaccggggccctttttttgtttccccaaaaaaaaatttttggagggtctccttccgggggggggggagaaacccctctttgtttttttaaaaaaaaacagggggggggaaaaaatatttcgcgccccggggggggggggggggaaaaaaaaaaagggggggtggtcttctcccaaaaaagaga

SEQ ID NO: 13216 - DNA, 730 bp, Zea mays
  misc_feature: Ceres CLONE 1373546-F
gctggagctccccgcggtggcggccgctctagaactagtggatcccccgggctgcaggaattcgcacgagaccattacctagaacatcctaatcgaaaaacacatattattgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctggttgttatttacaacaagcaccagctaccaccattccgccagctagctgaatggagccccgttgccttcttgaaccaacaaaaggttgttgcccgtcta

SEQ ID NO: 13217 - DNA, 687 bp, Zea mays
  misc_feature: Ceres CLONE 1373548-F
  misc_feature (518)..(518): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
agagctggagctccccgcggtggcggccgctctagaactagtggatcccccgggctgcaggaattcgcacgagaccattacctagaacatcctaatcgaaaaatcttatcattccgccgccaatggtggcgccgcaacccaacccgcatcgaggtcacctcctccgaccgcgacgagctcgaagaccacctccgcggcggcgcggtgagctccaccaaggatccttccgggtacaccactccgtctcccgtccctggggccgcagaactcccatcccctgcttccatttcctccccccccaaagaccgggggccggggcattcaagtgccaaaggcttggggatggggcttttccaaccccggcgggtcccgccccccaaaaccccggaaaaccccccttcccccccccccgggggggtgggaaaaaaaaaccccccccctcccccgaagcctctcccccgcgaaaacaaacggcgtgtgtgcacggttttttttcgggggaaacgaccgccggccgnaaaaannnnngaggggggagcccctttttttacaaaacccccccccgcccccctttaaaaaagccaccccaccccgggttttcctctccgccccgggtgaaaaaaaatcccggagggacaggggggaattctcctcgggggggggggggaaggcggggggggggggggg

SEQ ID NO: 13218 - DNA, 691 bp, Zea mays
  misc_feature: Ceres CLONE 1373550-F
  misc_feature: Encodes the peptide sequence at SEQ ID NO. 13219
acttacctagaacatcctaatcgaaaattcgggatcgggacgcggagaggggaaaggcgagtcgtcgactcgtcgtccgggcagcttccctccctctcctctccgcccccgcttacctaggccggccccgcctacgcccccctcccgccgccgcacgatgagcacttctcccgccgccgccgacgtttcgcctttgccgcctactgctgccgccgacgaggccgcgcgggcgacagagacggtggtggtcgatgagagggtcgcctcacacgtgggacccgttcctcgtcgaggggctcgacaaccctcgccaccgtctcatggttctacggatgcaaccggaaatacaaaactttatgcagaaccctcaggtggaggagtttgaattccaaaaactttccgacttcctaacctcgctgtgctgctcatcggtggtggacaaccttagggcttaaagactaatggagccacaacggttcactagaaaggctcacgtagcagggattgttgccagaaaaaacagcaagaaaagcgggaatcctgcgatttttttaacgggaaagtccctaccaaccgaggcgacaaaggatccttgagaacgtctgaaaaagcttaaagttgtggcattttaaccaaagggccccaaaggcatctccaaaagggaaacgccgtgattctcaaaaaccagagg

SEQ ID NO: 13219 - protein, 67 aa, Zea mays
  misc_feature: Ceres CLONE 1373550-F
MRGSPHTWDPFLVEGLDNPRHRLMVLRMQPEIQNFMQNPQVEEFEFQKLSDFLTSLCCSSVVDNLRA

SEQ ID NO: 13220 - DNA, 658 bp, Zea mays
  misc_feature: Ceres CLONE 1373555-F
  misc_feature: Translation starting site: 267
  misc_feature (200)..(200): n is a, c, t, g, unknown, or other
  misc_feature (406)..(406): n is a, c, t, g, unknown, or other
  misc_feature (407)..(407): n is a, c, t, g, unknown, or other
  misc_feature (412)..(412): n is a, c, t, g, unknown, or other
  misc_feature (415)..(415): n is a, c, t, g, unknown, or other
  misc_feature (431)..(431): n is a, c, t, g, unknown, or other
  misc_feature (448)..(448): n is a, c, t, g, unknown, or other
  misc_feature (462)..(462): n is a, c, t, g, unknown, or other
  misc_feature (524)..(524): n is a, c, t, g, unknown, or other
agagctggagctccccgcggtggcggccgctctagaactagtggatcccccgggctgcaggaattcgcacgagaccattacctagaacatcctaatcgaaaactctgtctctctagggtttttgattttagccgccgccgctgctcatctcacatccctcgagaagacgcctgctactcgccgatcgatacgatggccgntcttctccgacctccacaccgccgacggcctcaagtccctcgaggctcacctcgccggcaaaacctatgtgtctggtgacgccattagtaaggatgacattaagggtctttcgcgcggtgccgtcgaagcctggcgctgagtttcctaatgccgcccgctggtacgagaccgtctctggcgctgtagccctcagattccctggtanngctgntgntgtaaatctgcctgcnggatcagctcctgcggnagctgctcctgcgnatgaggttgaggatgatgagaccctgatctttttggggaggaactgaggagaacaaaagccnctgatgaacgggccccccttgcaaggcccttttaaaaaaaagaaaggggaaacccccgccctttggggggcaaccctgggccctggaccttttttaaaaacttggggagggttccccagggcccaaaggggggc

SEQ ID NO: 13221 - DNA, 645 bp, Zea mays
  misc_feature: Ceres CLONE 1373558-F
  misc_feature: Encodes the peptide sequence at SEQ ID NO. 13222
  misc_feature (29)..(29): n is a, c, t, g, unknown, or other
  misc_feature (30)..(30): n is a, c, t, g, unknown, or other
  misc_feature (59)..(59): n is a, c, t, g, unknown, or other
  misc_feature (158)..(158): n is a, c, t, g, unknown, or other
  misc_feature (265)..(265): n is a, c, t, g, unknown, or other
  misc_feature (435)..(435): n is a, c, t, g, unknown, or other
gggagggctaaagctgtcgttttgtgggnntggggataacacacgccaccatgacctanaacatcctaatcgaaaaatcacataagtccgccgcccctctccctcagtaaacccccctctcttcttcccgcggtctgctcgggcggtctggggagcanatctgagggcgcgagcgaccgggaagcagcttcaatcgtcggcatggcgctcgtattgcatagtggggctggaaacaagaatggcttcaaagcacttattggtgcanaatacagtgggatcaagggtgagttgaccaaggattttgagatgggtggctccaacaagacccctgagtttcttaagatggaccgggggggggagggtcctggtctggagactcctgatggccctgtttttgagagtaatggtatcgcacgctatgttgctcgcttgaangatgacaaccctctttttgggtcttcccggattgaacaagcccacgttgagcaatggatggattttgccgcaacagaagttgatcctgggggtgcatgggacttgtatccaagggttgggtacctcccttatggcagcacaactggggaaacagctatttcttcattgaagaggtcgcttggtgctctgaacacacaccttgcctcaaac

SEQ ID NO: 13222 - protein, 148 aa, Zea mays
  misc_feature: Ceres CLONE 1373558-F
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
  misc_feature (22)..(22): Xaa is any aa, unknown, or other
  misc_feature (78)..(78): Xaa is any aa, unknown, or other
MALVLHSGAGNKNGFKALIGAXYSGIKGELTKDFEMGGSNKTPEFLKMDRGGEGPGLETPDGPVFESNGIARYVARLXDDNPLFGSSRIEQAHVEQWMDFAATEVDPGGAWDLYPRVGYLPYGSTTGETAISSLKRSLGALNTHLASN

SEQ ID NO: 13223 - DNA, 655 bp, Zea mays
  misc_feature: Ceres CLONE 1373560-F
  misc_feature: Encodes the peptide sequence at SEQ ID NO. 13224
  misc_feature (387)..(387): n is a, c, t, g, unknown, or other
aaagctggagctccccgcggtggcggccgctctagaactagtggatcccccgggctgcaggaattcgcacgagaccattacctagaacatcctaatcgaaaactcatttttctctctcctgcgccgcgacgtccctcgccttcgccgccgaatccgagactccgatctcgggttcaccgcagcgcacagagcagccccgactcccggcccgatccgcgctctcctctccgtcgcttcagtcatggcaggaatggcacctgagggttctcagttcgatgctaagcactatgattctaagatgcaggagctgctgagcaccggtgagactgaggagttcttcacttcatatgatgaagtttttgagagttttgatgatatgggcctccnaagagatcttctgagaggcatttatgcttatggttttgagaagccatcttgcattcagcagagaaggaatggtcccttccggcaaggggccttgatgtcatttccgcaagcaccattctggtaacgggaaagaccggaaactttcggggttttgggaactttgcaccaactggaactatgggcctggtttgaaagggccagcccctgggccttggttcccccccgggagttttgccccccaaaattccaaaaagtcttgggcgcgcct

SEQ ID NO: 13224 - protein, 89 aa, Zea mays
  misc_feature: Ceres CLONE 1373560-F
  misc_feature (49)..(49): Xaa is any aa, unknown, or other
MAGMAPEGSQFDAKHYDSKMQELLSTGETEEFFTSYDEVFESFDDMGLXRDLLRGIYAYGFEKPSCIQQRRNGPFRQGALMSFPQAPFW

SEQ ID NO: 13225 - DNA, 680 bp, Zea mays
  misc_feature: Ceres CLONE 1373567-F
  misc_feature: Encodes the peptide sequence at SEQ ID NO. 13226
  misc_feature (360)..(360): n is a, c, t, g, unknown, or other
  misc_feature (442)..(442): n is a, c, t, g, unknown, or other
  misc_feature (465)..(465): n is a, c, t, g, unknown, or other
  misc_feature (484)..(484): n is a, c, t, g, unknown, or other
  misc_feature (488)..(488): n is a, c, t, g, unknown, or other
  misc_feature (496)..(496): n is a, c, t, g, unknown, or other
  misc_feature (644)..(644): n is a, c, t, g, unknown, or other
aaagctggagctccccgcggtggcggccgctctagaactagtggatcccccgggctgcaggaattcgcacgagaccattacctagaacatcctaatcgaaaagtgttccgtgtccgcgtccagtgtgtccgctccccctcagtcctagcggtagcgtgcgcgcgggagacgtagatggcggcttcggcggcggcggcggcggcggcggcgacaccggtggcgccgacagaggggacggtgatcgcgatccacagcctggaggagtggagcatccagatcgaggaggccaacagcgcccagaagctggtggtgattgacttcactgcaacatggtgtcctccgtgccgcgccatggctccnatttttgctgatatggccaagaagtccccaaatgttgttttccctgaaagtgatgtcgatgaaatgaagaccattgctgagncattcagcgtagaggccatgccnacattccctgtcatgaggnaggncgacgtcnaggacagggtcgttggcgcagcaaaggagagctagcagggaagcttggactacacatgggctcgtagatcagtgatgccgtaatgtagtattcgccctaataagagacgcctcgcctcactctgagaaactagtgcttctgtgatggnattcggatgagagagtgcccccttggtgtacttctt

SEQ ID NO: 13226 - protein, 118 aa, Zea mays
  misc_feature: Ceres CLONE 1373567-F
  misc_feature (22)..(117): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (90)..(90): Xaa is any aa, unknown, or other
  misc_feature (104)..(104): Xaa is any aa, unknown, or other
  misc_feature (105)..(105): Xaa is any aa, unknown, or other
  misc_feature (108)..(108): Xaa is any aa, unknown, or other
MAASAAAAAAAATPVAPTEGTVIAIHSLEEWSIQIEEANSAQKLVVIDFTATWCPPCRAMAPIFADMAKKSPNVVFPESDVDEMKTIAEXFSVEAMPTFPVMRXXDVXDRVVGAAKES

SEQ ID NO: 13227 - DNA, 536 bp, Zea mays
  misc_feature: Ceres CLONE 1373572-F
  misc_feature (53)..(53): n is a, c, t, g, unknown, or other
  misc_feature (303)..(303): n is a, c, t, g, unknown, or other
  misc_feature (325)..(325): n is a, c, t, g, unknown, or other
  misc_feature (338)..(338): n is a, c, t, g, unknown, or other
  misc_feature (350)..(350): n is a, c, t, g, unknown, or other
  misc_feature (399)..(399): n is a, c, t, g, unknown, or other
  misc_feature (402)..(402): n is a, c, t, g, unknown, or other
aaagctggagctccaccgcggtggcggccgctctagaactagtggatcccccngggctgcaggaattcgcacgagaccattacctagaacatcctaatcgaaaaaaacgatcacacaccactccacagcagtagcaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttccaagatgatggtggncggcagctctgctgggcttggnccctgccgtgtcnatcgcccgaggngaggaacatcaagacaccaccaccgaaaaaaggaccacccggtgggaanccnaaaacctttccgcccttaaccggcttgggggggggggcccccggggtttggggggctcccccgggggagaatttcggggaaaaattttcccgggttcaaagggcccgggggggggggaacccctcccccgggtt

SEQ ID NO: 13228 - DNA, 672 bp, Zea mays
  misc_feature: Ceres CLONE 1373574-F
aaagctggagctccccgcggtggcggccgctctagaactagtggatcccccgggctgcaggaattcgcacgagaccattacctagaacatcctaatcgaaaaacctataatattttgagcattcagaaacacaccaagcgaagcgcactagcaacaacctaacaacaatggctaccaagatattatccctccttgcgcttcttgcgctttttgcgagcgcaacaatgcgtccattattccacaatgctcacttgctcctagttccattattccacagttcctcccaccagttacttcaatggccttcgaacacccagctgtgcaagcctataggctacaacaagcgattgcggcgagcgtcttacaacaccaattgccccattgcaaacaacatccttggcacatctaacaatacaaaccatcgcaacgcaacagcaaacacagttcctaccagcactgagccacctagccatggtgaaccctgtcgcctacttgcaacagcagctgcttgcatcaacccacttgctctagcaaacgtaggtgcaaaccagcaacacaacaaactgcacagtttctgccagcgcttagtcaactagccatggtgacccctgcccgctacctacacaggaacaactggtttcatctaacccggtcgctggggccaatgaccct

SEQ ID NO: 13229 - DNA, 760 bp, Zea mays
  misc_feature: Ceres CLONE 1373577-F
  misc_feature: Encodes the peptide sequence at SEQ ID NO. 13230
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (40)..(40): n is a, c, t, g, unknown, or other
  misc_feature (48)..(48): n is a, c, t, g, unknown, or other
  misc_feature (760)..(760): n is a, c, t, g, unknown, or other
nnnnnnncccccnnnnnnnnnctcccccggccctccacangggggggngggtcagaactggagctccccgcggtggcggccgctctagaactagtggatcccccgggctgcaggaattcgcacgagaccattacctagaacatcctaatcgaaaaattagccagcccacctctgctctgcgggcgcttcagatggaagcactagccattggatccgcgcctcgccgtccgggcgcaaggtactcccaactccgccgccccggaaccctcgccgtcaccaccacagccacagttgcatgccgccccctcacggcgccctccatggacgccgccgttggccgcccgagccgcgcgcctatccgctgcaccagcgcggagacggactcggtggatgaggtcgcgacgagctcgcacgccgcggagggcggggggggggggcaccacggagcaagagggcaacgggagccccgtggccggcgctgccgcggactcccccgtggtcgccggcgtcgacgggataagggatccggcggcgggcccgggacggggccccgcggggcactaccgggggccggttccaggttccgcctccaggaacgagggggaacacggccgcgggaacatcccccgaagaaaaatcttctgggaaccagggacgccccaggttttctgccgaagggaagggggagggaggcccccttggtacatggcttgaaggcgcccccccttggaggggctgcttcccccccccccaaggggcn

SEQ ID NO: 13230 - protein, 107 aa, Zea mays
  misc_feature: Ceres CLONE 1373577-F
MRSRRARTPRRAGGGGTTEQEGNGSPVAGAAADSPVVAGVDGIRDPAAGPGRGPAGHYRGPVPGSASRNEGEHGRGNIPRRKIFWEPGTPQVFCRREGGGRPPWYMA

SEQ ID NO: 13231 - DNA, 675 bp, Zea mays
  misc_feature: Ceres CLONE 1373580-F
  misc_feature: Encodes the peptide sequence at SEQ ID NO. 13232
  misc_feature (487)..(487): n is a, c, t, g, unknown, or other
  misc_feature (608)..(608): n is a, c, t, g, unknown, or other
aaagctggagctccccgcggtggcggccgctctagaactagtggatcccccgggctgcaggaattcgcacgagaccattacctagaacatcctaatcgaaaactttcgtcaactccacttctcttctccgcgtcacctcctcttcgccgccgccgacgcttcaccgggcagccagccatggatgaggagtacgacgtgatcgtactaggcacggggctcaaggagtgcatcctcagcggtctcctctctgtggacggcctcaaggttttgcatatggacagaaatgactactatggaggagattccacctcgctcaaccttaatcagctctggaagaggtttagaggggaagacaagcccccagcacatctaggtgcaagcagagactacaatgtggacatggtggcaaagtttatgatggcaaatgggacattggttcgaaccctcatccacaccgacgtgacaaagtacttgtcattcaaagctngtgatgggagctatgttttcagtaaagggaagatttacagggtccctgccactgatatggaggctctgaagtccctttgatgggcctattcgagaagcgcagagcagggacttcttcattnattgcccagattacaatgaggctgatccaggacacctcagggatgggactttactagggtgacacta

SEQ ID NO: 13232 - protein, 129 aa, Zea mays
  misc_feature: Ceres CLONE 1373580-F
  misc_feature (1)..(130): Pfam Name: GDI Pfam Description: GDP dissociation inhibitor
  misc_feature (104)..(104): Xaa is any aa, unknown, or other
MDEEYDVIVLGTGLKECILSGLLSVDGLKVLHMDRNDYYGGDSTSLNLNQLWKRFRGEDKPPAHLGASRDYNVDMVAKFMMANGTLVRTLIHTDVTKYLSFKAXDGSYVFSKGKIYRVPATDMEALKSL

SEQ ID NO: 13233 - DNA, 685 bp, Zea mays
  misc_feature: Ceres CLONE 1373582-F
  misc_feature: Encodes the peptide sequence at SEQ ID NO. 13234
agagctggagctccccgcggtggcggccgctctagaactagtggatcccccgggctgcaggaattcgcacgagaccattacctagaacatcctaatcgaaaaaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccaccgccggtccacctgccaccgccggtccatgtgccgccgccggttcatctgccgccgccaccatgccactaccctactcaaccgccccggcctcagcctcatccccagccacacccatgcccgtgccaacagccgcatcccagcccgtgccaactgcaggaaacctggcgggttggcagcacccccgatcctgggccagtggcgtcgaggttcctgagggatcatggcagcccggacggggacgccttactggtccgctcagggccagccgttgcggcaacagggttgccaacaactacgggagggggaaccccaaacccggaccaggggatt

SEQ ID NO: 13234 - protein, 72 aa, Zea mays
  misc_feature: Ceres CLONE 1373582-F
MPVPTAASQPVPTAGNLAGWQHPRSWASGVEVPEGSWQPGRGRLTGPLRASRCGNRVANNYGRGNPKPGPGD

SEQ ID NO: 13235 - DNA, 664 bp, Zea mays
  misc_feature: Ceres CLONE 1373584-F
  misc_feature: Encodes the peptide sequence at SEQ ID NO. 13236
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (492)..(492): n is a, c, t, g, unknown, or other
agagctggagctccccgcggtggcggccgctctagaactagtggatcccccgggctgcaggaattcgcacgagaccattacctagaacatcctaatcgaaaaatcacctataatattttgagcattcagaaacacaccaagcgaagcgcactagcaacaacctaacaacaatggctaccaagatattatccctccttgcgcttcttgcgctttttgcgagcgcaacaatgcgtccattattccacaatgctcacttgctcctagttccattattccacagttcctcccaccagttacttcaatggccttcgaacacccagctgtgcaagcctataggctacaacaagcgatttgcgcgagcgtcttacaacaaccaattgccccattgcannncacatccttggcacatctaacaatacaaaccatcgcaacgcaacagcaaacacagttcctaccagcactgagccacctaggcatggtgaaccctgtcgnctacttgcaacagcagctgcttgcatccaacccacttgctctagcaaacgtagttgcaaaccagcacaacaacaactgcacagtttctggcagcgcttaatcaactagccatggtggaccctgccggctacctacaaaggaacactggtttcatctagcccgctcgcttggg

SEQ ID NO: 13236 - protein, 96 aa, Zea mays
  misc_feature: Ceres CLONE 1373584-F
  misc_feature (30)..(30): Xaa is any aa, unknown, or other
  misc_feature (31)..(31): Xaa is any aa, unknown, or other
  misc_feature (64)..(64): Xaa is any aa, unknown, or other
MAFEHPAVQAYRLQQAICASVLQQPIAPLXXTSLAHLTIQTIATQQQTQFLPALSHLGMVNPVXYLQQQLLASNPLALANVVANQHNNNCTVSGSA

SEQ ID NO: 13237 - DNA, 678 bp, Zea mays
  misc_feature: Ceres CLONE 1373585-F
  misc_feature: Translation starting site: 192
  misc_feature (433)..(433): n is a, c, t, g, unknown, or other
  misc_feature (472)..(472): n is a, c, t, g, unknown, or other
  misc_feature (678)..(678): n is a, c, t, g, unknown, or other
aaagctggagctccccgcggtggcggccgctctagaactagtggatcccccgggctgcaggaattcgcacgagaccattacctagaacatcctaatcgaaaaatctacctcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcacccgtgnctgtgggggccggccgccatcgcgctggcgtccaatggncggccgggttcgtcacctccggcggcctcggcgtcgctgcgctgtccgtgttctcctggatgtacaagtacctgacgggcaagcacccgccgggcgccgaccagctggaccacgccaaggcgaggctggcgtccaaggcccgcgacatcaaggatgcagcacagcaccgcatcgaccaggcgcaggggtcttgagagaagaccacn

SEQ ID NO: 13238 - DNA, 672 bp, Zea mays
  misc_feature: Ceres CLONE 1373586-F
  misc_feature: Encodes the peptide sequence at SEQ ID NO. 13239
  misc_feature (458)..(458): n is a, c, t, g, unknown, or other
  misc_feature (522)..(522): n is a, c, t, g, unknown, or other
  misc_feature (617)..(617): n is a, c, t, g, unknown, or other
  misc_feature (672)..(672): n is a, c, t, g, unknown, or other
aaagctggagctccccgcggtggcggccgctctagaactagtggatcccccgggctgcaggaattcgcacgagaccattacctagaacatcctaatcaaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactaancacacttgtgctagcaaaccttgctgcctactctcagcaacagcagtttcttcccattcaccanctaaggtcattgaactctgcttcttatttgcaacaacaacaactaccattcagccagctacctgctgcctacccccaggaatttccttccattcnaacaactagcagcattggaatcctcctgcttaattacagcagcaacaactactan

SEQ ID NO: 13239 - protein, 170 aa, Zea mays
  misc_feature: Ceres CLONE 1373586-F
  misc_feature (100)..(100): Xaa is any aa, unknown, or other
  misc_feature (121)..(121): Xaa is any aa, unknown, or other
  misc_feature (153)..(153): Xaa is any aa, unknown, or other
MAAKIFCLLMLLGLSASAATATIFPQCSQAPIASLLPPYLSPAVSSVCENPILQPYRIQQAIAAGILPLSPLFLQQSSALLQQLPLVHLLAQNIRAQQLXTLVLANLAAYSQQQQFLPIHXLRSLNSASYLQQQQLPFSQLPAAYPQEFPSIXTTSSIGILLLNYSSNNY

SEQ ID NO: 13240 - DNA, 720 bp, Zea mays
  misc_feature: Ceres CLONE 1373594-F
  misc_feature: Translation starting site: 292
  misc_feature: Pfam Name: AA_permease Pfam Description: Amino acid permease
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
nttttnnntttcttttttttccctactcttctccgggggggggggtggggcagagctggagctccccgcggtggcggccgctctagaactagtggatcccccgggctgcaggaattcgcacgagaccattacctagaacatcctaatcgaaaaacacactgctcgttctcacgacaaattcgattcatcaaaatctacaaacgtagtagtatttacgagaatagatattacaggcccaaacagctgctgcttctgttgaagcacgccgcaccggcagacgttacccctccaatgggcgaatgcagaacggagtacaggggcctgcccgacgccaatggcgaggacgcggggacggtgccggccgcgctccgcaaggtgtccatagtcccgctcgttttcctcatcttctacgaggtctccggcgggccggtcggcatcgaggacagcgtgggcgcagcggggccgctcctcgccatcgtcggcttccttgtcctccccgtcatctggagcatcccggaggcgctgattaccgcggaggctgggcaccatgttcccggagaacggcggatacgtcgtgtgggtcgcctcggcgctcggcccctactggggattccagcaagggtgggtgaagtggctcagtggcgtcatcgacaatgccctgtaccccgtcctcttcctggactacctcaagtccgccgtggctgccctgggcggcggcca

SEQ ID NO: 13241 - DNA, 669 bp, Zea mays
  misc_feature: Ceres CLONE 1373596-F
  misc_feature: Encodes the peptide sequence at SEQ ID NO. 13242
  misc_feature (147)..(147): n is a, c, t, g, unknown, or other
  misc_feature (313)..(313): n is a, c, t, g, unknown, or other
aaagctggagctccccgcggtggcggccgctctagaactagtggatcccccgggctgcaggaattcgcacgagaccattacctagaacatcctaatcgaaaaaacagcgtcctcctcccgcgtgctctccactcccagaccccgggngactacaagggcactgggctaggtccgttggcaacagccgccacactgctccgctctgctctctggaggcattgcctgcctcgagttgtcatggcggcagcggggacgcagctgggtcggctccttgttggcggcctctggctcctggccgcgttgctgcagcggngcgctgcggcggcagtggccgccgtggatgggcggcgcgccatcgcagcgactggggagaacttcgtgtgcgcgacattggactggtggcccgccggacagtgcgactatggcacctgcccctggggccgcggcgggctgctcaacctggatctctccaacaaggtcctccctcacggcgtcagaggacaaggtggtgtacggggaccgcggacctccggcgggcggtgcgcgccttccgcaaggagcgcgtcggaaatgcaccggtttcaccagaggttgcctgaccctggcaagggggaacaagctaaccgctttctccaagaaactggggttttaaatccccttgggaaggcc

SEQ ID NO: 13242 - protein, 144 aa, Zea mays
  misc_feature: Ceres CLONE 1373596-F
  misc_feature (26)..(26): Xaa is any aa, unknown, or other
MAAAGTQLGRLLVGGLWLLAALLQRXAAAAVAAVDGRRAIAATGENFVCATLDWWPAGQCDYGTCPWGRGGLLNLDLSNKVLPHGVRGQGGVRGPRTSGGRCAPSARSASEMHRFHQRLPDPGKGEQANRFLQETGVLNPLGKA

SEQ ID NO: 13243 - DNA, 669 bp, Zea mays
  misc_feature: Ceres CLONE 1373597-F
  misc_feature: Encodes the peptide sequence at SEQ ID NO. 13244
cagagctggagctccccgcggtggcggccgctctagaactagtggatcccccgggctgcaggaattcgcacgagaccattacctagaacatcctaatcgaaaagttcaccaaacaaaaccgaagccgcactccaccgctctcctccccaatcagctatgctcgcccaccgcttcctcctcctcatcgccgtcgccgcggctgcggcgagcggcatcgcctccgctaagccgacggcgtacgaagccctcgccgactacgacttccccccggggatccttcccaagggcgtggtcgcctacacggtcgacaacgccacgggcgccttcacggccacgctcgatgcctccgcgtccggcgcgggatcctccatctgcgagggcgcaatcgagggctcctactcgctacgctaccagaccaagatcaccggcaagatctcccccgaccacctcaccgacctccagggtgtctccgacaagggcctcttcttctggctcaacatcgtcgaggtcacccgccatggggataacctcgagttctccgtcggcatcgccgccgcggacttcgggattgacaacttcctcgagggcccaacctgtgggtgcgggttcgactgcaacgacctgctcatgctccagaaggggggggccgccaccgccaagctgccgccg

SEQ ID NO: 13244 - protein, 171 aa, Zea mays
  misc_feature: Ceres CLONE 1373597-F
  misc_feature (5)..(153): Pfam Name: DUF538 Pfam Description: Protein of unknown function, DUF538
MLAHRFLLLIAVAAAAASGIASAKPTAYEALADYDFPPGILPKGVVAYTVDNATGAFTATLDASASGAGSSICEGAIEGSYSLRYQTKITGKISPDHLTDLQGVSDKGLFFWLNIVEVTRHGDNLEFSVGIAAADFGIDNFLEGPTCGCGFDCNDLLMLQKGGAATAKLPP

SEQ ID NO: 13245 - DNA, 665 bp, Zea mays
  misc_feature: Ceres CLONE 1373606-F
  misc_feature (302)..(302): n is a, c, t, g, unknown, or other
cgctctagaactagtggatcccccgggctgcaggaattcgcacgagaccattacctagaacatcctaatcgaaaaatcgacccagccatctcctcaccctcgttcacacacagtccgccactcctttagtagcttgtgatttgtacgtcgacgagatcactggtcgggtggcggacgacgacacatgggggagggtagtgtgggtgcatcatggtggggcgttcctcctgctcggcggcgtgctgctggtcgtaacaaccaccgcccgggcggaggacggagtggtcaacgggaacgcaaanaggacctgcggtggtgcaagcaggcttgcgagtggcaaaacggaaggggacccccccggaaaagggaatggaaaaagggaggccccggaggggaacccaaaatttaaccgggagaggacggcaaaggggggggggacccccaaccttccccctccgggggggggggggggggggggccccgggccttgggcccccccggggggcccccggggggacccccgaggggggtggggggggggcccccccccgcgggggtggggccctcaaaggggggagaaaagaaagcccccccgcgcaaaaaggagggcggcgaaaaagcggggggggggggggggggcggcgccgcccgccccgggggggagg

SEQ ID NO: 13246 - DNA, 718 bp, Zea mays
  misc_feature: Ceres CLONE 1373614-F
  misc_feature: Encodes the peptide sequence at SEQ ID NO. 13247
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (412)..(412): n is a, c, t, g, unknown, or other
aaagctggagctccccgcggtggcggccgctctagaactagtggatcccccgggctgcaggaattcgcacgagaccattacctagaacatcctaatcgaaaacagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgactcgcggnnntnggggggggggggcggcccccatttggggtgggggttaaggggggggccggggttcggtcaccttccggggggcctcggggggcccctggggcttggtccggggtcctccggggagggacaagtaacctggaggggcaagggcacccggccggggcgcccgaccaagctggaaccacgcccaggggaggggttgggcgttccaagggcccgcgaaattcaagggatgggggcaccggaaccggaatcaaccaggggggagggggtccttggagggaaagaaacacccctccgaggggaacggggggg

SEQ ID NO: 13247 - protein, 92 aa, Zea mays
  misc_feature: Ceres CLONE 1373614-F
  misc_feature (80)..(80): Xaa is any aa, unknown, or other
  misc_feature (81)..(81): Xaa is any aa, unknown, or other
MADHHRGATGGGGGYGDLQRGGGMHGEAQQQQKQGAMMTALKAATAATFGGSMLVLSGLILAGTVIALTVATPVLVTRGXXGGGAAPIWGGG

SEQ ID NO: 13248 - DNA, 720 bp, Zea mays
  misc_feature: Ceres CLONE 1373617-F
  misc_feature: Translation starting site: 240
  misc_feature: Pfam Name: Propeptide_C1 Pfam Description: Peptidase family C1 propeptide
  misc_feature (202)..(202): n is a, c, t, g, unknown, or other
  misc_feature (720)..(720): n is a, c, t, g, unknown, or other
aagctggagctcaccgcggtggcggccgctctagaactagtggatcccccgggctgcaggaattcgcacgagaccattacctagaacatcctaatcgaaaaatatataatacacacactagtgtagtagtgtggagtacttcaattggcgttggccgaagaagaggagaagcgaagcaagcagctttccgaggacaaggggnagggggaggaccaagcgaaagggggaactagagcaagatgggcggcgaactgctgcttgcgctcctcctcgtctctgctgctgccgcccctcaggtacttggagttggcaatggagacaatcacatgagaatcatccaggaggacatcattgagacagtcaacaaccatcccgggggtggggtgggaaggctcacgtaatccttacttttcaaactataccattgcgcaatttaagcacatacttggagtgaaacccggaccacagagtggcctaggcaatgttcctgtcaaaacttattgcggatccctgggacttgcgaagggaggttggacgcttgagtctgcgtggggccccgttggcgggacaattggggaaccttacttggatcaaggggcactgggggcctccttgggtggggctttttgggtgcctggtgggaggggccccccggggaccggttttgtggcgttcccccctcccagcgggggggcctgtttttactttttgcgcggcgcn

SEQ ID NO: 13249 - DNA, 686 bp, Zea mays
  misc_feature: Ceres CLONE 1373618-F
  misc_feature: Encodes the peptide sequence at SEQ ID NO. 13250
  misc_feature (480)..(480): n is a, c, t, g, unknown, or other
aaagctggagctccccgcggtggcggccgctctagaactagtggatcccccgggctgcaggaattcgcacgagaccattacctagaacatcctaatcgaaaaacttctacctggcctcgcaggcttcgcaaggcggccacacgccgatacctcctccttcacccgctccgtcgtcccccccagccggccacgccaccatgctgccaccggccgcgcgccttgcggcccgccgcctcctcggcctcgcctccgcatctgcgtcggaagccgccggccgccgggtagcttcctctccgatcgcttccgcaggctactccgccgccgcgtccaggggctccgtctccagcaccaggcccttctccacggctcttaactaccaccttgactcgccggagaacaagccggacatgaaatgggagttctcacaggcgaatatgaagaaggtcaatgagattctgtctcactatccaagcaactacnagcaatctggtattattccgctgcttgatcttgcacagcagcagcatggtgggatgggtggcagttgcagcaatggatgctattgctaaaatttgtcgaagttgcaccaatcaggggtctatgaaggtgcaaccttctatacgatgttaacagggactaagggtggtaatacaacccttttgggggggtggactacacttggagag

SEQ ID NO: 13250 - protein, 123 aa, Zea mays
  misc_feature: Ceres CLONE 1373618-F
  misc_feature: SWISSPROT Homolog: EC 1.6.99.5 NADH dehydrogenase (quinone)
  misc_feature (95)..(95): Xaa is any aa, unknown, or other
MLPPAARLAARRLLGLASASASEAAGRRVASSPIASAGYSAAASRGSVSSTRPFSTALNYHLDSPENKPDMKWEFSQANMKKVNEILSHYPSNYXQSGIIPLLDLAQQQHGGMGGSCSNGCYC

SEQ ID NO: 13251 - DNA, 690 bp, Zea mays
  misc_feature: Ceres CLONE 1373621-F
gctctagaactagtggatcccccgggctgcaggaattcgcacgagaccattacctagaacatcctaagtcgaaaaatatctttcttctccccaagaaaaaaaaggcggcgagagcataagaagaaaaaaaacacacacacacacacacaaagcgcacttttcaaatcgacaaaggggaaaggttcgcttcttgtggcatcttgctttccttcgagtgccatggccgatccggcggaggagaacgttgtctcgccgccaccgacccctgcggcccagccgtggggcgctcagaccccgcccctggcaggctggctgccgaacaaccgcctcaacggaaagggggtctgctcgggggcgggagggaagggcccgggaatccaggttccttggaagggaacttcccgggcaaaaatcccctgggggggggaaaaagggcgtgggttctgtaaggaaaaaaaaaaaaaaatttccgggggggaaaaaagggggggggaagggcgagtgcgggggtcgggtgggaagagggttgaaaaaaaccgccccgggcgcgggaagtccgagggggggggggggggggggtttgccccctttagtctcggggggcccaaaaaacccccccctttttaaagaaagagaacccccgggaatattctccaaggggggggggggtttgtgggggcgcgctggggg

SEQ ID NO: 13252 - DNA, 655 bp, Zea mays
  misc_feature: Ceres CLONE 1373622-F
  misc_feature: Encodes the peptide sequence at SEQ ID NO. 13253
gctctagaactagtggatcccccgggctgcaggaattcgcacgagaccattacctagaacatcctaatcgaaaaacacaacaccagaatccgcgaatcacagacgcgtctatctcagcttgctgcactgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcaggcgcggccgccgcgctgcccagcaaggtgcggcgtccccctgccgtacaagatcagcaccaacgttaactgcaacacgattaattaggtggatgaggggtccctgtgcgcgtccggggcgaggaatgatggcatggggctggcggagagtaataaataatgctactgggatttagcg

SEQ ID NO: 13253 - protein, 153 aa, Zea mays
  misc_feature: Ceres CLONE 1373622-F
  misc_feature (32)..(110): Pfam Name: Tryp_alpha_amyl Pfam Description: Protease inhibitor/seed storage/LTP family
MAAPKLATLALAVLLAATVVAPPAAVRAAMSCSTVYSTLMPCLPFVQMGGAMPPQPCCGGIRSLLQQANNTPDRRTICGCLKNVANGANGSGTYIRRGRRAAQQGAASPCRTRSAPTLTATRLIRWMRGPCARPGRGMMAWGWRRVINNATGI

SEQ ID NO: 13254 - DNA, 689 bp, Zea mays
  misc_feature: Ceres CLONE 1373623-F
  misc_feature (457)..(457): n is a, c, t, g, unknown, or other
  misc_feature (623)..(623): n is a, c, t, g, unknown, or other
  misc_feature (636)..(636): n is a, c, t, g, unknown, or other
  misc_feature (655)..(655): n is a, c, t, g, unknown, or other
  misc_feature (689)..(689): n is a, c, t, g, unknown, or other
aaagctggagctccccgcggtggcggccgctctagaactagtggatcccccgggctgcaggaattcgcacgagaccattacctagaacatcctaatcgaaaaatacttttcctccttcagtttttatcacacgtcaatggagtggggctagcaatggcatggtaacttttccaatctttttgcattaaaaaagaaatcctaaagaaaaaggattactaaacgagcacgctcgccggcgctgggaccaggctctgggtctcgcatcacgatcagatccaatccaaggccgcgccccagcccggcggatggattccgccgccgtggccatcgtgacggtgccgttcccggcgcagggccacctgaaccagctgctgcacctgtccctgctcctggcatcgcgggggcttcctgtccacttcgccgcgccggagccgaccctccgggaggcccgcgcgcngcctgcacggctgggggcccaccccccgcgtcggtgtgcttccgcgcgctggacgtgcccgcgcacgactccccctccccggacccatcctccccgttcccggcgacatgcagccccctgttcgaggctctgcacccgggcggcgcgggcctcgctagcgcgctcntgggggggggagnttggccgcgtccaacgccncccgggtcgtcgtcctctacgaccgatggggggn

SEQ ID NO: 13255 - DNA, 693 bp, Zea mays
  misc_feature: Ceres CLONE 1373624-F
  misc_feature: Encodes the peptide sequence at SEQ ID NO. 13256
  misc_feature (476)..(476): n is a, c, t, g, unknown, or other
  misc_feature (500)..(500): n is a, c, t, g, unknown, or other
aaagctggagctccccgcggtggcggccgctctagaactagtggatcccccgggctgcaggaattcgcacgagaccattacctagaacatcctaatcgaaaaattttttttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcggcggcagtttcgtcgccgtcgcctccatgacgtccgccgccgtctccaccagggtggagaacaagaagccatttgctcctccgagggaggtacatgtccaggttacacattcaatgccatctcacaagattgaaattttcaagtcacttgatgattgggctagagataatatcttgacacatctcnagccagtcgagaagtgttggcagncacaggatttccctcctgacccagcatctgaaggatttcatgattgaagtaaggagcttcagagaacgtggccaggagatccctgaggattaatttgtttggttgggtggaaaactgattatcgggggaagttttccccaaatttcaaaaattgtttaacccccccccgggggtaaaaaaaaaaaaggggggc

SEQ ID NO: 13256 - protein, 107 aa, Zea mays
  misc_feature: Ceres CLONE 1373624-F
  misc_feature: SWISSPROT Homolog: EC 1.14.19.2 Acyl-[acyl-carrier-protein] desaturase
  misc_feature (85)..(85): Xaa is any aa, unknown, or other
  misc_feature (93)..(93): Xaa is any aa, unknown, or other
MALRLHDVALCLSPPLAARRRSGGSFVAVASMTSAAVSTRVENKKPFAPPREVHVQVTHSMPSHKIEIFKSLDDWARDNILTHLXPVEKCWQXQDFPPDPASEGFHD

SEQ ID NO: 13257 - DNA, 721 bp, Zea mays
  misc_feature: Ceres CLONE 1373626-F
  misc_feature: Encodes the peptide sequence at SEQ ID NO. 13258
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (320)..(320): n is a, c, t, g, unknown, or other
  misc_feature (321)..(321): n is a, c, t, g, unknown, or other
  misc_feature (323)..(323): n is a, c, t, g, unknown, or other
  misc_feature (347)..(347): n is a, c, t, g, unknown, or other
  misc_feature (348)..(348): n is a, c, t, g, unknown, or other
  misc_feature (360)..(360): n is a, c, t, g, unknown, or other
  misc_feature (397)..(397): n is a, c, t, g, unknown, or other
  misc_feature (400)..(400): n is a, c, t, g, unknown, or other
  misc_feature (414)..(414): n is a, c, t, g, unknown, or other
  misc_feature (434)..(434): n is a, c, t, g, unknown, or other
  misc_feature (451)..(451): n is a, c, t, g, unknown, or other
aaagctggagctccccgcggtggcggccgctctagaactagtggatcccccgggctgcaggaattcgcacgagaccattacctagaacatcctaatcgaaaaaaagaaatgtacagtctacacagctgaccagagagctagtgcaagcgatctagcaagttttaatcttggaagaagccagctaggcgcgtgaatatggatcgcctcactgtgatggcgccgccgctgctcgtcctcctcctgctgctcctctcgcggtgctcggcggcggcgtcacggcgcgggnnngggctgtttggggaggaggcgagggggatganngncccgaagcgagaggaaagaaggcnnaaaggcaaaggnagggggctgttcctgctgcaccgggtggagaaggtgntgnagtcggagggcggncaggtgcgcgtggtgcgcgnccagccgtggccgccgncgtccttcgcctgccgcgaggggctcatgcacatcggcttcatcaccatggagcccaagacgctgttcgtgccgcagtacctcgactccagcatcactctcttcgtgcagcggggggaagcgaaggttgggtatattcacaaggacgagctcgtggagagggagctcaggatgggcgacgtcctccacatcgacgccggctccactttctacatgggcaaccccgggaaaggccgaagctgcagatcatatgcagcgtgaacgcctcgaa

SEQ ID NO: 13258 - protein, 171 aa, Zea mays
  misc_feature: Ceres CLONE 1373626-F
  misc_feature (31)..(31): Xaa is any aa, unknown, or other
  misc_feature (42)..(42): Xaa is any aa, unknown, or other
  misc_feature (43)..(43): Xaa is any aa, unknown, or other
  misc_feature (51)..(51): Xaa is any aa, unknown, or other
  misc_feature (68)..(68): Xaa is any aa, unknown, or other
  misc_feature (69)..(69): Xaa is any aa, unknown, or other
  misc_feature (80)..(80): Xaa is any aa, unknown, or other
  misc_feature (86)..(86): Xaa is any aa, unknown, or other
MDRLTVMAPPLLVLLLLLLSRCSAAASRRGXGLFGEEARGMXXPKREERRXKGKGRGLFLLHRVEKVXXSEGGQVRVVRXQPWPPXSFACREGLMHIGFITMEPKTLFVPQYLDSSITLFVQRGEAKVGYIHKDELVERELRMGDVLHIDAGSTFYMGNPGKGRSCRSYAA

SEQ ID NO: 13259 - DNA, 658 bp, Zea mays
  misc_feature: Ceres CLONE 1373629-F
  misc_feature (402)..(402): n is a, c, t, g, unknown, or other
  misc_feature (422)..(422): n is a, c, t, g, unknown, or other
aaagctggagctccccgcggtggcggccgctctagaactagtggatcccccgggctgcaggaattcgcacgagaccattacctagaacatcctaatcgaaaaatcacctataatattttgagcattcagaaacacaccaagcgaagcgcactagcaacaacctaacaacaatggctaccaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccnttggcacatctaacaatacnaaccatccgcacgcaacaggaaacaaaaggtccctaacaaaccctgaccccccagccttggggaaccctgtccccaatttgaaaaggagttgtttgaacccaacccctttggttttgaaaggggtttgtaaacccaaaaaaaaaaaattggaaaagtttctcccccggtttaaaaaaaaaaccccgggggagaccctcgcccccaaccaaaaaaaggaaaaaagggtttttttttt

SEQ ID NO: 13260 - DNA, 521 bp, Zea mays
  misc_feature: Ceres CLONE 1373632-F
  misc_feature: Encodes the peptide sequence at SEQ ID NO. 13261
  misc_feature (227)..(227): n is a, c, t, g, unknown, or other
  misc_feature (253)..(253): n is a, c, t, g, unknown, or other
aagctggagctccccgcggtggcggccgctctagaatagtggatcccccgggctgcaggaattcgcacgagaccattacctagaacatcctaatcgaaaagcacatacttattgagaccaactactaacatagaaagacaatagtgtaccaacaatggcagccaacatattatgcctccttatgctccttggtctttctgcaagagctgttacgggctaccattttncctgcatgctcgcaagcatctatagntttccctttcttcccccgtactctcacaggggtgtcttcgtatgtgaaaaccaatcttcaccctacagatctacaggaatcacagtggaatcttactttattaccctgttctccaggagggtcgccctataaatcagtacctttggggttaattgggcaaaaaattcgggcaaacaaaaaaaaaatttgggaaaaaaactttttctcaattttctaaaaaaaattttttctttttcccacaaagggggttaaacccccttttttattt

SEQ ID NO: 13261 - protein, 76 aa, Zea mays
  misc_feature: Ceres CLONE 1373632-F
  misc_feature (25)..(25): Xaa is any aa, unknown, or other
  misc_feature (33)..(33): Xaa is any aa, unknown, or other
MAANILCLLMLLGLSARAVTGYHFXCMLASIYXFPFLPPYSHRGVFVCENQSSPYRSTGITVESYFITLFSRRVAL

SEQ ID NO: 13262 - DNA, 707 bp, Zea mays
  misc_feature: Ceres CLONE 1373635-F
  misc_feature: Encodes the peptide sequence at SEQ ID NO. 13263
  misc_feature (408)..(408): n is a, c, t, g, unknown, or other
aaagctggagctccccgcggtggcggccgctctagaactagtggatcccccgggctgcaggaattcgcacgagaccattacctagaacatcctaatcgaaaaagacttcgcagtcctcctccccactaccagagcatgcgcgttgccgcgacccgagccgccgccgccgctcaccctccgagcgccttcctgctcctcctgttactcctcggttgcgcgtccctcgcgatcggaggagcagccatggccggccacgtcctcggcggcgtgaaggagaacccagccgcggccaacagcgccgagtccgacgggctcggccgcttcgccgtcgatgagcacaacaggcgcgagaacgcgctgctggagttcgtgcgcgtggtggaggccaaggagcaggtgatgggcggnacgctgcaccacctcacgctcgaggccgtctaggccgggaggaaaaagctctacgagggccaggtctgggtcaggccatggctcgacttcaagagctccaggaatcagccacagggggacgccacgccttcaccacgacgtactcgggccaagcagggtgacatgagccctgttggcgtgagctccagtaaaggatcctgtgcccaagatgctgcacacctgctgggaatcgatccagagaggcccattccttgtttccctacaaattccgagatctttctgcccttggacgggtgggt

SEQ ID NO: 13263 - protein, 101 aa, Zea mays
  misc_feature: Ceres CLONE 1373635-F
MRVAATRAAAAAHPPSAFLLLLLLLGCASLAIGGAAMAGHVLGGVKENPAAANSAESDGLGRFAVDEHNRRENALLEFVRVVEAKEQVMGGTLHHLTLEAV

SEQ ID NO: 13264 - DNA, 717 bp, Zea mays
  misc_feature: Ceres CLONE 1373637-F
  misc_feature: Encodes the peptide sequence at SEQ ID NO. 13265
  misc_feature (381)..(381): n is a, c, t, g, unknown, or other
  misc_feature (479)..(479): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (619)..(619): n is a, c, t, g, unknown, or other
tccccgcggtggcggccgctctagaactagtggatcccccgggctgcaggaattcgcacgagaccattacctagaacatcctaatcgaaaaaatcttcttcttctccccaaattcgcccggcccgtcgtcgggagcaaggcagcaagcaatgtgccccagagccacggaccagctctgcggcgccgcgatggctagcgtgtgttcgttggtggaggaggagtacatcgacctggatctcagttcgtgcggggagctggagttccgggtgcgccggagcggcgcgtcggacgagctcctctgccgcggtagtaggctgcagccgccggcgccaccgaggcctggcggcaaggcgcaggaagttgacgtcggcggcggcggcnggatgtggtggcgccggcaggaggagcgcccgcgacggtggcgccgctgcagcactcgcactcccgcggggttccgcgacgacacgcagccccgtggncggcgaggctggcgcaccgagtgctcccgccgcaggaaagcgggcgcggacggtgcacgcgaagctgctggcgtcgcgggccttccttcccggtccttgttcggcaggactaccccgtgctccgacgagcatgcgnnnangcgccgaggtcgggccagcaccagagcgggcgccaccaccgggcgaagaccaagaggactgctggaaaaggggggcgtttgcccagatcaataactgc

SEQ ID NO: 13265 - protein, 174 aa, Zea mays
  misc_feature: Ceres CLONE 1373637-F
  misc_feature (65)..(65): Xaa is any aa, unknown, or other
  misc_feature (143)..(143): Xaa is any aa, unknown, or other
  misc_feature (144)..(144): Xaa is any aa, unknown, or other
MASVCSLVEEEYIDLDLSSCGELEFRVRRSGASDELLCRGSRLQPPAPPRPGGKAQEVDVGGGGXMWWRRQEERPRRWRRCSTRTPAGFRDDTQPRGRRGWRTECSRRRKAGADGAREAAGVAGLPSRSLFGRTTPCSDEHAXXRRGRASTRAGATTGRRPRGLLEKGGVCPDQ

SEQ ID NO: 13266 - DNA, 684 bp, Zea mays
  misc_feature: Ceres CLONE 1373640-F
  misc_feature: Encodes the peptide sequence at SEQ ID NO. 13267
  misc_feature (493)..(493): n is a, c, t, g, unknown, or other
  misc_feature (540)..(540): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaaaccggtccaccgcgcatcgaacccccacttgtgccgattctgctgatccctcgccgacaacggccggcgaatcgacaccatggccgctgcgcgccggggccgtggcgacggcgccaacggcgtcgtccgtccccgcccccgcgaccgcggcgggagcatggcggggcgcgtggccgtcctcgccttctgtgtcgcagggatctggtccgcctacatctaccagggcgtcctccaggagactctatcgacgaagcggttcgggccgaatgcgcggcggttcgagcacctcgcgttcctcaacttcgcgcagaacgtcatctggcttcgtctggtccttcataatgattaagctgtgggtcgggcgggagtagctccaatggcagcgcaccgnatatggaagttactgggggcgtcagcgtcaccaataccatcgggcgnacccatgggggatcgaggctctcaagtacatcagctacccgggctcaggtgttagcaaatctttctaagatgattccctgggaatggtngatgggaactctcctctaatgggggtgaagtacacacttccaggagtattatgcc

SEQ ID NO: 13267 - protein, 89 aa, Zea mays
  misc_feature: Ceres CLONE 1373640-F
MAAARRGRGDGANGVVRPRPRDRGGSMAGRVAVLAFCVAGIWSAYIYQGVLQETLSTKRFGPNARRFEHLAFLNFAQNVIWLRLVLHND

SEQ ID NO: 13268 - DNA, 729 bp, Zea mays
  misc_feature: Ceres CLONE 1373641-F
  misc_feature: Encodes the peptide sequence at SEQ ID NO. 13269
  misc_feature (617)..(617): n is a, c, t, g, unknown, or other
aaagctggagctccccgcggtggcggccgctctagaactagtggatcccccgggctgcaggaattcgcacgagaccattacctagaacatcctaattgaaaacttttaatttcatttcctctcttttgacgacggaaacgaggcacgatcacacgctgaacgcttccgccccgccgccaccttccccgctctcctccctccgctcgcctccgcttccgttccgcgccctgcccccggaaggcaagcaaagccctcgctacttgcggagcgtcgttggtcaaaccctagcacacgtacgagcaggccagccccgcccgctcccattcccaggccctcatccatggcggcgctctccgtgcccctccacgccgccgccggatcccgcgccgccgcggccgaccccgtcaaggttccgtgcgtgaggagcactggttcagcccatttcggccgcgccttcccctccgtcgcggtctcctctttggctgcgaggcacatcgagccgatgagagcgatagctacacaggcgccccctggccgtgcacaatatttgagtggcgagaagacaaagatcggcatcaacggcttttggcggattggcaggttggtcctgcgaattngcactagcagagacgatttggaaagttgtggctgtgaatgacccccttcgtgatgctaagacatggcctattatgtcagtatgactctactcatggcccgttaaagggtcta

SEQ ID NO: 13269 - protein, 105 aa, Zea mays
  misc_feature: Ceres CLONE 1373641-F
  misc_feature: SWISSPROT Homolog: EC 1.2.1.12 Glyceraldehyde-3-phosphate dehydrogenase (phosphorylating)
  misc_feature (93)..(93): Xaa is any aa, unknown, or other
MAALSVPLHAAAGSRAAAADPVKVPCVRSTGSAHFGRAFPSVAVSSLAARHIEPMRAIATQAPPGRAQYLSGEKTKIGINGFWRIGRLVLRIXTSRDDLESCGCE

SEQ ID NO: 13270 - DNA, 719 bp, Zea mays
  misc_feature: Ceres CLONE 1373644-F
  misc_feature: Encodes the peptide sequence at SEQ ID NO. 13271
  misc_feature (597)..(597): n is a, c, t, g, unknown, or other
aaagctggagctccccgcggtggcggccgctctagaactagtggatcccccgggctgcaggaattcgcacgagaccattacctagaacatcctaatcgaaaattcccctccctgcctcctcgtctcctcggtctcccctccctgtcttccagagacacagagcagggcgctcttcggtcggaggagaagcgcgaccacgaccatgggctttatctcgttcgtcggccgggttctcttcgcctccctcttcctcctctcggcctaccaagagttcattgaatttggaaatgacggtggacctgcagcgaagaccttgaagccaaagttcaatttgttcgtcaagctagtgtccaagaatactggactggggctgccgcatatggatataaaaactgtcattgcagctaccatgtttcttaaaggctttggtggtcttctgttcatagtcagcagctcatttggagcattcctcctggttagcatctaagtattgtttttttctggcatgcttaatgtcttgtgtttaaaaacataaagggcttatagaggtaattggcaaaaaagtactaaatatactctcatatgtaatttactaantgagtactctggcgcatttctcccaagtgacatctggatgtcaagatttcttgtagcatgtctttctcaacatcaaactatttgctcatttacttgggcgttataaccctattgtgtatgat

SEQ ID NO: 13271 - protein, 94 aa, Zea mays
  misc_feature: Ceres CLONE 1373644-F
  misc_feature (1)..(94): Pfam Name: HR_lesion Pfam Description: HR-like lesion-inducing
MGFISFVGRVLFASLFLLSAYQEFIEFGNDGGPAAKTLKPKFNLFVKLVSKNTGLGLPHMDIKTVIAATMFLKGFGGLLFIVSSSFGAFLLVSI

SEQ ID NO: 13272 - DNA, 685 bp, Zea mays
  misc_feature: Ceres CLONE 1373645-F
  misc_feature: Encodes the peptide sequence at SEQ ID NO. 13273
  misc_feature (208)..(208): n is a, c, t, g, unknown, or other
  misc_feature (650)..(650): n is a, c, t, g, unknown, or other
aaagctggagctccccgcggtggcggccgctctagaactagtggatcccccgggctgcaggaattcgcacgagaccattacctagaacatcctaatcgaaaaaataaaaaaaaatccgtcttcttgtggtcttctccaaaccctagcgcccccggccccggtctccgcccccccgctttcgccgtcgcggtcgcgccccatggcgggnaagtcgcgaccgcccaagcggatcctcgagtcctataccatcaagggttcggacagagtcatcaagcctggcgattgcgtgctaatgagggcatctgatgcttcaaagccaccttatgtggcaagagttgaggcaattgaagcagcaggatctcgaggcaccaatgtgagagtacgagtgcggtggtattatcgaccagaggagtccataggtggtcggcggccatttcatgtttcccaagaggttttcctctctgaccactatgatgtacaaagtgctgacaccatttgagggaaaatgcatgtccacagcttccgtagctatacaaagcttgattctgtcaatggtgaggatttcttctgccgcttcgagtataaatcagctactggcagttttgaacaattcggtatagcagtgtttttgcaagtgcgagatgcatacnatcccgatgaacttatggatcatggggaggaatgt

SEQ ID NO: 13273 - protein, 99 aa, Zea mays
  misc_feature: Ceres CLONE 1373645-F
  misc_feature (22)..(100): Pfam Name: BAH Pfam Description: BAH domain
  misc_feature: SWISSPROT Homolog: EC 2.1.1.37 DNA (cytosine-5-)-methyltransferase
MAGKSRPPKRILESYTIKGSDRVIKPGDCVLMRASDASKPPYVARVEAIEAAGSRGTNVRVRVRWYYRPEESIGGRRPFHVSQEVFLSDHYDVQSADTI

SEQ ID NO: 13274 - DNA, 724 bp, Zea mays
  misc_feature: Ceres CLONE 1373648-F
  misc_feature: Translation starting site: 179
  misc_feature: Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (393)..(393): n is a, c, t, g, unknown, or other
  misc_feature (412)..(412): n is a, c, t, g, unknown, or other
  misc_feature (470)..(470): n is a, c, t, g, unknown, or other
tggagctccccgcggtggcggccgctctagaactagtggatcccccgggctgcaggaattcgcacgagaccattacctagaacatcctaatcgaaaaatcacactcgccaaccccgtcatcgatctcgtttcaaatccatccatcctcgtttcctccgtcccgcagcatctcaaccccatggccaagatcaagatcgggatcaatgggttcggcaggatcggaaggctggtggccagggtggctctgcagagtgacgatgtcgagctcgtcgccgtgaacgaccccttcatcagcaccgactacatgacctacatgttcaagtacgacactgtacacggacagtggaagcaccatgaagtcaaggtgaaggactccaaaacccttctctttgntgagaaggaggttgctgtngtttggctgcaggaacccctgagagatccccgtgggggttcggtggtgctgaatatgntgttgagtctactggtgttttcactgaccaggagaaggctgcagctcacttgaagggtgttgccaagaaggttgccattcctgttctagcaggatgccccctgtttgccgttggggcaccaaaagggtacaagtctgactttacattggctccaggttaagtggaaaaccaatggcttggccctttggaaaggcatcagggaaatttcggatacgtgaaggtttgaggaccctggcctgcattatggtacccaa

SEQ ID NO: 13275 - DNA, 697 bp, Zea mays
  misc_feature: Ceres CLONE 1373651-F
  misc_feature: Encodes the peptide sequence at SEQ ID NO. 13276
  misc_feature (196)..(196): n is a, c, t, g, unknown, or other
aaagctggagctccccgcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccngtccgcaaacggcgccaccgccgccgccgccgccgcgagggacgacatgtccccggcggaggccaggctggcgatgatggagctggcgaacatggtgtcggtgctgatggcgctggcggccgtgatccggctgggcgtgccggccgcggtgtgggcgggcggggccaacgcgcccatgtcagggggcgacctccttcccggcgggccaccccggacccgtcccgtcctggagcggatgctccggctgctgggggtcccgcggggtttttcctcaaagtccccgagtccaccccccaccagcggggggggggttatttcccctcaccccgggggggccccaccctggggggccgggccccccctccgggggggtgccaacccccgaaataagtgttgaaacccccccagaaaccttttggggggggggggggcccccccctgcaaaggtccgtgtttttacccgcggggcccccaagcggtttcggggccacaaaggggggg

SEQ ID NO: 13276 - protein, 116 aa, Zea mays
  misc_feature: Ceres CLONE 1373651-F
MSPAEARLAMMELANMVSVLMALAAVIRLGVPAAVWAGGANAPMSGGDLLPGGPPRTRPVLERMLRLLGVPRGFSSKSPSPPPTSGGGVISPHPGGAPPWGAGPPLRGGANPRNKC

SEQ ID NO: 13277 - DNA, 734 bp, Zea mays
  misc_feature: Ceres CLONE 1373653-F
  misc_feature: Encodes the peptide sequence at SEQ ID NO. 13278
  misc_feature (358)..(358): n is a, c, t, g, unknown, or other
  misc_feature (434)..(434): n is a, c, t, g, unknown, or other
  misc_feature (483)..(483): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (607)..(607): n is a, c, t, g, unknown, or other
  misc_feature (665)..(665): n is a, c, t, g, unknown, or other
  misc_feature (709)..(709): n is a, c, t, g, unknown, or other
  misc_feature (711)..(711): n is a, c, t, g, unknown, or other
aaagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccngcggtccacctgccaccgccggtccatgtgccgccgccggttcatctgccgccgccaccatgccactaccctactncaccgccccggcctcagcctcatccccagccacacccatggccgtgccnacagccgcatccaagccccgtgcagctgcagggaacctgcgnnncgtgcagcaccccgatccctgggcagtgcgtcgagttcctgaggcatcagtgcagcccgacggcgacgccctactgctcngctcagtgccagtcgtttgcgcagcagtgttgcagcagctcaggcaggtgagccgcancacgggtacaggggatcttcgttggtcctccagtccatctgganancaagcgaaagcggcaggtcgggg

SEQ ID NO: 13278 - protein, 87 aa, Zea mays
  misc_feature: Ceres CLONE 1373653-F
  misc_feature (19)..(19): Xaa is any aa, unknown, or other
  misc_feature (46)..(46): Xaa is any aa, unknown, or other
  misc_feature (65)..(65): Xaa is any aa, unknown, or other
  misc_feature (80)..(80): Xaa is any aa, unknown, or other
MAVPTAASKPRAAAGNLRXVQHPDPWAVRRVPEASVQPDGDALLLXSVPVVCAAVLQQLRQVSRXTGTGDLRWSSSPSGXQAKAAGR

SEQ ID NO: 13279 - DNA, 622 bp, Zea mays
  misc_feature: Ceres CLONE 1373657-F
  misc_feature: Encodes the peptide sequence at SEQ ID NO. 13280
  misc_feature (392)..(392): n is a, c, t, g, unknown, or other
aaagctggagctccccgcggtggcggccgctctagaactagtggatcccccgggctgcaggaattcgcacgagaccattacctagaacatcctaatcgaaaaatttgcagattactctacacgagtcacgataggaggaagactggaagaggaggcgagcacgtttgcggtgcccaccctcaccgtccactccagaaccccaaatccagttccgttccaatcgccgagaagggcagcaaaggggagaaaaaaaaggaaatctatggcggcggccggcggcgagaacagcggcgctggcgagggcgagggcgagttctacctgcgctactacgtgggacacaagggcaagttcgggcacgagttcctcgagttcgagttcggccgcgacggcnagctccgctacgccaacaactcccactacaagaacgacactatgatccgcaaggaggtcttcgtctcggcctccgtcctccgcgaggccaggaggatcatccaggagtccgacatcatgaaggaggacgacagcaactgggccgagcccgaccgcatcggcccgcaggagctcgagatcgtcatgggcacgagcacatttcattcacactttcaagatcggctccctcgg

SEQ ID NO: 13280 - protein, 120 aa, Zea mays
  misc_feature: Ceres CLONE 1373657-F
  misc_feature (17)..(120): Pfam Name: Mago_nashi Pfam Description: Mago nashi protein
  misc_feature (44)..(44): Xaa is any aa, unknown, or other
MAAAGGENSGAGEGEGEFYLRYYVGHKGKFGHEFLEFEFGRDGXLRYANNSHYKNDTMIRKEVFVSASVLREARRIIQESDIMKEDDSNWAEPDRIGPQELEIVMGTSTFHSHFQDRLPR

SEQ ID NO: 13281 - DNA, 662 bp, Zea mays
  misc_feature: Ceres CLONE 1373659-F
  misc_feature: Encodes the peptide sequence at SEQ ID NO. 13282
  misc_feature (464)..(464): n is a, c, t, g, unknown, or other
  misc_feature (465)..(465): n is a, c, t, g, unknown, or other
  misc_feature (570)..(570): n is a, c, t, g, unknown, or other
aaagctggagctccccgcggtggcggccgctctagaactagtggatcccccgggctgcaggaattcgcacgagaccattacctagaacatcctaatcgaaaaaatgcggcgcctccactttgcgatgcccgcgtcctcgctcccctccccatcctcctcatctaccgtgctctccattccccacccgctcccaccgccgctcgcagatgccgcccaaggtggtcgccgtcgccgcgggcgaggcccacacactcgccctcacgggtgacgggcaggtgtactcctggggcagggggccgttcggtcgcctcgggaacggccgcgaggacgacaagctggtccccaccgcggtggcgcccgcggtctctgccagcgggaggccgcggcccaggttcgtcgccgtcgcggctggtgcctaccacagccttgcgctggacgatgaaggttcactctggtcatggggnntacatctctatggtcaactgggctatggggacagaattccctttttccatggttcgtgagcagtttcaggaatttagttctctgaacactggatgggtgagaccnaaaaccgtggtcgactgtggttgaggtggcttcggcccagctgggggatgaatgccctgccataaaaggttggggagccttggatgggggga

SEQ ID NO: 13282 - protein, 105 aa, Zea mays
  misc_feature: Ceres CLONE 1373659-F
  misc_feature (21)..(76): Pfam Name: RCC1 Pfam Description: Regulator of chromosome condensation (RCC1)
  misc_feature: SWISSPROT Homolog: EC 2.7.11.1 Non-specific serine/threonine protein kinase
  misc_feature (87)..(87): Xaa is any aa, unknown, or other
MPPKVVAVAAGEAHTLALTGDGQVYSWGRGPFGRLGNGREDDKLVPTAVAPAVSASGRPRPRFVAVAAGAYHSLALDDEGSLWSWGXHLYGQLGYGDRIPFFHGS

SEQ ID NO: 13283 - DNA, 739 bp, Zea mays
  misc_feature: Ceres CLONE 1373663-F
  misc_feature: Encodes the peptide sequence at SEQ ID NO. 13284
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccaccagggccagccgtgggagaccccagagtgcatgaagcggtgccgccgccgcggactggccgtcgacatggagcaagagtacggtcgcggcagcgagagcgcgggcaagtgcccggagaagtgcgagcgccaccaccgcgggactggtgggagagcaccgctgcctgatgactgcaaaaaacccggaagcggaaggaagagggcgccaccgccgc

SEQ ID NO: 13284 - protein, 175 aa, Zea mays
  misc_feature: Ceres CLONE 1373663-F
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHQGQPWETPECMKRCRRRGLAVDMEQEYGRGSESAGKCPEKCERHHRGTGGRAPLPDDCKKPGSGRKRAPPP

SEQ ID NO: 13285 - DNA, 740 bp, Zea mays
  misc_feature: Ceres CLONE 1373665-F
  misc_feature: Encodes the peptide sequence at SEQ ID NO. 13286
  misc_feature (442)..(442): n is a, c, t, g, unknown, or other
  misc_feature (728)..(728): n is a, c, t, g, unknown, or other
aaagctggagctccccgcggtggcggccgctctagaactagtggatcccccgggctgcaggaattcgcacgagaccattacctagaacatcctaatcgaaaaacggccaatgcaattgcagttgcagttgcaattgcacggcacccatttccagagccgtcctcaattagctagtcaaatctcgctatcctttccccaccatccagatcttccctttcatggacgccgccgtctccaccctcaccgctctcgccatcttcgcgagcaccgtcgagcacgccgcctacaggagcgtgcaggggtatagggtggtcgggaggaaaggcggcgggtgggtccgttgggagaggtgggtggagcggcagttcgtcctctccctctccttcccacggtgcgtcgaggttgccctgcccgccgccgcgccgcggatactgccagcggngtggcgcagccggccggtgttccgcgagggacagaccgtcgacacttggcgttgcattgtggcattcgactccgtcgccgccgtcgctccgtcctccccgccgccgcccgtgctctcccccttcgtgaacccacagctgcagtatctgtctaatctgtacatgacctgctgatgggtggttcggtttcgagaaagagaaacggccccacaactcgttaatcaaagcaccccatcccgttgtgtgaacagggaaacttctgatttgggggatgcatcggagtcgatncccgaatgggaa

SEQ ID NO: 13286 - protein, 131 aa, Zea mays
  misc_feature: Ceres CLONE 1373665-F
  misc_feature (75)..(75): Xaa is any aa, unknown, or other
MDAAVSTLTALAIFASTVEHAAYRSVQGYRVVGRKGGGWVRWERWVERQFVLSLSFPRCVEVALPAAAPRILPAXWRSRPVFREGQTVDTWRCIVAFDSVAAVAPSSPPPPVLSPFVNPQLQYLSNLYMTC

SEQ ID NO: 13287 - DNA, 742 bp, Zea mays
  misc_feature: Ceres CLONE 1373666-F
  misc_feature: Encodes the peptide sequence at SEQ ID NO. 13288
  misc_feature (457)..(457): n is a, c, t, g, unknown, or other
aagctggagctccccgcggtggcggccgctctagaactagtggatcccccgggctgcaggaattcgcacaagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcacaagctcctatagcttcccttcttcccccgtacctctcaccagtggtgtcttcggtatgtcaaaacccaattcttgaaccctacaggatccaacaggcaatcgcagctggcatcttacctttatcacccttgttcctccaacaatcatcagccctattacagcagttacctttggtgcatttattggcacaaaacatcagggcacaacaactacnacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttctttcattcaaccaactggcagcattgaactctcctgcttatttacagcagcacaactaactacagcaggttgttgccgttctaccagcacgctgccgctaacgctggcaccctcttacaactgcaacaattgctgc

SEQ ID NO: 13288 - protein, 168 aa, Zea mays
  misc_feature: Ceres CLONE 1373666-F
  misc_feature (100)..(100): Xaa is any aa, unknown, or other
MAAKIFCLLMLLGLSASAATATIFPQCSQAPIASLLPPYLSPVVSSVCQNPILEPYRIQQAIAAGILPLSPLFLQQSSALLQQLPLVHLLAQNIRAQQLXQLVLANLAAYSQQQQFLPFNQLAALNSASYLQQQQLPFSQLPAAYPQQFLSFNQLAALNSPAYLQQHN

SEQ ID NO: 13289 - DNA, 801 bp, Zea mays
  misc_feature: Ceres CLONE 1373668-F
  misc_feature (1)..(1): n is a, c, t, g, unknown, or other
  misc_feature (319)..(319): n is a, c, t, g, unknown, or other
  misc_feature (409)..(409): n is a, c, t, g, unknown, or other
  misc_feature (421)..(421): n is a, c, t, g, unknown, or other
  misc_feature (422)..(422): n is a, c, t, g, unknown, or other
  misc_feature (461)..(461): n is a, c, t, g, unknown, or other
  misc_feature (462)..(462): n is a, c, t, g, unknown, or other
  misc_feature (477)..(477): n is a, c, t, g, unknown, or other
  misc_feature (481)..(481): n is a, c, t, g, unknown, or other
  misc_feature (498)..(498): n is a, c, t, g, unknown, or other
  misc_feature (511)..(511): n is a, c, t, g, unknown, or other
  misc_feature (534)..(534): n is a, c, t, g, unknown, or other
  misc_feature (585)..(585): n is a, c, t, g, unknown, or other
  misc_feature (624)..(624): n is a, c, t, g, unknown, or other
  misc_feature (651)..(651): n is a, c, t, g, unknown, or other
  misc_feature (652)..(652): n is a, c, t, g, unknown, or other
  misc_feature (751)..(751): n is a, c, t, g, unknown, or other
  misc_feature (752)..(752): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
naaagctggagctcaccgcggtggcggccgctctaaaacaagtggaacccccgggcttgcaggaattcgcacgagaccattacctagaacttcctaatcgaaaaacatcgacccagccatttcctcacccttcgttcaccacacagtccgccactccttttagtaagctttgtgattttgtacgtcgaacgagatcacttggtcgggtggcggacgaacgacacatggggaagggtaatgtgggtgcattcatggtgggcgttccttcctgctcgccggcgtgctgcttggtcgtaagcagccacggccggggcggagngacggagtggtcgaacgggaccgcaaggaggaacctgcggtggtgcaagcaaggcgtgcgagtggcagtacggaaaggacacccccgcgnaaaaggaatgcnnagagcgagtgccgcgagcggcaccagcaagctgacgcgnngcgaggacggcgacnagcnggcgtgggacgcctacngtctccgctccgnaaaaaaggggcgaagtgcccggncgccagtgccctgcgcccgccacgaagggccaggccgtgggagaacccagnagtgcccatgaaggcggtgcccgccgccgcgggactggnccgtcgacatgggagcaaagagtacgnngtcgcgcagcgagaaccgcgggcaaggggcccgggaaagaggtgcgagcgcccacaacgccggggaccttgggtgggagaagcagcgctcctatgatgnnaaaaaaaccnnnncggggggggnnnaaaaaaaaaggcccgcacgccccc

SEQ ID NO: 13290 - DNA, 587 bp, Zea mays
  misc_feature: Ceres CLONE 1373668-R
  misc_feature: Encodes the peptide sequence at SEQ ID NO. 13291
cgattgggtaccgggccccccctcgaggtcgacggtatcgataagcttttttttttttttttttggagaaggcgccctttacttatttattattatagcacatttcacttacacagtctctcaactagtacaagcgtacttaggcaagacgtatacatgtcatgcatggaacaacatcacgaacacacgtacacagctagctctctcatcggagagccatggccgccgtacgcgcatgcagctaccactctttattcccacgtctccctacgaaggagcagtagcacttggtggatgggtccctggagactggagagtgccacgcccggtgacacgtacgtacgcggtaagcgtacactaccctttttatattagctctgcgccacggcatgcacgtcgtcgatcgtcacaccacctcaaggatggggccggccacccgtttccaagccacgggccccggggggaattccgggcacgaccttgcggctggtttggccaaaacccccgggggggtttcttgggaaattttttttcccaacccggtcccccgggggtgggggccccctcctaaaagggtcctcccgggg

SEQ ID NO: 13291 - protein, 111 aa, Zea mays
  misc_feature: Ceres CLONE 1373668-R
MQLPLFIPTSPYEGAVALGGWVPGDWRVPRPVTRTYAVSVHYPFYISSAPRHARRRSSHHLKDGAGHPFPSHGPRGEFRARPCGWFGQNPRGGFLGNFFSQPGPPGVGAPS

SEQ ID NO: 13292 - DNA, 676 bp, Zea mays
  misc_feature: Ceres CLONE 1373673-F
  misc_feature: Translation starting site: 157
aaagctggagctccccgcggtggcggccgctctagaactagtggatcccccgggctgcaggaattcgcacgagaccattacctagaacatcctaatcgaaaaagccgcatcccttctttcattcgccgccgccgcctgctctctgctgccgtcgccatggggagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgaggctgcccgtattgcctgcaacaggacatgaccaagtctgcaggagaggatgccttccaccttcgggtccgggttcaccccttcatgtccttcgtatcaacagatgctttcgtgtgctggggctgataggctccagactgggatgaggggtgcctttggcaagcctcagggcacctggggctaggggggacatgggtccaggtcctcttttctggtcaatgcagggacaacaatggctgacatgccagtgaaactctgcgtcccgcccagttcggggtcccctggccggcaaaagatatttgggggcggagagtggggctttc

SEQ ID NO: 13293 - DNA, 676 bp, Zea mays
  misc_feature: Ceres CLONE 1373674-F
  misc_feature: Encodes the peptide sequence at SEQ ID NO. 13294
aaagctggagctccccgcggtggcggccgctctagaactagtggatcccccgggctgcaggaattcgcacgagaccattacctagaacatcctaatcgaaaattcgggatcgggacgcggagaggggaaaggcgagtcgtcgactcgtcgtccgggcagcttccctccctctcctctccgcccccgcttacctaggccggccccgcctacgcccccctcccgccgccgcacgatgagcacttctcccgccgccgccgacgtttcgcctttgccgcctactgctgccgccgacgaggccgcgcgggcgacagagacggtggtggtcgatgagagggtcgcctcacacgtggacccgttcctcgtcgaggcgctcgaggggcctcgccaccgtctcatggttctacggatggaactggatatacaaaactttatgcagaaccctcagctgcaggagtttgaattccagaactttccgacttcttacctccgctgtgctgctcatcgtgttgcacaacattatggcttagagactataggtagcagatagttgagtagagggctcagttagcaggattgttgcaagaaaaacggcagaaggggggtatcctgcaatttttttatcagaaggttctagcaatcaggcaagaaatgatcatggaaccggctgagaagctta

SEQ ID NO: 13294 - protein, 104 aa, Zea mays
  misc_feature: Ceres CLONE 1373674-F
MSTSPAAADVSPLPPTAAADEAARATETVVVDERVASHVDPFLVEALEGPRHRLMVLRMELDIQNFMQNPQLQEFEFQNFPTSYLRCAAHRVAQHYGLETIGSR

SEQ ID NO: 13295 - DNA, 644 bp, Zea mays
  misc_feature: Ceres CLONE 1373682-F
  misc_feature: Encodes the peptide sequence at SEQ ID NO. 13296
  misc_feature (213)..(213): n is a, c, t, g, unknown, or other
  misc_feature (225)..(225): n is a, c, t, g, unknown, or other
  misc_feature (226)..(226): n is a, c, t, g, unknown, or other
  misc_feature (600)..(600): n is a, c, t, g, unknown, or other
caaagctggagctccccgcggtggcggccgctctagaactagtggatcccccgggctgcaggaattcgcacgagaccattacctagaacatcctaatcgaaaactctgtctctctagggtttttgattttagccgccgccgctgctcatctcacatccctcgagaagacgcctgctactcgccgatcgatacgatggccgtcttctccgaccntccaccaccggnnccgaaggggccctccaaggtcccctccgggggttcccccccccccggggaaaaaaccctatggggggttgggggggcccccctttaaaagggggggggacatttagggggttccccccgcgggggggcgcccaaaaaaacgggggggggggatttttttttttaaggcccccccccgggagagaaaaaacccccccctccgggggggggggcggccccaactatcccctggggggggggggggggggggggggagaaaaaaaggggggggggggaggaaaaacccccgcgcgccggggggtttctttttcttttccccggggggggggggggaaaaaaaagaaaaaagggccccccaccccccccttctttttnggtggaaaaaaaaaaaaaaaaaagaaaaaaagaaaaaaaaatta

SEQ ID NO: 13296 - protein, 103 aa, Zea mays
  misc_feature: Ceres CLONE 1373682-F
  misc_feature (71)..(71): Xaa is any aa, unknown, or other
  misc_feature (75)..(75): Xaa is any aa, unknown, or other
KAGAPRGGGRSRTSGSPGLQEFARDHYLEHPNRKLCLSRVFDFSRRRCSSHIPREDACYSPIDTMAVFSDXPPPXPKGPSKVPSGGSPPPGEKTLWGVGGAPL

SEQ ID NO: 13297 - DNA, 727 bp, Zea mays
  misc_feature: Ceres CLONE 1373683-F
  misc_feature (309)..(309): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (384)..(384): n is a, c, t, g, unknown, or other
  misc_feature (385)..(385): n is a, c, t, g, unknown, or other
  misc_feature (388)..(388): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (422)..(422): n is a, c, t, g, unknown, or other
  misc_feature (423)..(423): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (467)..(467): n is a, c, t, g, unknown, or other
  misc_feature (468)..(468): n is a, c, t, g, unknown, or other
  misc_feature (562)..(562): n is a, c, t, g, unknown, or other
  misc_feature (612)..(612): n is a, c, t, g, unknown, or other
  misc_feature (621)..(621): n is a, c, t, g, unknown, or other
  misc_feature (622)..(622): n is a, c, t, g, unknown, or other
  misc_feature (635)..(635): n is a, c, t, g, unknown, or other
  misc_feature (666)..(666): n is a, c, t, g, unknown, or other
  misc_feature (669)..(669): n is a, c, t, g, unknown, or other
  misc_feature (673)..(673): n is a, c, t, g, unknown, or other
  misc_feature (678)..(678): n is a, c, t, g, unknown, or other
  misc_feature (681)..(681): n is a, c, t, g, unknown, or other
  misc_feature (688)..(688): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (715)..(715): n is a, c, t, g, unknown, or other
aaagctggagctccccgcggtggcggccgctctagaactagtggatcccccgggctgcaggaattcgcacgagaccattacctagaacatcctaatcgaaaaagaaacaccaccaccaccacatacctgagttcctgtgaagtttatctgagttacctgacgaattagggtcctcttccccagatctggtggggaagaaccctacctcacgtcccggatcccatccggcggccaaggtgagttacacgctagccggcggtcggccagccgccgccaaccggctcagccccacagtcgcaccgccgccgncgagggcaaactcgaagccaccccgcccgcgcaggcannnnnnnnnnnnnnnngnnnnncccggggggggggggnnccnccccgaaaaaggcctttttggagacgcgcnnngnncccgcgttttgggggnnnttttccccccccgcnnnncccctttnnaaaatcgccccccatcggcctctcctggaaaaagaggagggaactttttatttgggggaaccgggctggcccttaaaaaaattttaaagaggcncccgagggtccccgggtgggggcccacaaggggattcttcctccccgganaaagggggnnaggtggggggggnaaactttctttttatttttgtgtagaagccnccnaganccccnctntttcttncccccnnnaaagaaaaaaatttggtgnaagagggccccc

SEQ ID NO: 13298 - DNA, 717 bp, Zea mays
  misc_feature: Ceres CLONE 1373684-F
  misc_feature: Translation starting site: 194
  misc_feature: Pfam Name: SSDP Pfam Description: Single-stranded DNA binding protein, SSDP
caaagctggagctccccgcggtggcggccgctctagaactagtggatcccccgggctgcaggaattcgcacgagaccattacctagaacatcctaatcgaaaatcccacgagcgccccccctgccctgcccatttcgctctcctccctaggcaactaaacgccgcgctcccgcagacggtaccagccgccgcgatggggtcctcgtcctcgccaccgccaccaccgccgctgccactgcccatgattgggcgggccgggaacctcaccatcttcatcacgccgccatcccccgctagcacgccccggggcgctgggcgcacgccgccgctcgagtccccgcgctcggatatctccacacccatcccgcagagggcagccccgtcgccctccctttctccctctccgcggaaccacgagagccgggccgtggcgcctgcggtggtggtcaccccgcccccggcgcctgtttctgggaatgtcccgctgcccgcggtgcagggggccgccccccaaaacaaaaaggctcccggggggggaaagattagataaacggggttcgcttcttctgggaaccccctcgcgggggtccaaaaaccaaccagaccctccaaggaaaggtttaccggggttggggggggaacacccaaaaacccggggggggttaaaaaacaaacaaaaccctttgggggggcccggggggcctgggttttctaaat

SEQ ID NO: 13299 - DNA, 735 bp, Zea mays
  misc_feature: Ceres CLONE 1373687-F
  misc_feature: Encodes the peptide sequence at SEQ ID NO. 13300
  misc_feature (552)..(552): n is a, c, t, g, unknown, or other
  misc_feature (583)..(583): n is a, c, t, g, unknown, or other
  misc_feature (598)..(598): n is a, c, t, g, unknown, or other
  misc_feature (673)..(673): n is a, c, t, g, unknown, or other
aagctggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtctggcctgctccttatctctgggcctttcaagatcaatggagtaccgatccgccgtgtgaaccagacctatgtcattgctacatcnaccaaaggtgacatctctgggtgtgatgtcngccagtttgatgacnagtactttgcccaggagaagaagcagaaggtgaagaagacgagggcgagctttttagacagaaaagaggcatccnagtcactggctgactttcagaggatgaccagagggctgtggattctgctctgatcaagctat

SEQ ID NO: 13300 - protein, 186 aa, Zea mays
  misc_feature: Ceres CLONE 1373687-F
  misc_feature (112)..(175): Pfam Name: Ribosomal_L6e Pfam Description: Ribosomal protein L6e
  misc_feature (1)..(49): Pfam Name: Ribosomal_L6e_N Pfam Description: Ribosomal protein L6, N-terminal domain
  misc_feature (140)..(140): Xaa is any aa, unknown, or other
  misc_feature (145)..(145): Xaa is any aa, unknown, or other
  misc_feature (170)..(170): Xaa is any aa, unknown, or other
MAPTSKLSTGIKRASRSHTYHRRGLWAIKAKNGGAFPKADKAAAAVEPKFYPADDVKPRVPSTRKPKPTKLRSSITPGTVLILLAGRFMGKRVVFLKQLKSGLLLISGPFKINGVPIRRVNQTYVIATSTKGDISGCDVXQFDDXYFAQEKKQKVKKTRASFLDRKEASXSLADFQRMTRGLWILL

SEQ ID NO: 13301 - DNA, 751 bp, Zea mays
  misc_feature: Ceres CLONE 1373688-F
  misc_feature: Encodes the peptide sequence at SEQ ID NO. 13302
  misc_feature (425)..(425): n is a, c, t, g, unknown, or other
  misc_feature (571)..(571): n is a, c, t, g, unknown, or other
  misc_feature (636)..(636): n is a, c, t, g, unknown, or other
  misc_feature (657)..(657): n is a, c, t, g, unknown, or other
  misc_feature (691)..(691): n is a, c, t, g, unknown, or other
aaagctggagctccccgcggtggcggccgctctagaactagtggatcccccgggctgcaggaattcgcacgagaccattacctaagaacatcctaatcgaaaattcgggatcgggacgcggagaggggaaaggcgagtcgtcgactcgtcgtccgggcagcttccctcccttctcctctccgcccccgcttacctaggccggccccgcctacgcccccctcccgccgccgcacgatgagcacttctcccgccgccgccgacgtttcgcctttgccgcctactgctgccgccgacgaggccgcgcgggcgacagagacggtggtggtcgatgagagggtcgcctcacacgtggacccgttcctcgtcgaggcgctcgacaaccctcgccaccgtctcatggttctacggatggaactggatatacnaaactttatgcagaaccctcagctgcaggagtttgaattccagaactttccgacttcttacctccgctgtgctgctcatcgtgttgcacaacattatggcttagagactatagtagcagatagtttagtagaaggctcagttagcnagattggtgcaagaaaacagcagaaggcaggtatccctgcatttttttatcagaagttcctagcnatcagcaaggaatgatcatgnaacagctgaaaagctttaagtttgtcatttatcnaaggcccaaagcatcccaaaatgaaagcgctgatctaagaaacaaggagtgtggaccaaa

SEQ ID NO: 13302 - protein, 138 aa, Zea mays
  misc_feature: Ceres CLONE 1373688-F
  misc_feature (64)..(64): Xaa is any aa, unknown, or other
  misc_feature (113)..(113): Xaa is any aa, unknown, or other
MSTSPAAADVSPLPPTAAADEAARATETVVVDERVASHVDPFLVEALDNPRHRLMVLRMELDIXNFMQNPQLQEFEFQNFPTSYLRCAAHRVAQHYGLETIVADSLVEGSVSXIGARKQQKAGIPAFFYQKFLAISKE

SEQ ID NO: 13303 - DNA, 749 bp, Zea mays
  misc_feature: Ceres CLONE 1373690-F
  misc_feature: Encodes the peptide sequence at SEQ ID NO. 13304
  misc_feature (336)..(336): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
catagctggagctccccgcggtggcggccgctctagaactagtggatcccccgggctgcaggaattcgcacgagaccattacctagaacatcctaatcgaaaagtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcnggtcgatgctggtgctgtccgggctgatcctggccggcaccgtgatcgcgctcacggtggccacccccgtgctggtgactcgcgnnnntttttttgggggcggcccccccccttcgggttggcgttctggggcgggccggtttccgccacctccggggggctcggggtcccctggcgttggcccgtgtttccctgggatgggccaggacacctggaagggcaaagcacccggcggggcggcgaacaagttgggacacggccaagggggggggttgggggtccaagggcccgggaatttcaggggtggaggaacagcacccgttccgacagggggggaggggtcctgggagaaaaaaaccaacctcgaggggggacggggggggggactctccttgaaccagtgggcggggggg

SEQ ID NO: 13304 - protein, 188 aa, Zea mays
  misc_feature: Ceres CLONE 1373690-F
  misc_feature (51)..(51): Xaa is any aa, unknown, or other
  misc_feature (79)..(79): Xaa is any aa, unknown, or other
  misc_feature (80)..(80): Xaa is any aa, unknown, or other
MADHHRGATGGGGGYGDLQRGGGMHGEAQQQQKQGAMMTALKAATAATFGXSMLVLSGLILAGTVIALTVATPVLVTRXXFFGGGPPPSGWRSGAGRFPPPPGGSGSPGVGPCFPGMGQDTWKGKAPGGAANKLGHGQGGGLGVQGPGNFRGGGTAPVPTGGEGSWEKKTNLEGGRGGGLSLNQWAGG

SEQ ID NO: 13305 - DNA, 557 bp, Zea mays
  misc_feature: Ceres CLONE 1373691-F
  misc_feature: Encodes the peptide sequence at SEQ ID NO. 13306
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (268)..(268): n is a, c, t, g, unknown, or other
  misc_feature (269)..(269): n is a, c, t, g, unknown, or other
  misc_feature (308)..(308): n is a, c, t, g, unknown, or other
  misc_feature (309)..(309): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (370)..(370): n is a, c, t, g, unknown, or other
aaagtgggtcaccgcggggggcgctctaaactagggaccccggctgaggaattccacgagaccttacctagaacatcctaatcgaaaaaattagccagcccacctctgctctgcgggcgcttcagatggaagcactagccattggatccgcgcctcgccgtccggggcgcaaggtaactccccaactccggccgcccccggaaccctcgccgtcaccaccacagccacagttgcatgcccgccccccttccacgggggnnnnnnnggnnccccccctttttccccaattggggacggcccggcccccnnttttttggcggccgagcccnnnnnnnnngcgctatcgctgcacaggcgcgagacgactcgntgggatgagtcgcgacgagctcccacgccgcggagcccacggcgggggggaccacggagcagaagggaacggagagccccgggccgccctttcccggaattccccccggggtccccggggttaaaaagaataaagaacccggggggggccccggaaaggggcccccggggggaataaagggggcccc

SEQ ID NO: 13306 - protein, 39 aa, Zea mays
  misc_feature: Ceres CLONE 1373691-F
MSRDELPRRGAHGGGDHGAEGNGEPRAALSRNSPRGPRG

SEQ ID NO: 13307 - DNA, 725 bp, Zea mays
  misc_feature: Ceres CLONE 1373693-F
  misc_feature: Encodes the peptide sequence at SEQ ID NO. 13308
aaagctggagctccccgcggtggcggccgctctagaactagtggatcccccgggctgcaggaattcgcacgagaccattacctagaacatcctaatcgaaaaacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcggatacgcgatgggcagcgcggcgtcgccctccgcggagtgctgcagcggggtgcgctcgctcaacagccgcgcgtcgtcgacggcggaccggtaggccacctgcaactgcctcaagagcatgacgggccggctcggcggcggcgtcaagatggccaacgtcgacacatcccctccaagtgcgcgtctccgtcggtgcacccatcagccccacggcgactgcacaagatcactgatcgatggaacataggggagtagctcgctcgttggagggaccgtacgtgccattacaccatgcaatctgctcctacagaaattcctaggtagtggtgggtttgctcagacggcacatataataaggaaatctgccccccccactagtgacccttcccaag

SEQ ID NO: 13308 - protein, 81 aa, Zea mays
  misc_feature: Ceres CLONE 1373693-F
MAARSSSSQPQLVAAAAVLAAALLLLAAGAGTASAAVSCGEVTSSVAPCLGYAMGSAASPSAECCSGVRSLNSRASSTADR

SEQ ID NO: 13309 - DNA, 688 bp, Zea mays
  misc_feature: Ceres CLONE 1373695-F
  misc_feature: Translation starting site: 388
  misc_feature: Pfam Name: STT3 Pfam Description: Oligosaccharyl transferase STT3 subunit
  misc_feature: SWISSPROT Homolog: EC 2.4.1.119 Dolichyl-diphosphooligosaccharide--protein glycotransferase
  misc_feature (499)..(499): n is a, c, t, g, unknown, or other
  misc_feature (529)..(529): n is a, c, t, g, unknown, or other
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaagcctgggtccagcactcggatttccgcgcgttccacttccacccacacacacacacacaccaaaggacgcaggccgcaatggcggagtccaggtctcccccgcagcggccggcggcggcgggcggctccgcaacgccttcgggggcgtgctctgcgccttcacgcttctcctcatcggcgtcgttgccttctcgatccgtctcttctccgtaatcaagtacgagagcgtgatccacgagttcgacccctacttcaacttccgcgtcactcagtttctggtcaagaatggaatttatgagttctggaactggtttgatgataggacatggtaccccttggccgtgtgatcggtggcactgtgtatcctggggtgacttgactgctggaactatggggngggtgctgaactcttctaacatcccattgncgggggagacgggttgtggggtcccagctcccattttcccagcaaaggcatcatgggcctacttacctgcttaaaaaaggaaacaaaaggtacctggagctggttaaagggcanaccccattttaagaaagggcccccccaaatttttaaaaaattgtg

SEQ ID NO: 13310 - DNA, 660 bp, Zea mays
  misc_feature: Ceres CLONE 1373696-F
  misc_feature: Encodes the peptide sequence at SEQ ID NO. 13311
  misc_feature (287)..(287): n is a, c, t, g, unknown, or other
aaagtggagtccccgcggtggcggccgctctagaatagtggatcccccgggctgcaggaattcgcacgagaccattacctagaacatcctaatcgaaaaaaaaaggaaagctctctcattgccaaattgcccccgactcaagccccccgcgccgccggcgttggtggaatcgatcgacccggcctcgccggacaatccaccagcgttggtttcacctcaggtttttgtgcatggaagatgacaatgaggtcactggagagtcacctgtggctgatgaatgggatatngtgtccctgactttcatcatatatgctagcccattattccgaagaagattgatccatttatttgcctggatatgggaatgtgattaatattcaggaaggcacacaactggattagtcatggcagatggcttccgtgtccctcccagtgagcatgaaaattggccataaaaaccagagatggggattttgccaataaaccggggggtggtggattcaataccaaacgcgtttaaaaggaaaaaaattttggctggaaaaaaaccaaaaaaaacgggggccagggttccccctgaaaaaaacccgggggccggagggatggagaaattttttttgtcaaaagggggttttgtccaacggcccgggagaaattccc

SEQ ID NO: 13311 - protein, 47 aa, Zea mays
  misc_feature: Ceres CLONE 1373696-F
  misc_feature (19)..(19): Xaa is any aa, unknown, or other
MEDDNEVTGESPVADEWDXVSLTFIIYASPLFRRRLIHLFAWIWECD

SEQ ID NO: 13312 - DNA, 762 bp, Zea mays
  misc_feature: Ceres CLONE 1373697-F
  misc_feature: Encodes the peptide sequence at SEQ ID NO. 13313
  misc_feature (1)..(1): n is a, c, t, g, unknown, or other
  misc_feature (517)..(517): n is a, c, t, g, unknown, or other
  misc_feature (608)..(608): n is a, c, t, g, unknown, or other
  misc_feature (621)..(621): n is a, c, t, g, unknown, or other
  misc_feature (691)..(691): n is a, c, t, g, unknown, or other
naaagctggagctccccgcggtggcggccgctctagaactagtggatcccccgggctgcaggaattcgcacgagaccatttacctaagaacatcctaatcgaaaaatcccaattggaagggcagctaataaggtaaggggcgacgaaaatggcttccaacgaccgccaccaaggacgacagtggctacggcgacgagcgccggcgcgagcttgcaggcgttcgacgacacgaagctgggggtgaaaggtctggtggactccggcgtcaagtccattcccgtccattcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtggcagtcagagnccccccccggggggagaggaaaaaaaagctcttttactcgaggggacctcgctcgaacctgcggtttcgccttccacttcgacctcttcanggctgcttgcggncgactggcgcgcacgtcttttttttgcgaggtggctccgaaccccgccccccgcgggaaggagctgccgnagccactcaggaacgttgatgctggagtaccggcgcggcggtacaaaaactttgggggcggttcgtgtttc

SEQ ID NO: 13313 - protein, 31 aa, Zea mays
  misc_feature: Ceres CLONE 1373697-F
KLELPAVAAALELVDPPGCRNSHETIYLRTS

SEQ ID NO: 13314 - DNA, 704 bp, Zea mays
  misc_feature: Ceres CLONE 1373699-F
  misc_feature: Translation starting site: 172
  misc_feature (370)..(370): n is a, c, t, g, unknown, or other
aaagctggagctccccgcggtggcggccgctctagaactagtggatcccccgggctgcaggaattcgcacgagaccatacctagaacatcctaatcgaaaaacgccttcgctcgcgccgccgccgccgacgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcagcaggcggcgccgagtagcggctccccacctcgagcttgccaccatggctagaggattgaagaagcatttgaagaggctcaatgcgcccaagcattgnatgctggacaagcttggcggagcttttgctcccagccatcttctggacctcacaggtctaggggagggcgtgcactgatcctcatcatcaggaacaggctcaagtatgctcttacataccggggaggcctttccatcctgaggcaacgccatgtactggttgatgggaagggccagaacaacaggacttaccctgggtgggttcctggaatggcatttcccttcccccagaacgagggggaacttacggggtgggggaacaatacccaaggggggggttttccgcttttcccccaagggggggaggggggggggctaaaggtcaaggtttttgc

SEQ ID NO: 13315 - DNA, 689 bp, Zea mays
  misc_feature: Ceres CLONE 1373701-F
  misc_feature: Encodes the peptide sequence at SEQ ID NO. 13316
  misc_feature (356)..(356): n is a, c, t, g, unknown, or other
tggagctccccgcggtggcggccgctctagaactagtggatcccccgggctgcaggaattcgcacgagaccattacctagaacatcctaatagaaaaaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccgaagcactgcttccggcgcggggccgatggctacctgtactgcgagggagtgcggntggaggacgcgatgacggctgccgagcgcagccccttctacctctacagcaagccacagatcctccgcaacttcgccgcctaccgcgatgctctccaggggctccgctccatcatcgggtatgccgtgaaaggcaacaacaacctccccgtgctacgcgtcctgcgtgagcttggctgcggcgccgtcctcgtcagcgggaacgagctccgactcgccctccaggggggattcgaccccggcaggtgcatattttacggagatgggagacactcgaacatctaaatagctgctgagagtggagtatttggaatggggatagggaatttgattg

SEQ ID NO: 13316 - protein, 177 aa, Zea mays
  misc_feature: Ceres CLONE 1373701-F
  misc_feature: SWISSPROT Homolog: EC 4.1.1.20 Diaminopimelate decarboxylase
  misc_feature (84)..(84): Xaa is any aa, unknown, or other
MASASMLARSLLRTPDPTQTSHPNRRSAAVVSFPRRHRRLSVRASVSTASPSPPPQPAAAAAGVPKHCFRRGADGYLYCEGVRXEDAMTAAERSPFYLYSKPQILRNFAAYRDALQGLRSIIGYAVKGNNNLPVLRVLRELGCGAVLVSGNELRLALQGGFDPGRCIFYGDGRHSNI

SEQ ID NO: 13317 - DNA, 740 bp, Zea mays
  misc_feature: Ceres CLONE 1373702-F
  misc_feature: Translation starting site: 146
  misc_feature (447)..(447): n is a, c, t, g, unknown, or other
  misc_feature (495)..(495): n is a, c, t, g, unknown, or other
aagctggagctccccgcggtggcggccgctctagaactagtggatcccccgggctgcaggaattcgcacgagaccattacctagaacatcctaatcgaaaaattcgcaccaccgccgcgccgcccaaatcacagccaccgccgccatggccgcctccagccgccctctcgtctccgtgaaggccctggagggcgacatggtcacggacgcccccggcatcgccttgccgcccgtcttcggtgcgccgatccgcccggacgtggtccgcttcacccacaagctgctgtcctgcaacaagcgccagccttacgcagtctcccgccgcgctggccaccagacgtcggccgagtcctggggtacgggccgcgctgtgtcccgtatcccccgcgtccccggcggcggcacccaccgcgccggccagggagcattcggcaacatgtgccgcgncggacgcatgttcgcgcccacaagatctggcgcaagtgggaccgcccngtcaacgtcaaccttccgccgggtcgccgtcgcctcggggctcgccgccaacgccgtccccggcctcgttcaggggggggggccaccggatcaaagacggtccaaaaaatgcccctggccatccttgactccgggggatccattaaaaaaacctccaagggggttcaaaatccttaagggggggctgggccctaacccaaccccaaaaaaggcagggatctcctcggaattcgccccgggaaaga

SEQ ID NO: 13318 - DNA, 733 bp, Zea mays
  misc_feature: Ceres CLONE 1373703-F
  misc_feature: Encodes the peptide sequence at SEQ ID NO. 13319
  misc_feature (259)..(259): n is a, c, t, g, unknown, or other
  misc_feature (577)..(577): n is a, c, t, g, unknown, or other
  misc_feature (616)..(616): n is a, c, t, g, unknown, or other
  misc_feature (653)..(653): n is a, c, t, g, unknown, or other
  misc_feature (698)..(698): n is a, c, t, g, unknown, or other
  misc_feature (733)..(733): n is a, c, t, g, unknown, or other
aagctggagctccccgcggtggcggccgctctagaactagtggatcccccgggctgcaggaattcgcacgagaccattacctagaacatcctaatcgaaaaatctcgtcgctcggctcccgaccgcatcgcgatcagtcatctcctgcgtctcgttctcgccggagatcagacgcgccaccgccgggcgatggatgcctcctaccgccgcgccggtgccggaagcggttctgctccccgctccgtcgaggacatctacnaggactaccgcgcccgccgctccgccgtcctccgcgccctcacccacgacgtcgaggagttctacgcgctgtgcgatccagagaaggagaacctgtgcctatacgggtacgcaaacgaagcgtgggaggtggcgctgccggcggaggaggtgcccacggagctgccggagcctgcgctcgggatcaacttcgcgcgcgacgggatgaaccgtcgcgactggctcgcgctcgtcgccgtccactccgactcgtggctcatatccgtcgcattctactacgccgcgcggctcagccgaagtgatcgtcgtctccggtggntgtgagcaatctaaggaaagggacagatccggtactgancacagtggtaaaaataactgtcagcaaagcaacaagncgagccacggttagaaaatatgcccaggaggctgacgaggctacnatgaagacgacggctaccacagcgagccttggggn

SEQ ID NO: 13319 - protein, 129 aa, Zea mays
  misc_feature: Ceres CLONE 1373703-F
  misc_feature (24)..(24): Xaa is any aa, unknown, or other
MDASYRRAGAGSGSAPRSVEDIYXDYRARRSAVLRALTHDVEEFYALCDPEKENLCLYGYANEAWEVALPAEEVPTELPEPALGINFARDGMNRRDWLALVAVHSDSWLISVAFYYAARLSRSDRRLRW

SEQ ID NO: 13320 - DNA, 715 bp, Zea mays
  misc_feature: Ceres CLONE 1373706-F
  misc_feature: Encodes the peptide sequence at SEQ ID NO. 13321
  misc_feature (524)..(524): n is a, c, t, g, unknown, or other
  misc_feature (544)..(544): n is a, c, t, g, unknown, or other
  misc_feature (545)..(545): n is a, c, t, g, unknown, or other
  misc_feature (552)..(552): n is a, c, t, g, unknown, or other
  misc_feature (553)..(553): n is a, c, t, g, unknown, or other
  misc_feature (563)..(563): n is a, c, t, g, unknown, or other
  misc_feature (639)..(639): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaatcgaaaaatctcttctgcctccgtctcaatctcgaccggtcaccccatctccaccgccacatccgtcgtcttccgccgccgccgatggcccgcctcctcacgcaaaccctcaccctagcccgccccgcctcctccccctccactaccgccgcatccgcttccctccgtggcctcgccaccaaggtcgagatcatcgagatcgatctcgccgaggaagacgctggctcctcgtcccacggctccccctcctcgtccccgtcggtcgaggcggtcgggatccggcgcctggaggaggccatccacggcgtcatggtgcgccgcgccgcgcccgactggctccccttcgtgccgggagggcccttctgggtgcccccgctgcgccgcccgcacggagtcgccgagctcgttggccggatcgcggctgctggnggcaccgaaggggcgtcggnnacgtttnnggggcggcgntcaaaatcttggagctcgacgcgcccatgacggaagaacagggcgttttggtttctcacaacgcgcggctgagcantcggctcttncttcgtcgaaggaaatctacacatttgaggaatcgaggaaagtgcaactcaactgatgatgaagaa

SEQ ID NO: 13321 - protein, 137 aa, Zea mays
  misc_feature: Ceres CLONE 1373706-F
  misc_feature (122)..(122): Xaa is any aa, unknown, or other
  misc_feature (125)..(125): Xaa is any aa, unknown, or other
MARLLTQTLTLARPASSPSTTAASASLRGLATKVEIIEIDLAEEDAGSSSHGSPSSSPSVEAVGIRRLEEAIHGVMVRRAAPDWLPFVPGGPFWVPPLRRPHGVAELVGRIAAAGGTEGASXTFXGRRSKSWSSTRP

SEQ ID NO: 13322 - DNA, 679 bp, Zea mays
  misc_feature: Ceres CLONE 1373707-F
  misc_feature: Encodes the peptide sequence at SEQ ID NO. 13323
  misc_feature (427)..(427): n is a, c, t, g, unknown, or other
aaagctggagctccccgcggtggcggccgctctagaactagtggatcccccgggctgcaggaattcgcacgagaccattacctagaacatcctaatcgaaaacccatttcgaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctcctctatcgacagcatcgtgaacgacagcgacgccgtcatggagccgggtgntgctgggcagcacacggtagtagctgttgcccaagtcgagttgcaaacaatgaacgtgcagcaaccggctgatgttgccggacccagcggaggggtgggcgcgatttccaaggggggaaaagtaggggccaaccggtgacaccctggaagaaaaaaggttgggctcacggaatcaacctggcggggggggaatttgtttgggggcttcccccttttcccaaaaagaagaagggaagtttcaataccgggggg

SEQ ID NO: 13323 - protein, 114 aa, Zea mays
  misc_feature: Ceres CLONE 1373707-F
  misc_feature (14)..(38): Pfam Name: zf-A20 Pfam Description: A20-like zinc finger
  misc_feature (69)..(69): Xaa is any aa, unknown, or other
MEHKEAGCQAPEGPILCINNCGFFGSAATMNMCSKCHKEMITKQDQAKLAASSIDSIVNDSDAVMEPGXAGQHTVVAVAQVELQTMNVQQPADVAGPSGGVGAISKGGKVGANR

SEQ ID NO: 13324 - DNA, 734 bp, Zea mays
  misc_feature: Ceres CLONE 1373709-F
  misc_feature: Encodes the peptide sequence at SEQ ID NO. 13325
aaagctggagctccccgcggtggcggccgctctagaactagtggatcccccgggctgcaggaattcgcacgagaccattacctagaacatcctaatcgaaaaagcgacaccgcgtggttcgttaggaaaggaaatcgatccccatctgatctcttcggtgctaaagaaatataggccgccgccgcctcctcattcggtgaaaggtgggcggttagggttgggagatctcttgactcacgacacgagcagcagaatttgtcgagggccgctggttgctgcgagaggtccgtaccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaaccacctgcattttcattttgatctccctaatccctccggctagctgctttccagtgaccaaaagatatcagagaccacttcccgtcttcctcccgtggcctgtctgtcatctggctctgaaacgatggcagtcctggcagttgctgctgctgcccctccccctgtctctgtgattgggttcgaggatttgagaagcgcctgagatcagcttctctgaa

SEQ ID NO: 13325 - protein, 51 aa, Zea mays
  misc_feature: Ceres CLONE 1373709-F
  misc_feature (1)..(51): Pfam Name: AdoMetDC_leader Pfam Description: S-adenosyl-l-methionine decarboxylase leader peptide
MESKGGKKKSSSSRSSLMYEAPLGYSIEDIRPAGGIKKFSAAYSNCARKPS

SEQ ID NO: 13326 - DNA, 666 bp, Zea mays
  misc_feature: Ceres CLONE 1373715-F
  misc_feature: Encodes the peptide sequence at SEQ ID NO. 13327
  misc_feature (260)..(260): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
aaagctggagctccccgcggtggcggccgctctagaactagtggatcccccgggctgcaggaattcgcacgagaccattacctagaacatcctaatcgaaaaacagtaactagcagctagcacatcaaacaagtggcgacagacaaagatttgtgagggtgatccgcgctgagaagagatggctaagatcgccgcggcggcggcggcggcgctgtgcttcgcggccctggtggccgtggccgtctgccaaggcgaggtcngagcggcagagggctcagggaactgcagtgctggcaggaggtccaggagagcccgctcgacgcgtgccgccaggtcctcgaccggcagctaaccggcggcggcggcggcggcggcgttggcccgttccggtggggcaccgggctccggatgcggtgctgccagcagctccgggacgtgagccgcgagtgccgctgcgccgccatccggagcatggtcaggggctacgaggagggcatgcccgcgctggagaaggctgtggccgtttgggggcggagcacagnnnnnnncgggggggggaaaaaggggggggacacgggggggtacaactacccctgccgccggccagtagagggataccggctaccggccgggttggccacggggaaatgtttccccccggggccg

SEQ ID NO: 13327 - protein, 86 aa, Zea mays
  misc_feature: Ceres CLONE 1373715-F
  misc_feature (45)..(45): Xaa is any aa, unknown, or other
  misc_feature (46)..(46): Xaa is any aa, unknown, or other
  misc_feature (47)..(47): Xaa is any aa, unknown, or other
MRCCQQLRDVSRECRCAAIRSMVRGYEEGMPALEKAVAVWGRSTXXXGGGKKGGDTGGYNYPCRRPVEGYRLPAGLATGKCFPPGP

SEQ ID NO: 13328 - DNA, 673 bp, Zea mays
  misc_feature: Ceres CLONE 1373717-F
  misc_feature: Encodes the peptide sequence at SEQ ID NO. 13329
  misc_feature (296)..(296): n is a, c, t, g, unknown, or other
  misc_feature (357)..(357): n is a, c, t, g, unknown, or other
  misc_feature (419)..(419): n is a, c, t, g, unknown, or other
  misc_feature (429)..(429): n is a, c, t, g, unknown, or other
aaagctggagctccccgcggtggcggccgctctagaactagtggatcccccgggctgcaggaattcgcacgagaccattacctagaacatcctaatcgaaaaaaaacacctccgatccgtccccgatcatcgcaccacctgtagcccacctcgctctcgagtctcgacccagcgacgagatggccgcggtggatctgaccccaaggacgcccaagaaggcctacggcggcgacggcggcgcctactacgagtggagccccgccgacctgcctatgctcgccgtcgcctccatcggngccgtcaagctctcgctcgccgccggtgtgctctctctccccagctactccgactccggcnaggtcgcctacgtcctacgaggcgtaggtacctgcggtctcgtcctccccgatgcgactaangataaggtgntggcagtgaaagacggcgacacgctggcgctggcctttcgggcggtgacgtggtggcacaacggccccggcggggagggcgaacttagggtgctctccctcggggacccctccagggccacaagagggggcaggtcaccaccttcgaggtccgggggccgcgggcatctttccgggctgtcccccaaattccggcccccgcggggaattgtgggggaccccaccccctagggttggggccaacc

SEQ ID NO: 13329 - protein, 159 aa, Zea mays
  misc_feature: Ceres CLONE 1373717-F
  misc_feature (6)..(132): Pfam Name: Cupin_1 Pfam Description: Cupin
  misc_feature (60)..(60): Xaa is any aa, unknown, or other
  misc_feature (80)..(80): Xaa is any aa, unknown, or other
  misc_feature (84)..(84): Xaa is any aa, unknown, or other
MAAVDLTPRTPKKAYGGDGGAYYEWSPADLPMLAVASIGAVKLSLAAGVLSLPSYSDSGXVAYVLRGVGTCGLVLPDATXDKVXAVKDGDTLALAFRAVTWWHNGPGGEGELRVLSLGDPSRATRGGRSPPSRSGGRGHLSGLSPKFRPPRGIVGDPTP

SEQ ID NO: 13330 - DNA, 672 bp, Zea mays
  misc_feature: Ceres CLONE 1373719-F
  misc_feature: Translation starting site: 175
  misc_feature: Pfam Name: BSD Pfam Description: BSD domain
  misc_feature (516)..(516): n is a, c, t, g, unknown, or other
  misc_feature (562)..(562): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
aaagctggagctccccgcggtggcggccgctctagaactagtggatcccccgggctgcaggaattcgcacgagaccattacctagaacatcctaatcgaaaagacggagacgtgtcactggcggcgttgagaagacagaagacttcagaccttctagattttttcccggccgcaatggatctctgggagagggcccgggccttcgccggcgaggcggcgaattggtcgcaggagctctccgcggaggcgaccaagcgctcgtctgcgctggtctcggagacggcgaagaagtcgaaggagatcttttccgagaccgcctccaagtcgctggagatcgccgccgaggcaaccaagcaggccgacctcctggccggccagatcaagcacctcgcctccgacatccccgtaccctcgatcccacccatccccgcgatcccacctatcgccgccactgcctcgtcggagcccgacgcggccgagcttgagcgctacggcatcaccgacgacctccgcgangtcgtcaaggacatgacccatagcacttccggcgacttccactggnagatgagcctgaaatgtctgatgtgccaacggggtccaatgtgcgtcacgatctgagcgaatggcaggccaggcacgccacacttggtctctcggcagtcaggcggnnnn

SEQ ID NO: 13331 - DNA, 668 bp, Zea mays
  misc_feature: Ceres CLONE 1373723-F
aaagctggagctccccgcggtggcggccgctctagaactagtggatcccccgggctgcaggaattcgcacgagaccattacctagaacatcctaatcgaaaattccccatctccggataaaagataaggagtgtctctcctttgccatcctcctctctttcagctaagtccctgccccctctctttttcttacattcaggtcctcgcagctcctctcttttttcttgtttctttcgatctgcgagccgtacaagtccagtactcttctttccctcaaggaactcttgcagccggcccctctggtttcctcgaattcttgttccccggtccctcctcctgtccccgcgtagatccgtccgtccgaggagcacaccgtccccacccccatgtttacccaccagttcctctgacggtcgacgtgctccgatgaagatgagcgtgctccgtatccgccgctcccactctttctccgtcaccttactctactggatctacgacttctcatgaacgcatcgcccctctccaaatgatgatccttcaacgactctccctctgactgttctcttgacaagactttagaatcatctctagaattcctgattatcccatacatccgccactcaccgcctagcaaaagatacatcacacaagagatatccgtgacgtcg

SEQ ID NO: 13332 - DNA, 689 bp, Zea mays
  misc_feature: Ceres CLONE 1373725-F
  misc_feature: Encodes the peptide sequence at SEQ ID NO. 13333
  misc_feature (368)..(368): n is a, c, t, g, unknown, or other
  misc_feature (569)..(569): n is a, c, t, g, unknown, or other
  misc_feature (578)..(578): n is a, c, t, g, unknown, or other
  misc_feature (600)..(600): n is a, c, t, g, unknown, or other
  misc_feature (601)..(601): n is a, c, t, g, unknown, or other
aaagctggagctccccgcggtggcggccgctctagaactagtggatcccccgggctgcaggaattcgcacgagaccattacctagaacatcctaatcgaaaaaagctggagtaccgctgccgcacagactgcagcgcgtgcgcactgagtacgcaggcaggacgcgacgcagcgccgaagcaccaaggatggagcccgagattcagagcctgtgtccgagtacgacggccgtgctcctcctgctggccgcctgtctcgccgccgcggtggcagcgctcgacgctgcggactacgccaggccgccgctgcctgcaggcggaggcggccggcgcgtcctgttcgccaacgggctcgggctgacaccgcanatggggtggaacagctggaaccatttccagtgcgacatcaacgaggcggtcgtccggagcaccgctgatgcgctcgtcgccaccggacttgcaaaggctggctacacgtatgtcaacttacatgactggctgggcggattccgagagaaccaaagagggatacatggtcgctaaccccaagacattcccatccgtgatcanggccctggncagattacgttcacagcaaggnngcttaagcttggcatctaactctttccgctgggacaagaacttgcagcaacagggatgccctggatctctgggctaccaaggagaggg

SEQ ID NO: 13333 - protein, 117 aa, Zea mays
  misc_feature: Ceres CLONE 1373725-F
  misc_feature: SWISSPROT Homolog: EC 3.2.1.22 Alpha-galactosidase
  misc_feature (60)..(60): Xaa is any aa, unknown, or other
MEPEIQSLCPSTTAVLLLLAACLAAAVAALDAADYARPPLPAGGGGRRVLFANGLGLTPXMGWNSWNHFQCDINEAVVRSTADALVATGLAKAGYTYVNLHDWLGGFRENQRGIHGR

SEQ ID NO: 13334 - DNA, 551 bp, Zea mays
  misc_feature: Ceres CLONE 1373730-F
  misc_feature: Encodes the peptide sequence at SEQ ID NO. 13335
  misc_feature (347)..(347): n is a, c, t, g, unknown, or other
  misc_feature (398)..(398): n is a, c, t, g, unknown, or other
  misc_feature (502)..(502): n is a, c, t, g, unknown, or other
gctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacgganaagaaggacgacgcggtggtgcagccgcagaccttcccgcccttcgaccgncctcggcggcggcgcgtccccggcggtcggcggcctccccggggcagcattcctggagcagcattcccggttcagaatgccgggagcggagcagcctaccgggntcagctggccgggagggagatgccccttttcgggggggtccccggttag

SEQ ID NO: 13335 - protein, 101 aa, Zea mays
  misc_feature: Ceres CLONE 1373730-F
  misc_feature (34)..(34): Xaa is any aa, unknown, or other
  misc_feature (86)..(86): Xaa is any aa, unknown, or other
MARSSKMMVAAALLALALAVSTAEARNIKTTTTXKKDDAVVQPQTFPPFDRPRRRRVPGGRRPPRGSIPGAAFPVQNAGSGAAYRXQLAGREMPLFGGVPG

SEQ ID NO: 13336 - DNA, 678 bp, Zea mays
  misc_feature: Ceres CLONE 1373734-F
  misc_feature: Encodes the peptide sequence at SEQ ID NO. 13337
  misc_feature (487)..(487): n is a, c, t, g, unknown, or other
  misc_feature (545)..(545): n is a, c, t, g, unknown, or other
  misc_feature (567)..(567): n is a, c, t, g, unknown, or other
  misc_feature (569)..(569): n is a, c, t, g, unknown, or other
  misc_feature (580)..(580): n is a, c, t, g, unknown, or other
  misc_feature (606)..(606): n is a, c, t, g, unknown, or other
  misc_feature (613)..(613): n is a, c, t, g, unknown, or other
aaagctggagctccccgcggtggcggccgctctagaactagtggatcccccgggctgcaggaattcgcacgagaccattacctagaacatcctaatcgaaaaacaaacaacaaatcactccgttgagccttcaccatcacctccctctctggctctctctctctctcacgcatacgaacacactctctactagtactaacctctcactaatctatatctagcagcaagcacacaccgtaacatcaaagccaacgacgacgcggggccggccgcccatggccttcacgtccttattgggcagcgacgcggagcggaaggtggcggtggcggaggtggcgctgcgggcggtgctgtgcgggctaggcgcgctggcggcggcgctggtggcgacggacacgcagacgcgcaccttcttctccctgcagaagaaggcgacctacacggacatgaaggccatggtgctcctggtggccgccgcggccacggncgccggctacagcctgctgcaggcggcgcgctgctgctgctgcgtcgccctgctgcgnacgtacatccgcccccgcgccngnctggtggtganctgtgcggtcttcgcgtgcgacaagncgctggngtacgcgcttgctgggcgccgtcaccgccgggctgaagggcttcctcgtcgccaaggagggctgg

SEQ ID NO: 13337 - protein, 134 aa, Zea mays
  misc_feature: Ceres CLONE 1373734-F
  misc_feature (71)..(71): Xaa is any aa, unknown, or other
  misc_feature (98)..(98): Xaa is any aa, unknown, or other
  misc_feature (102)..(102): Xaa is any aa, unknown, or other
  misc_feature (111)..(111): Xaa is any aa, unknown, or other
  misc_feature (113)..(113): Xaa is any aa, unknown, or other
MAFTSLLGSDAERKVAVAEVALRAVLCGLGALAAALVATDTQTRTFFSLQKKATYTDMKAMVLLVAAAATXAGYSLLQAARCCCCVALLRTYIRPRAXLVVXCAVFACDKXLXYALAGRRHRRAEGLPRRQGGL

SEQ ID NO: 13338 - DNA, 667 bp, Zea mays
  misc_feature: Ceres CLONE 1373736-F
  misc_feature: Encodes the peptide sequence at SEQ ID NO. 13339
  misc_feature (458)..(458): n is a, c, t, g, unknown, or other
  misc_feature (569)..(569): n is a, c, t, g, unknown, or other
aaagctggagctccccgcggtggcggccgctctagaactagtggatcccccgggctgcaggaattcgcacgagaccattaactagaacatcctaatcgaaaagcatcaactcaaccgaagggacgaccgagcggagtctagactcgagagcaacctcgacctcccggatctctctcccacccacgcctcgtcgccgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccagctggtgatcagtgagatcgactcgtcagccgctacctcgctgcagggcgtgaagctgctcgcgctgtacctcactggagacnaggaaggtgctatctccagtctcaaggagtggttgagcgattcagcaattggaagcaatcctgttctgagattgattgctgggattatatttatgcatgagcatgactacnatgaggctctcaagcacacacgctctgggagaactctggatttgcatgcattgaatgcccagatcttcatcaagatgcatcgttcagactatgctggg

SEQ ID NO: 13339 - protein, 151 aa, Zea mays
  misc_feature: Ceres CLONE 1373736-F
  misc_feature (3)..(151): Pfam Name: Coatomer_E Pfam Description: Coatomer epsilon subunit
  misc_feature (82)..(82): Xaa is any aa, unknown, or other
  misc_feature (119)..(119): Xaa is any aa, unknown, or other
MASPDLLFNLRNLFYLGAYQAAINNSDVPGLDADAAAERDAIVFRSYIALGSYQLVISEIDSSAATSLQGVKLLALYLTGDXEGAISSLKEWLSDSAIGSNPVLRLIAGIIFMHEHDYXEALKHTRSGRTLDLHALNAQIFIKMHRSDYAG

SEQ ID NO: 13340 - DNA, 577 bp, Zea mays
  misc_feature: Ceres CLONE 1373738-F
  misc_feature: Encodes the peptide sequence at SEQ ID NO. 13341
  misc_feature (422)..(422): n is a, c, t, g, unknown, or other
aaagctggagctccccgcggtggcggccgctctagaactagtggatcccccgggctgcaggaattcgcacgagaccatacctagaacatcctaatcggaactccaaagtttcgtccaccatttcgctcccgcaagcaccgatttgtttactgctctctccgacgcgcggcggcggagctccctacgacgactgaaccatgtgcggcggcgcgatccttgccaaccttcgcgagccggcgccgcgccggctcacagagcgggacatctggcagcagaaaaagagctcaagaggggcggcggcggcagaaggcgctcgttcgcggcggaggacgatgaggacttcgagggcgacctttgaggtcttcaaggccaactcccgggggattcagatttggagctcagggaggggactgacaaccacntcctccaaatcaagcccctcactggcaaaaggatttttcccagggaggggttaagccccatgaccaggggctggaccagggcccccccaaagggaaaaaaaaaaattttatccgggggtatccccccggggcctttggggaaaagggggtttgtg

SEQ ID NO: 13341 - protein, 92 aa, Zea mays
  misc_feature: Ceres CLONE 1373738-F
MCGGAILANLREPAPRRLTERDIWQQKKSSRGAAAAEGARSRRRTMRTSRATFEVFKANSRGIQIWSSGRGLTTTSSKSSPSLAKGFFPGRG

SEQ ID NO: 13342 - DNA, 675 bp, Zea mays
  misc_feature: Ceres CLONE 1373741-F
  misc_feature: Encodes the peptide sequence at SEQ ID NO. 13343
aaagctggagctccccgcggtggcggccgctctagaactagtggatcccccgggctgcaggaattcgcacgagaccattacctagaacatcctaatcgaaaaatcgcttcaggtcggcgtgttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggtatccaagtcggcaacgcgtgctgggaactttactgcctcgagcacggcatccagcctgatggtcaagtgcctggagataagaccgcgggacatcacgatgatgccttcagcaccttcttcatccagactggtgctgggaagcacgttccccgtgcaatcttcgttgatctagaacccactgtgatcgatgaggtgcgcactggcacgtaccgcctgctcttccaccctgagcagatcatcaggggcaaggaggatgccgctaacaatttcgcccgtggccactacacaattgggaaggagattgttgatctgtggccttgaccgtatccgcaagtttgctggaaactgcaccgggcctccagggggttcctgggtcg

SEQ ID NO: 13343 - protein, 119 aa, Zea mays
  misc_feature: Ceres CLONE 1373741-F
MRECISVHIGQAGIQVGNACWELYCLEHGIQPDGQVPGDKTAGHHDDAFSTFFIQTGAGKHVPRAIFVDLEPTVIDEVRTGTYRLLFHPEQIIRGKEDAANNFARGHYTIGKEIVDLWP

SEQ ID NO: 13344 - DNA, 709 bp, Zea mays
  misc_feature: Ceres CLONE 1373743-F
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
  misc_feature (52)..(52): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (673)..(673): n is a, c, t, g, unknown, or other
ggggggggccccnnnnnannacaacatggggggcnnatcccctnnnnnnannccaagctggggctccccgcggtggcggccgctctagaactagtggatcccccgggctgcaggaattcgcacgagaccattacctagaacatcctaatcgaaaactctcttcttcccgcggtctgctcgttcgatctgtgcagcagatctgaggtcccgggcgaccgtgaagcagcttcaatcggcgggatggcgctcgtattgcatagtggggctggaaacaagaatgccttcaaagcacttattgctggcacaataccgtggggatcggggttggagttgcccagggattttggagatggggggtcttcccacaagacccccggagttttcttagggaggcacccccctttgggaagggttcctggttctggggaaactcctggatgggcccgggttttttggggaggaatggggtatttgggagggttcttggggtggcccccccttgggggggggggccaaacccctctctttttggggggccttccccccgaaactagaacccaagcccccccgccccggggggccaaaggggcagggggacgtctttgcgccgggnnngcgcggaaagccgcgcacccccggggggggtgtcccgcggggggccggcggtagatcnccaggggggggcggtggcgtcttctctcctctgttg

SEQ ID NO: 13345 - DNA, 676 bp, Zea mays
  misc_feature: Ceres CLONE 1373744-F
  misc_feature: Encodes the peptide sequence at SEQ ID NO. 13346
  misc_feature (298)..(298): n is a, c, t, g, unknown, or other
  misc_feature (303)..(303): n is a, c, t, g, unknown, or other
  misc_feature (403)..(403): n is a, c, t, g, unknown, or other
  misc_feature (411)..(411): n is a, c, t, g, unknown, or other
  misc_feature (412)..(412): n is a, c, t, g, unknown, or other
aaagctggagctccccgcggtggcggccgctctagaactagtggatcccccgggctgcaggaattcgcacgagaccattacctagaacatcctaatcgaaaaatacttttcctccttcagtttttatcacacgtcaatggagtggggctagcaatggcatggtaacttttccaatctttttgcattaaaaaagaaatcctaaagaaaaaggattactaaacgagcacgctcgccggcgctgggaccaggctctgggtctcgcatcacgatcagatccaatccaaggccgcgccccccncaagnccccccgggcggatggattccgccgccgtggccatcgtgacggtgccgttcccggcgcagggccacctgaaacagctgctgcacctgtccctgctcctgncatcgcgnnggcttcctggtcacttcgccccgcgcgagccgcacctccggaaggcccgcgcgcgcctgcaccgctgggggcccgaccccgcgttcggtgtgctcccgcggctggaagtgccggggaaaactccccctccccggaaccatcctccccgttcccggggaaaatgaacccccggttcaaaggctttttgaaccggggggcgggggcctccttaaccccgttcttgggggaattggccccgttcccacccccggtttttggtcttaa

SEQ ID NO: 13346 - protein, 86 aa, Zea mays
  misc_feature: Ceres CLONE 1373744-F
  misc_feature: SWISSPROT Homolog: EC 2.4.1.215 Cis-zeatin O-beta-D-glucosyltransferase
  misc_feature (30)..(30): Xaa is any aa, unknown, or other
  misc_feature (33)..(33): Xaa is any aa, unknown, or other
MDSAAVAIVTVPFPAQGHLKQLLHLSLLLXSRXLPGHFAPREPHLRKARARLHRWGPDPAFGVLPRLEVPGKTPPPRNHPPRSRGK

SEQ ID NO: 13347 - DNA, 700 bp, Zea mays
  misc_feature: Ceres CLONE 1373745-F
  misc_feature: Encodes the peptide sequence at SEQ ID NO. 13348
  misc_feature (343)..(343): n is a, c, t, g, unknown, or other
aaagctggagctccccgcggtggcggccgctctagaactagtggatcccccgggctgcaggaattcgcacgagaccattacctagaacatcctaatcgaaaaacgcctcccaacctcctctgctctcccccacctcccggtccggcagcagagagcgggggtgcagagagatcgagatccggaggccgcgagtgggagcgccaccaccagcgactgcggcaatggcgggcacggtgacggtcccggggtcgtcgaccccctccacgccgctgctcaaggacgagctcgacatcgtgatcccgacgatcggcaaactcgacttcctggagatgtgggggccttncttccagccctaccacctcatcatcggggaggagggggggggcgaccaagaccatcaaggtggcccaggggttcaaatacgaggttctacaaccggaaggagattcaaccggattctccgggcccaagggcccttggttttcctttaaaggatccggctgggccgtggttttggtaaaaggggttcccaaaaaaaagaccttttacccccttcgaggagcggtgggttttttttgccaagggacccctttggggagaggaatttcagggtttttgtgaagaaaaaaaaaaaaaaacccctttaagagaccatcccccccgggtgtttttttaaaaaccccgggggagcacccccccc

SEQ ID NO: 13348 - protein, 89 aa, Zea mays
  misc_feature: Ceres CLONE 1373745-F
  misc_feature (41)..(41): Xaa is any aa, unknown, or other
MAGTVTVPGSSTPSTPLLKDELDIVIPTIGKLDFLEMWGPXFQPYHLIIGEEGGGDQDHQGGPGVQIRGSTTGRRFNRILRAQGPLVFL

SEQ ID NO: 13349 - DNA, 687 bp, Zea mays
  misc_feature: Ceres CLONE 1373748-F
  misc_feature: Encodes the peptide sequence at SEQ ID NO. 13350
  misc_feature (256)..(256): n is a, c, t, g, unknown, or other
  misc_feature (291)..(291): n is a, c, t, g, unknown, or other
  misc_feature (292)..(292): n is a, c, t, g, unknown, or other
aaagctggagctccccgcggtggcggccgctctagaatagtggatcccccgggctgcaggaattcgcacgagaccattacctagaacatcctaatcgaaaaactcggcacgcaggcagaggcagcacagcagcagccagctccatccatcctctttcccctcctcgcttcgcttcctcggcggattcctcctccctcggccgtccccgtcccctttttcggcgcgcgagctcgcccgagatggcaaacgcgagatncggtgtcgctgtgaatgacgagtgcatgctcaagnntcgcgagctgcagtcgaagaggctgcaccgcttcctaactttcaggatggacgacaagttcaaggagatcctttgtggacaagggcgggggatcgcgctaccaggtaacgaggacttcaccaacaggcctccccgagatggactgcggaaacgcgaactataattccaactttgggcctggcaaaagatgcccaaaaaaacaggatctttctatttgcaatgggccccaaccccccgcaaagggaaaaaacaaaaatcttttatgcaagctcaaaccaaaaattcaggaggggggctcaaggggatttcgggggaaacctgccgctactgggggaaagggaaaaccccctttgaaaaaaaacagagaccgggtcccaaaaacaataaaaaaaaat

SEQ ID NO: 13350 - protein, 71 aa, Zea mays
  misc_feature: Ceres CLONE 1373748-F
  misc_feature (6)..(6): Xaa is any aa, unknown, or other
  misc_feature (18)..(18): Xaa is any aa, unknown, or other
MANARXGVAVNDECMLKXRELQSKRLHRFLTFRMDDKFKEILCGQGRGIALPGNEDFTNRPPRDGLRKREL

SEQ ID NO: 13351 - DNA, 668 bp, Zea mays
  misc_feature: Ceres CLONE 1373750-F
  misc_feature: Encodes the peptide sequence at SEQ ID NO. 13352
  misc_feature (437)..(437): n is a, c, t, g, unknown, or other
  misc_feature (438)..(438): n is a, c, t, g, unknown, or other
  misc_feature (476)..(476): n is a, c, t, g, unknown, or other
tggagctccccgcggtggcggccgctctagaactagtggatcccccgggctgcaggaattcgcacgagaccattacctagaacatcctaatcgaaaaggttaaacccatgccgctaatcgacgccgccgcctcggcggtcgcgccgcccccaccccggcgagtggctcaactccgcttcttcagcactcgcagacccggaatcctatccctaactgccaccagctgctccccctcccctccgcccccggtcgctgcggaggtgcctgcgccgccacaggaagcgaagtcgaagccgaggccacggcggtacccgaagcagtaccccggcgagtcggggggcgttgctgaggagatgcgctttgtggggggggggctgggtaaccccaagcgcaccaccataaaagacaagtcggggacggaggacgcggacgccggnnccgggggtgtcggagggcgaggttgagtacgacgaccncgggcgggcgtgaagggaggaacacgaggagggagaatgagggccaagctccagggaaggggaaagggatggcccaggatgggaagggggttcgcggcaaaaccctgggggaaaaggaagcttcgtgcttccggaaccaatcgaaggggggtcggggggcccgaaaccccaccaaagggtccgcccaaagcg

SEQ ID NO: 13352 - protein, 36 aa, Zea mays
  misc_feature: Ceres CLONE 1373750-F
  misc_feature (29)..(29): Xaa is any aa, unknown, or other
MRFVGGGLGNPKRTTIKDKSGTEDADAGXGGVGGRG

SEQ ID NO: 13353 - DNA, 732 bp, Zea mays
  misc_feature: Ceres CLONE 1373751-F
  misc_feature: Encodes the peptide sequence at SEQ ID NO. 13354
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (40)..(40): n is a, c, t, g, unknown, or other
  misc_feature (41)..(41): n is a, c, t, g, unknown, or other
  misc_feature (43)..(43): n is a, c, t, g, unknown, or other
  misc_feature (44)..(44): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (732)..(732): n is a, c, t, g, unknown, or other
nnnnnnnnnnnnnccccccccccccccccccccccccgcnntnntttttaaannnggccaagctggggctccccgcggtggcggccgctctagaactagtggatcccccgggctgcaggaattcgcacgagaccattacctagaacatcctaatcgaaaaatatccactattctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatggagtacttgcatgaaggcaacagggggttggccaagcttgctagggggggcccgaccctggatgctggaggcaactgtttggccctcaccggtttcagccgtgcccacatggccaaggaggggggccggggagtgatggccaccgaatgaaaatggatgcccgaatgccaaataatgatggccctccggaggatggggggcccgaactaatggatggccccccgagtaaacccaatggggtaagggatggaggggcccccggaatgatggaatggccaaaacattggttcccccaccacatggagtggatggccccaagtgaatgaagtggcctttcccaaccgagtaaaacggcccgaaaggaattgaactcgcgcccccccagataaagggggtgggcccgagn

SEQ ID NO: 13354 - protein, 91 aa, Zea mays
  misc_feature: Ceres CLONE 1373751-F
MAAKMFALFALLALCATATSATHIPGHLSPLLMPLATMNPWMEYLHEGNRGLAKLARGGPTLDAGGNCLALTGFSRAHMAKEGGRGVMATE

SEQ ID NO: 13355 - DNA, 657 bp, Zea mays
  misc_feature: Ceres CLONE 1373752-F
  misc_feature: Encodes the peptide sequence at SEQ ID NO. 13356
aaagctggagctccccgcggtggcggccgctctagaactagtggatcccccgggctgcaggaattcgcacgagaccattacctagaacatcgtaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacataccttgatcacccttgtttcaacaatcgccagccctatctttggtgcagtcattggtacaacccatcagggcacagcagctgcagcaactcgtggctacgtgtgatcaacaagtagctctggcaaccttttctcctactctcagaacaacaatttcttccattcaaccacctgtctaacttgaactgtgctggctatttgcagcaaaactattaccattcgccaggtaggtaatggctactctcagcaaaaacacttcttccattaaccaattgccgcactgaaccc

SEQ ID NO: 13356 - protein, 68 aa, Zea mays
  misc_feature: Ceres CLONE 1373752-F
MATKIFSLLMLLALSACVANATIFPQCSQAPIASLLPPYLPSMIASVCENPALQPYRLQQAIAASNIP

SEQ ID NO: 13357 - DNA, 762 bp, Zea mays
  misc_feature: Ceres CLONE 1373760-F
  misc_feature: Encodes the peptide sequence at SEQ ID NO. 13358
aagctggagctccccgcggtggcggccgctctataactagtggatcccccgggctgcaggaattcgcacgagaccattacctagaacatcctaatcgaaaaagcgaatcacgtgacttcccctccccttctcccctctccactccatcgtcaaggaaggaacacggccctaactaaaccctagctaagggaagggaaacaagaccatggatgcctccaagctccgcgagcttcgcgacttcgtcgaggcgtgcaagaagaatccttcgctcctcgccgaccccaacctctccttcttccgggattacctccagagtttgggtgccaaaattcccgccgccgccccctctttcgaaagtcccaagagatctttccatggacgacattgatgacgacggtgatgacgacgacgatttggatatgagggatcccactcctgagcgagacgagctcgatgaagagattgttgagtctgatctttgagctcgaaggagaaattgtacagtctgacccatgatgacccaccacagaagatgggaaatccttccgtggaggggactgaagaaaaccgggatgcttccccaaaaagcaaaaggcaaggttatgaaaagcaatttcttgaaggaaaaacttgaagaatgctatttggaacaccttcacccacgcaataagtggtgaaatcccactcctcagcaaaccatggatggggaccaagagcaccccgggggtttataaaaaaatggaacaaaacccagcttggctt

SEQ ID NO: 13358 - protein, 60 aa, Zea mays
  misc_feature: Ceres CLONE 1373760-F
MDASKLRELRDFVEACKKNPSLLADPNLSFFRDYLQSLGAKIPAAAPSFESPKRSFHGRH

SEQ ID NO: 13359 - DNA, 711 bp, Zea mays
  misc_feature: Ceres CLONE 1373772-F
aaagctggagctccccgcggtggcggccgctctagaactagtggatcccccgggctgcaggaattcgcacgagaccattacctagaacatcctaatcgaaaactgtttggctgttgcctggcgggtggcggctgctttggtgcgctgcgcagtgcactccgtccgtcgaccggccggccgtcccctggcccctgctcgtcgtcttcctcgggcgctcgtcttcctccgaacgcgcgcgggccgccgacctacttgttctcctggaggagcgcgcccggcgggcaggcgacgcagtccagccgcggttttgaggaagaaggcgagcgaccgggggatccccatccaggcgtcccctgctcggtcttcctcgggggggggggggtggcgacccattcttcctccagccctccattctgatcaccgggccgaccgtccccctggtcgtctttcctggggggtcgggttgctccagggggtccgccccctggctgccagggttggctcgggcgcggtccgcaccttgggtggaaaatctggctccaaccccggggtggtttgggtttcccggttccttctggcaaaaaaattcttaggtccctggatggggaaaggcaaaaagcgtgccctccaatcttccatcaagggtggggttttggcgacccggcacggggattctttttagcggggaaggggcagaaaaaccctcgcccc

SEQ ID NO: 13360 - DNA, 735 bp, Zea mays
  misc_feature: Ceres CLONE 1373773-F
  misc_feature: Encodes the peptide sequence at SEQ ID NO. 13361
  misc_feature (507)..(507): n is a, c, t, g, unknown, or other
  misc_feature (508)..(508): n is a, c, t, g, unknown, or other
  misc_feature (527)..(527): n is a, c, t, g, unknown, or other
  misc_feature (540)..(540): n is a, c, t, g, unknown, or other
  misc_feature (584)..(584): n is a, c, t, g, unknown, or other
  misc_feature (712)..(712): n is a, c, t, g, unknown, or other
caaagctggagctccccgcggtggcggccgctctagaactagtggatcccccgggctgcaggaattcgcacgagaccattacctagaacatcctaatcgaaaaaactaggagagtggtggaggaggagacccaccgtcggctcgcccgtgtcccgattcccactcacgacatcaacctgtccccatccatctcgcccgcgacgtttgatggagtctctcctcgcctcgcgatccattaggtcttccttctccgccgtcgccagcaccaggggcgccgcttcccccaggccctcgcgcgtcgccaccctcgccagcgccggcgccggcgcccgctcccgcgcgctccgtgctggccacacggactcaatccttgaggtgctggcacaggacgatatgctgaacgcaaaggagctggtccaatgggagaatggcttgtcattcaatgacatagcggctagggcagggattcgcatccgcagacactgcccgcccactggctccttgaanngagatagagaggagctggnagccccccttaancatctagagaagatcatttgggacaaggagattgaagtagctgnagggcatgctaagaagcctcttgaggaggtgattcaggctgcaacgaaagcccctcctttcagagacttctatggcgctttaaaggctgcctaacagcgtaatgggggtgcctgcattgattgctgangtcaagaaagcatccccgagtag

SEQ ID NO: 13361 - protein, 156 aa, Zea mays
  misc_feature: Ceres CLONE 1373773-F
  misc_feature: SWISSPROT Homolog: EC 4.1.1.48 Indole-3-glycerol-phosphate synthase
  misc_feature (100)..(100): Xaa is any aa, unknown, or other
  misc_feature (101)..(101): Xaa is any aa, unknown, or other
  misc_feature (107)..(107): Xaa is any aa, unknown, or other
  misc_feature (111)..(111): Xaa is any aa, unknown, or other
  misc_feature (126)..(126): Xaa is any aa, unknown, or other
MESLLASRSIRSSFSAVASTRGAASPRPSRVATLASAGAGARSRALRAGHTDSILEVLAQDDMLNAKELVQWENGLSFNDIAARAGIRIRRHCPPTGSLXXDREELXAPLXHLEKIIWDKEIEVAXGHAKKPLEEVIQAATKAPPFRDFYGALKAA

SEQ ID NO: 13362 - DNA, 723 bp, Zea mays
  misc_feature: Ceres CLONE 1373774-F
  misc_feature (368)..(368): n is a, c, t, g, unknown, or other
  misc_feature (624)..(624): n is a, c, t, g, unknown, or other
  misc_feature (723)..(723): n is a, c, t, g, unknown, or other
aaagctggagctccccgcggtggcggccgctctataactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacgcancgccgccagcctgcaggaagccagcccctattcgagacaaggtcgatctttgctgccttggcgagcttcagccgaatcaaggtcgagcatggcggcaggccagtaaatagagcaccacaaaaccttcaaattaatggagacctctggaagaaacccgacccgggccgccacaccaggcggccacttcccccatcgccattcccccttcgtcgtcgtttaaggttggggaggccagggggggcaagcgaaaaatggncaattcagtggtcccattctgagccgcccccaaggagacattggcttgggccccccgttttctgaacggcccttgccaccctccttccggggtttgtan

SEQ ID NO: 13363 - DNA, 681 bp, Zea mays
  misc_feature: Ceres CLONE 1373775-F
  misc_feature: Encodes the peptide sequence at SEQ ID NO. 13364
  misc_feature (459)..(459): n is a, c, t, g, unknown, or other
  misc_feature (480)..(480): n is a, c, t, g, unknown, or other
  misc_feature (556)..(556): n is a, c, t, g, unknown, or other
  misc_feature (681)..(681): n is a, c, t, g, unknown, or other
aaagctggagctccccgcggtggcggccgctctagaactagtggatcccccgggctgcaggaattcgcacgagaccattacctagaacatcctaatagaaaactagaaccgtctccaatggcgctactccgagcgctccggcgagcccttccggcgctctcctcgccggcggcggttctcccccgtcgcgccccgcacccactacctcctccgcccgctcctcgtcggttcctggacccgatcgggctccgctccttctccgccgccgccgccaccgcgtcgcaggcgccgcccatgggggccaccctgttcggcgggctcatggacacccggttcccgaagcgccggccgggcttcgccaaccgccggaagaggggtagcttgcgccccaaagggccgtactactgggtgaagtgcaagcctgacgagcccataccagttagtcagccgaaccagggnagcgtacgagggaggaagganaataagcggatcaagcagcgcagggactttatcatggctgaaaagaagaagcgcagagctcagtattctgctgctngtaagagaagggaggcagaacgaacaaaaagaaagatggctgctgtggcaagaagagcgggcaggggcaagcaaggttgatagagcctaaacagattggaggaagacgttaaagctgtaatgggn

SEQ ID NO: 13364 - protein, 172 aa, Zea mays
  misc_feature: Ceres CLONE 1373775-F
  misc_feature (121)..(121): Xaa is any aa, unknown, or other
  misc_feature (147)..(147): Xaa is any aa, unknown, or other
MALLRALRRALPALSSPAAVLPRRAPHPLPPPPAPRRFLDPIGLRSFSAAAATASQAPPMGATLFGGLMDTRFPKRRPGFANRRKRGSLRPKGPYYWVKCKPDEPIPVSQPNQGSVRGRKXNKRIKQRRDFIMAEKKKRRAQYSAAXKRREAERTKRKMAAVARRAGRGKQG

SEQ ID NO: 13365 - DNA, 672 bp, Zea mays
  misc_feature: Ceres CLONE 1373777-F
  misc_feature: Encodes the peptide sequence at SEQ ID NO. 13366
  misc_feature (434)..(434): n is a, c, t, g, unknown, or other
  misc_feature (464)..(464): n is a, c, t, g, unknown, or other
  misc_feature (649)..(649): n is a, c, t, g, unknown, or other
  misc_feature (672)..(672): n is a, c, t, g, unknown, or other
aaagctggagctccccgcggtggcggccgctctagaactagtggatcccccgggctgcaggaattcgcacgagaccattacctagaacatcctaatcgaaaactctctgttgcatttcccgtcctgtccttccacccggcggcttaaaccctagttctcactcccatcgccgcttcagctccgccgctgcagatggagttctggggtctcgaggtcaagcctggttccactgttaagtgtgagcctggatatggctttgtgctgcacctttcccaggctgctcttggggaatcgaagaagagtgataatgccttgatgtatgtcaaaattgatgatcagaaacttgccattggaaccctctctgttgacaagaacccacgcagtacgatttgatctgattttcgataaagagtttgagctgtcgcacacatcanaaactaccagcgttttcttcactggctacnagggttgagcagcattcgaggaagatgaatggatcttgattctgaagatgaagacgaggagctgaatggtccagtagtcaagggaaatggcaaagctgatgagaagaaacagaaaagtcaagagaaggcagttgctgcaccttcaaaatcaggtccgggattcaagaagaagcaggatgacgacnattctgatgaggacgagactgan

SEQ ID NO: 13366 - protein, 66 aa, Zea mays
  misc_feature: Ceres CLONE 1373777-F
MEFWGLEVKPGSTVKCEPGYGFVLHLSQAALGESKKSDNALMYVKIDDQKLAIGTLSVDKNPRSTI

SEQ ID NO: 13367 - DNA, 699 bp, Zea mays
  misc_feature: Ceres CLONE 1373778-F
  misc_feature: Encodes the peptide sequence at SEQ ID NO. 13368
  misc_feature (410)..(410): n is a, c, t, g, unknown, or other
  misc_feature (653)..(653): n is a, c, t, g, unknown, or other
  misc_feature (664)..(664): n is a, c, t, g, unknown, or other
caaagctggagctcaccgcggtggcggccgctctagaactagtggatcccccgggctgcaggaattcgcacgagaccattacctagaacatcctaatcgaaaaaaaaacaaccgaaacctgcagtcgggtcatctcgtccacgaaacgtacggacttcgggcatcggccccaacgccagcggcaccgcacccgcaccaccaagctcgtcggcgacatgaatccgcccgcagcagccgcgtccaccggcgcaggaggccacgccgcggcgcctgcggcagccccggagtacgcgcactacccgaggctctcgccagaggaggtggccccgcccccgcccccgccttatcacgccgccaccgccgcgccgtccgcctacggaggcaacccctacatctactcccccgccggnggcgccgccacctccccgaagaatacgatggactccgtgaaggacgtgctcggcaagatgggaaagaggtttggcgaggcggcccgcaagaccgagaccatcaccggcaatttctggcagcacttgaaaactggaccaagcattactgatgcagcaatgagcaggatctcacaggtcaccaaagtcattgcagaaggtggatatgacaaaattttccatcaaacttttgaggtcgcccctggntgaaagctcangaagccatatgcatggtatctgtcaccctcggctg

SEQ ID NO: 13368 - protein, 146 aa, Zea mays
  misc_feature: Ceres CLONE 1373778-F
MNPPAAAASTGAGGHAAAPAAAPEYAHYPRLSPEEVAPPPPPPYHAATAAPSAYGGNPYIYSPAGGAATSPKNTMDSVKDVLGKMGKRFGEAARKTETITGNFWQHLKTGPSITDAAMSRISQVTKVIAEGGYDKIFHQTFEVAPG

SEQ ID NO: 13369 - DNA, 777 bp, Zea mays
  misc_feature: Ceres CLONE 1373780-F
  misc_feature: Encodes the peptide sequence at SEQ ID NO. 13370
  misc_feature (261)..(261): n is a, c, t, g, unknown, or other
  misc_feature (278)..(278): n is a, c, t, g, unknown, or other
aaagctggagctccccgcggtggcggccgctctagaactagtggatcccccgggctgcaggaattcgcacgagaccattacctagaacatcctaatcgaaaaatccaaatccgtcacggacgcttccacgcgaccaagcagccacgcggcgctggtctggccggccatgtcctgcctcgcggcgccgccggctgcaccgccaaaggcgggggagcgcatgctccgcgcccgcgctcctttgcgctcgccttcgccgtgccnggggctgcattacgcgntgcgggggactggagggcgagaagcggggtgcgcccggcgcagctggcgctgctgcggtgctccccagctggcgagtccaggggcgtccggggacggcggcctttccagcttctggataattgaaagtccagagacgatcgaggacttttgctcaaaatgccatcgcagggggatttgaagacacatcatgagccgacgcaacaaaaatttccctcctgatggaagaggttaaacggttggcgagtgcaccaccgtatccaaacttctgaaagcaaagatgccaccactgaaaggaaaggaaatgcctgaaattccatcaacttattccttttatggccggatgccgccacccaagaactatggaagccactctttagtgacctccgctccccctggcataatcggggaaaaatcattttttgggaagggtttgaaaaccccccagtaacttggacttggaaattaggggtttggggcgggcacactccttaagtaaaa

SEQ ID NO: 13370 - protein, 96 aa, Zea mays
  misc_feature: Ceres CLONE 1373780-F
  misc_feature (32)..(32): Xaa is any aa, unknown, or other
  misc_feature (38)..(38): Xaa is any aa, unknown, or other
MSCLAAPPAAPPKAGERMLRARAPLRSPSPCXGLHYAXRGTGGREAGCARRSWRCCGAPQLASPGASGDGGLSSFWIIESPETIEDFCSKCHRRGI

SEQ ID NO: 13371 - DNA, 688 bp, Zea mays
  misc_feature: Ceres CLONE 1373781-F
  misc_feature: Translation starting site: 314
  misc_feature: Pfam Name: MtN3_slv Pfam Description: MtN3/saliva family
  misc_feature (463)..(463): n is a, c, t, g, unknown, or other
  misc_feature (539)..(539): n is a, c, t, g, unknown, or other
  misc_feature (540)..(540): n is a, c, t, g, unknown, or other
  misc_feature (588)..(588): n is a, c, t, g, unknown, or other
  misc_feature (619)..(619): n is a, c, t, g, unknown, or other
  misc_feature (653)..(653): n is a, c, t, g, unknown, or other
  misc_feature (663)..(663): n is a, c, t, g, unknown, or other
aaagctggagctccccgcggtggcggccgctctagaactagtggatcccccgggctgcaggaattcgcacgagaccattacctagaacatcctaatcgaaaaactcacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcggacaccatccgcacggccatcggcgtcatcggcaatgggaccgccctagtgctcttcctctccccggtgcctacgttcatccgcatctggaagaaggggtcggtggagcagtactcgccgatcccgtacgtggcgacnctgctgaactgcatggatgtgggtgttgtacgggctggcgctggtgcacccgcacagcatgctggtgatcaccatnncacggaccgggatgctcatccagctgacctacgtggggctcttctcgnctactcccggggggggcgcgcggccgcaggntgtccctctgtggggccgccgaggtccgcttttntcggggcggntccccgggggtggggctcggcctgg

SEQ ID NO: 13372 - DNA, 709 bp, Zea mays
  misc_feature: Ceres CLONE 1373784-F
  misc_feature: Encodes the peptide sequence at SEQ ID NO. 13373
  misc_feature (427)..(427): n is a, c, t, g, unknown, or other
aaagctggagctccccgcggtggcggccgctctagaactagtggatcccccgggctgcaggaattcgcacgagaccattacctagaacatcctaatcgaaaaaaacacacacgggcaatcaattagcagaacccgcgccaccccccttcctcggagtcggagcgagtcgaggaacggctcgtctgcctctcccgttctccttcctctcctccccagaagatccgatccatcatcgaggactcgccgggaagaatcaaggatatatagataatatacaaacaaaggttcctccagagcccagagcaggagggaagtcaccggccgtcggcggggaagagatgtcggacggcgcgggctcccggacgggcgtcgctggcgcgctgggcctctcggtcacctcgtcggtggccatcgtcatctgcaacangtacctcatcagcactctaggcttcttcttcgcgacgacgctgacgagctggcacctcatggtgaccttctcacgctgaacgttgcggaagggcttgggctcctcgaagcaaagccgatggaggggggaaccgtcatttccttggggctgttaaagggaatttcctttggcctcctcaccttctggccggggttaactctgtttggtttctaacagaggaccaagttggcatttataccctccccaaggcttggaaacccctcttttggagaaaaaattaaa

SEQ ID NO: 13373 - protein, 55 aa, Zea mays
  misc_feature: Ceres CLONE 1373784-F
  misc_feature (30)..(30): Xaa is any aa, unknown, or other
MSDGAGSRTGVAGALGLSVTSSVAIVICNXYLISTLGFFFATTLTSWHLMVTFSR

SEQ ID NO: 13374 - DNA, 709 bp, Zea mays
  misc_feature: Ceres CLONE 1373785-F
  misc_feature (345)..(345): n is a, c, t, g, unknown, or other
  misc_feature (387)..(387): n is a, c, t, g, unknown, or other
  misc_feature (457)..(457): n is a, c, t, g, unknown, or other
aaagctggagctccccgcggtggcggccgctctagaactagtggatcccccgggctgcaggaattcgcacgagaccattacctagaacatcctaatcgaaaaatccatttacctgtccaccaaaccagtctgtagtgttttttccctccctaatgaacagaccacggaggtgacgaagcagcggtagagacaaattagcgagcagagaagggtactggcgatgacacaccttgccattgagcacatgcggtcggaagggatgaggggctgacggcgacagtggtggtggcgcaaagatggtcgggtcgagcgtacgctgatgctgtcgttgatgggaagatgagncgctcgtcccgctcccccagtacttgatcaccgcatgtggtncgcgtccgccccgttgcatgagcacaactgcccctcgccggcggcatggatctctcgcttcgcgctgtcnatgcccgaatattctttgaagggaaagtagtaggataatcctactaccctatagccgggggggaggggggaacccgggggcttcgtttggcacctcccgaggccccctggaagaaccggaacacttttggggccgaaaaatgggaaatgggcccaaaatttccccccccggtcccgggaagaattaaatggggattgagggggtcctttgtgcccccccaaaaccttgtccccagaaaggtgggcctcccct

SEQ ID NO: 13375 - DNA, 687 bp, Zea mays
  misc_feature: Ceres CLONE 1373790-F
  misc_feature: Encodes the peptide sequence at SEQ ID NO. 13376
  misc_feature (348)..(348): n is a, c, t, g, unknown, or other
  misc_feature (365)..(365): n is a, c, t, g, unknown, or other
  misc_feature (367)..(367): n is a, c, t, g, unknown, or other
  misc_feature (368)..(368): n is a, c, t, g, unknown, or other
  misc_feature (378)..(378): n is a, c, t, g, unknown, or other
  misc_feature (396)..(396): n is a, c, t, g, unknown, or other
  misc_feature (397)..(397): n is a, c, t, g, unknown, or other
  misc_feature (400)..(400): n is a, c, t, g, unknown, or other
  misc_feature (407)..(407): n is a, c, t, g, unknown, or other
  misc_feature (408)..(408): n is a, c, t, g, unknown, or other
  misc_feature (414)..(414): n is a, c, t, g, unknown, or other
  misc_feature (415)..(415): n is a, c, t, g, unknown, or other
  misc_feature (437)..(437): n is a, c, t, g, unknown, or other
  misc_feature (438)..(438): n is a, c, t, g, unknown, or other
  misc_feature (447)..(447): n is a, c, t, g, unknown, or other
  misc_feature (465)..(465): n is a, c, t, g, unknown, or other
aaagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccagtccnacctgcccgcgccggtncnnactgccacgncggtccatgtgcccgcgnncgntcatctnngcgcgnncacatggcactaccctactcanncgccccggnctcagcctcatccccagncacacccattgcccgtggcaacagccgcaatcaagcccggtgcagttgaagggaacctggcggggtgggagcaccccgatcccgggccagggggccaaggtcctgaggattaggggaacccgaagggaaccccctaatggtcccctcaagggcaaattttttgggaaaaatggtttccccaacttccgggggggggggccccgacccccggtacccggggat

SEQ ID NO: 13376 - protein, 113 aa, Zea mays
  misc_feature: Ceres CLONE 1373790-F
  misc_feature (59)..(59): Xaa is any aa, unknown, or other
  misc_feature (65)..(65): Xaa is any aa, unknown, or other
  misc_feature (66)..(66): Xaa is any aa, unknown, or other
  misc_feature (69)..(69): Xaa is any aa, unknown, or other
  misc_feature (75)..(75): Xaa is any aa, unknown, or other
  misc_feature (79)..(79): Xaa is any aa, unknown, or other
  misc_feature (81)..(81): Xaa is any aa, unknown, or other
  misc_feature (89)..(89): Xaa is any aa, unknown, or other
  misc_feature (92)..(92): Xaa is any aa, unknown, or other
  misc_feature (98)..(98): Xaa is any aa, unknown, or other
MRVLLVALALLALAASATSTHTSGGCGCQPPPPVHLPPPVHLPPPVHLPPPVHLPPPVXPARAGXXCHXGPCARXRSSXRXHMALPYSXAPXSASSPXTPIARGNSRNQARCS

SEQ ID NO: 13377 - DNA, 733 bp, Zea mays
  misc_feature: Ceres CLONE 1373792-F
  misc_feature: Encodes the peptide sequence at SEQ ID NO. 13378
  misc_feature (575)..(575): n is a, c, t, g, unknown, or other
  misc_feature (620)..(620): n is a, c, t, g, unknown, or other
aaagctggagctccccgcggtggcggccgctctagaactagtggatcccccgggctgcaggaattcgcacgagaccattacctagaacatcctaatccaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggctggcagcaggctaaagggctccacgctccttaccgaaggagtggtgacggatggatccgatgaatgggcaatctacggcgggaccggagagtttgctatggcgagaggtgtcgtcaaaagaaggtacttgncgatagggacggcgccgggaacactgacgagctcagcatgcaggntttctgcccggtgtttggctcatcacagcaccaaacaagcaggactccaccatctctgtcaccaagatgggtttatggggtggcgaaggagggtcggcgcaggacatcccaca

SEQ ID NO: 13378 - protein, 195 aa, Zea mays
  misc_feature: Ceres CLONE 1373792-F
  misc_feature (7)..(158): Pfam Name: Dirigent Pfam Description: Dirigent-like protein
  misc_feature (143)..(143): Xaa is any aa, unknown, or other
  misc_feature (158)..(158): Xaa is any aa, unknown, or other
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGSRLKGSTLLTEGVVTDGSDEWAIYGGTGEFAMARGVVKRRYLXIGTAPGTLTSSACRXSARCLAHHSTKQAGLHHLCHQDGFMGWRRRVGAGHPT

SEQ ID NO: 13379 - DNA, 728 bp, Zea mays
  misc_feature: Ceres CLONE 1373795-F
  misc_feature: Encodes the peptide sequence at SEQ ID NO. 13380
  misc_feature (613)..(613): n is a, c, t, g, unknown, or other
aaagctggagctccccgcggtggcggccgctctataactagtggatcccccgggctgcaggaattcgcacgagaccattacctagaacatcctaatcgaaaaagcgacaccgcgtggttcgttaggaaaggaaatcgatccccatctgatctcttcggtgctaaagaaatataggccgccgccgcctcctcattcggtgaaaggtgggcggttagggttgggagatctcttgactcacgacacgagcagcagaatttgtcgagggccgctggttgctgcgagaggtccgtaccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaaccacctgcattttcattttgatctccctaatccctccggctagctgctttccagtgaccaaagatatcagagaccacttcccgtcttcctccgtggnctgtctgtcatctggctctgaaacgatggcagtcctgcaagttgctgctgctgcccctcccctgtctctgtgattggtttcgaggatttgagaacgccttgaatcagctcctctg

SEQ ID NO: 13380 - protein, 51 aa, Zea mays; identical to SEQ ID NO: 13325
  misc_feature: Ceres CLONE 1373795-F
  misc_feature (1)..(51): Pfam Name: AdoMetDC_leader Pfam Description: S-adenosyl-l-methionine decarboxylase leader peptide

SEQ ID NO: 13381 - DNA, 745 bp, Zea mays
  misc_feature: Ceres CLONE 1373799-F
  misc_feature: Translation starting site: 223
atagctggagctccccgcggtggcggccgctctagaactagtggatcccccgggctgcaggaattcgcacgagaccattacctagaacatcctaatcgaaaactagcccagcaccgcagaggcgcagagacaggcgtcttcgtactcgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctctactgcctcgagcatggcattcaggccgatggtcagatgcccggtgacaagaccattggggggtggtgatgatgctttcaacaccttcttcagtgagactggggctgggaagcacgtccctcgggctgtttttgttgacctttgaaccaactgtcatcgatgaggggaggactgggacctaccgccagctctttccaccctgagcaagtttatcaggggcaaggaggattgcagcaaaaacttccccccgtgggccactacaccattgggcaagggaaattgttgacctgggggctttgatcgcatcaaggaaacttgggccacaaattggactggtcccccaggggtttcccccgtcttaaaacgctgttgggggagaggaaaagggtcctgggccctggggtccccccccccccgggagacgtcctgttttggttacctcccgcaaaaaaag

SEQ ID NO: 13382 - DNA, 821 bp, Zea mays
  misc_feature: Ceres CLONE 1373801-F
  misc_feature: Translation starting site: 427
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (50)..(50): n is a, c, t, g, unknown, or other
ttttcccccnnnnnncccnnncccccccccggggnnnaaaaaccntttgntcaaagctggagctccaccgcggtggcggccgctctagaactagtggatcccccgggctgcaggaattcgcacgagaccattacctagaacatcctaatcgaaaacccaacctcatcttctctccctttgctcggaacgcacacaccgcccggtctccgatctccgatccccgatcccctcgtcgatccaagatgcagatcttcgtcaagactctcactggaaagactatcacccctcgaggtggagtcctctgacaccattgacaacgtcaaggccaagatccaggacaagggaaggcattcccccggaccagcagcggctcatcttcgctggcaagcagctcgaggacgggcgcacacttggccggactacaacatgggggagggaggagcacccctccaccttggttctcccgccctcaggggggagggcatgcaagatctttcgtcgaagaccctccactgggaaaaagactatccacccttcgagggtggaggttcttcctgacacccattcgaccaacggtccaagggcccaaaaatcccagggaacagggagggggcattcccctcccgggaaccagaaagcgggctccatttttttgcctggggaaagcagcctccccaggaacgggtcaccaacgcttgggcccgacctacgaaccatttcaggaaagggagaagccccccctcccccttgggggggttgccccgctccccggggccgggaatggaaaaaatctttccgggaaaaaaacccttgaccggggc

SEQ ID NO: 13383 - DNA, 745 bp, Zea mays
  misc_feature: Ceres CLONE 1373802-F
  misc_feature: Translation starting site: 395
  misc_feature: SWISSPROT Homolog: EC 2.7.11.24 Mitogen-activated protein kinase
  misc_feature (460)..(460): n is a, c, t, g, unknown, or other
aagctggagctccccgcggtggcggccgctctagaactagtggatcccccgggctgcaggaattcgcacgagaccattacctagatcatcctaatcgaaaacccggcccgcgcctcgctctctcttgtctcgcccgctagctcccatcccagcctcccaccgcgcccgcctgccccaacatcccccctccccgctccgctccacgcacggctccagatctgctacggcggcggccggtggacgccgcgccgcgcgtgccggaggcggtgacgtgagcggcggatcctgcccggccgtgccatcctggcgacgatgacagcgtaagcgggcggcggacgaccgcgcccccccggcccctactcccgaggtcattggcgtgtgctccttggcagaaatggcgatgatggtggatcccccccatggcatggcaagtcaagaaaagcattactatactatgtgncagacactgtttgagatcgacaccaagtacgtgccgatcaagccccatcgaaaagagagcttacgaatcgtttgctcatctgtaaccggcgagaccaatgaaaagtcgcgataaaaagataaacaacgtctttgacaacccgtgtggatgcgctaaggacgctgaaagagctgaaactccttcggccactgagggacaagaatggtattgctcccaaggacatatgatgcctgggcatagaaggacctccaggacgtttacttggtttatgaactcatggaacct

SEQ ID NO: 13384 - DNA, 663 bp, Zea mays
  misc_feature: Ceres CLONE 1373807-R
  misc_feature: Encodes the peptide sequence at SEQ ID NO. 13385
ccgattgggtaccgggccccccctcgaggtcgacggtatcgataagcttttttttttttttttttggcgcaaaatcaatccaatttattcctcatcgagatacgtggaagactggggatgtctcgagctccatcggtacagtatgttcccgaaaacgtcgtaaaagataaagtgagcctggtcttggttcagctggagggacatgaacccttgcccgtcgtagaagaatcggagcttgtccttgtttggatggaagactcctctccatgccttggaaccgcctccgctcgtgaaatactggagtggactgtctctgctgctaatgtgctccagacagtgatcgtgtccattgatgtagaagtcgacgccattgtccttgaggactggaagtagtaattccagaagctcctcggtgtccctgtgctcactcacactcctcatggtgtgatgcccaaccacaatcttccaccttgcaggtgatttcttcatagccacatccagaatccttcagcaaattgggctaaagtattggcctcaaggggcccccccctctccagtcataacgatgcttgcccaggttgagcccaatactccaattggaaacggaaatgggggccaacaaaaagaaaatccccaaatttcgccttaacaaaaaaacaattc

SEQ ID NO: 13385 - protein, 91 aa, Zea mays
  misc_feature: Ceres CLONE 1373807-R
MSRAPSVQYVPENVVKDKVSLVLVQLEGHEPLPVVEESELVLVWMEDSSPCLGTASAREILEWTVSAANVLQTVIVSIDVEVDAIVLEDWK

SEQ ID NO: 13386 - DNA, 699 bp, Zea mays
  misc_feature: Ceres CLONE 1373808-F
  misc_feature: Pfam Name: PRA1 Pfam Description: PRA1 family protein
  misc_feature (371)..(371): n is a, c, t, g, unknown, or other
  misc_feature (500)..(500): n is a, c, t, g, unknown, or other
  misc_feature (501)..(501): n is a, c, t, g, unknown, or other
  misc_feature (538)..(538): n is a, c, t, g, unknown, or other
aaagctggagctccccgcggtggcggccgctctagaactagtggatcccccgggctgcaggaattcgcacgagaccattacctagaacatcctaatcgaaaacttcctctgcctctggtcaggtgtcgcggcggcagcaacggcaatccaattccactccaatggcggcctcgtcctccttcaagccgaacccgctgtcgctgagcgtgccggaccccgcgctcgaccgctggctccgggacagcggctacctggacctcctcgactccaccaccaccaccggaaggccgtcgtcgtcagcctcgggcccctccgccccctcctccgccgcctacagccccggcgccggccaggcttcctccggcgtcgcnggcgacgtcctcgccttcgcgcgcaccctcgcctcgctcctcgcgctcaaccccttcgcgcgcctctccacccgccgactggccgcacccaccccgtcctggtcgctcgccttcgtcggcccccccggnncgcgcgtctactcctggccgcccacgccccaccaggncaggctcccgcgtcaggagaacttccgccggtacgcgcgaactaacgcgcgctcgcatcctcgtcttcgggtggtgcctggacgggatgccgatgctctgctggcatgctggccacctcgctggtttggaaagcgtgggctactggccggaccatgggacc

SEQ ID NO: 13387 - DNA, 730 bp, Zea mays
  misc_feature: Ceres CLONE 1373810-F
  misc_feature: Encodes the peptide sequence at SEQ ID NO. 13388
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (484)..(484): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (493)..(493): n is a, c, t, g, unknown, or other
  misc_feature (494)..(494): n is a, c, t, g, unknown, or other
  misc_feature (496)..(496): n is a, c, t, g, unknown, or other
  misc_feature (498)..(498): n is a, c, t, g, unknown, or other
  misc_feature (499)..(499): n is a, c, t, g, unknown, or other
  misc_feature (501)..(501): n is a, c, t, g, unknown, or other
  misc_feature (502)..(502): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (509)..(509): n is a, c, t, g, unknown, or other
  misc_feature (512)..(512): n is a, c, t, g, unknown, or other
  misc_feature (513)..(513): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (519)..(519): n is a, c, t, g, unknown, or other
  misc_feature (529)..(529): n is a, c, t, g, unknown, or other
gctcttaactagtggatcccccggcctgcaggaattcgcacgagaccattacctagaacatcctaatcgaaaacatcgacccagccatctcctcaccctcgttcaccacacagtccgccactcctttagtagcttgtgatttgtacgtcgacgagatcactgggtcggtggcggaccacgacccatggcgaagggtagtggtggtgcatcatggtgggccgttcctcctgcttccccgcgttcctgttttccaaaccacccccgcccgttccgaaagaccgaattgtccaaacggacccccaaggaggacccttccgtgtgtccaaacaagcttgccagtggcaatacccaaaggccccccccccgaaaaaaggaattttaaaaaccatttcccccaaaccgtacccccaaaattttaccccgtccaagaaacaccaccccccgcggggagacccccaaaccccaggggnnnnnnnnnnnnntncnnnnnncnncncnntnnctnnncnctnntnnncnctcccccccncccctccctcctccccccttttccccttcttcctcccctcccctcttctcctcccccccctcctcctccccttctccctttctctctcccttctttctctcctctcctcctcttcccttccttccctctcttttcccctctctccccctcttcccttccccccccccccccccttccctcctcccttctcccctctccccc

SEQ ID NO: 13388 - protein, 65 aa, Zea mays
  misc_feature: Ceres CLONE 1373810-F
MAKGSGGASWWAVPPASPRSCFPNHPRPFRKTELSKRTPKEDPSVCPNKLASGNTQRPPPRKKEF

SEQ ID NO: 13389 - DNA, 755 bp, Zea mays
  misc_feature: Ceres CLONE 1373816-F
  misc_feature: Encodes the peptide sequence at SEQ ID NO. 13390
atagctggagctccccgcggtggcggccgctctataactagtggatcccccgggctgcaggaattcgcacgagaccattacctagaacatcctaatcgaaaagcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagacccgcgggacatcacgatgatgccttcagcaccttcttcagccagactggtgctgggaaagacgttccccggggaaatcttcgttgatctagaacccactgtgatccgatgaggtgcgaacttggacgtaccgccagttccttcaccccggagaagttcatcagtggcaaaggaaggatgccgttacatttttcgcccggggccacaaccaaattgggaaaggaaattgtttgacttgggcccttgaccgtatcccccaagtttggtgaaaaattggaccgggcctccagggtttcctgggtcttcaatggccgttggggggggggcactgggttctggccctgggttctccccccccccttgaacgcccgtgcttgg

SEQ ID NO: 13390 - protein, 46 aa, Zea mays
  misc_feature: Ceres CLONE 1373816-F
MRECISVHIGQAGIQVGNACWELYCLEHGIQPDGQVPGDKTRGTSR

SEQ ID NO: 13391 - DNA, 693 bp, Zea mays
  misc_feature: Ceres CLONE 1373823-F
  misc_feature: Encodes the peptide sequence at SEQ ID NO. 13392
  misc_feature (274)..(274): n is a, c, t, g, unknown, or other
  misc_feature (293)..(293): n is a, c, t, g, unknown, or other
  misc_feature (385)..(385): n is a, c, t, g, unknown, or other
  misc_feature (404)..(404): n is a, c, t, g, unknown, or other
  misc_feature (408)..(408): n is a, c, t, g, unknown, or other
  misc_feature (451)..(451): n is a, c, t, g, unknown, or other
  misc_feature (465)..(465): n is a, c, t, g, unknown, or other
  misc_feature (471)..(471): n is a, c, t, g, unknown, or other
  misc_feature (476)..(476): n is a, c, t, g, unknown, or other
  misc_feature (478)..(478): n is a, c, t, g, unknown, or other
  misc_feature (482)..(482): n is a, c, t, g, unknown, or other
  misc_feature (496)..(496): n is a, c, t, g, unknown, or other
aaagctggagctcaccgcggtggcggccgctctagaactagtggatcccccgggctgcaggaattcgcacgagaccattacctagaacatcctaatcgaaaagtatcgggcaggggctgcaacccaggctgtgcgggcgcggcagggcagcggcggcgacatctgcatctgcatctcccacctcgtctccctcccgcatctgccctgcctcgatcccgccgccagccatctaagggagccgggagccatgtctccctccggcgagctgctgggngtcatctcctccgctctcngcgtggccttcgtcttcctcgcctgcgtcgagctcggcgacgccgccgccgccgtcagcgtctacccgctcatccagtacgacctcgccggngccccgctcggctcccgcngcgnggtcctcaaatcaccacgcgcggtgctcccgctccctgccggngagaactctcccgntcgccntcgtngngcgntcctcgaacttcgntctccttctcagagagtactggtgaagaaaaacagctggggggattgctcattttgctccccacaaccagggtgataagatagtgcggatgacaaggtcaagtcaaagtgtactgactgagctgaagaatttgcttgggaccaccaagttccatatccagggtacttgctttgaatgacaacattttggaaactgct

SEQ ID NO: 13392 - protein, 107 aa, Zea mays
  misc_feature: Ceres CLONE 1373823-F
  misc_feature (16)..(16): Xaa is any aa, unknown, or other
  misc_feature (53)..(53): Xaa is any aa, unknown, or other
  misc_feature (54)..(54): Xaa is any aa, unknown, or other
  misc_feature (73)..(73): Xaa is any aa, unknown, or other
  misc_feature (75)..(75): Xaa is any aa, unknown, or other
  misc_feature (77)..(77): Xaa is any aa, unknown, or other
  misc_feature (79)..(79): Xaa is any aa, unknown, or other
MSPSGELLGVISSALXVAFVFLACVELGDAAAAVSVYPLIQYDLAGAPLGSRXXVLKSPRAVLPLPAGENSPXRXRXAXLELRSPSQRVLVKKNSWGDCSFCSPQPG

SEQ ID NO: 13393 - DNA, 708 bp, Zea mays
  misc_feature: Ceres CLONE 1373824-F
  misc_feature: Encodes the peptide sequence at SEQ ID NO. 13394
  misc_feature (263)..(263): n is a, c, t, g, unknown, or other
  misc_feature (284)..(284): n is a, c, t, g, unknown, or other
  misc_feature (310)..(310): n is a, c, t, g, unknown, or other
  misc_feature (356)..(356): n is a, c, t, g, unknown, or other
  misc_feature (405)..(405): n is a, c, t, g, unknown, or other
  misc_feature (443)..(443): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcngcggcgtgctgctggtcgtancagccacggccccgggcggaggacgnagtggtcgaaacggaccgcagggaggacctgcggtggtgcaagcangcgtgcgagtggcagtacggaaaggacaccccgcggaaagagggatgcnagagcgagtgccgcgagcggcaccagcaagctgacgcnggcgaggacggcgacagcggcgtggacgcctacgtctcccgctccgggaggggcgagtgccggcgccagtgcctgcgccgccacgagggccagccgtggaagaccccagagtgcatgaggcggtgccgccgccgcggactggccgtcgacatggagcaagatacggtcgcggcagcaagagcccggccaggtgccggagaggtgcaagccccacacccgcggggactggtggaaaagcaacctgctagataaaaaaaaannnnna

SEQ ID NO: 13394 - protein, 74 aa, Zea mays
  misc_feature: Ceres CLONE 1373824-F
  misc_feature (17)..(17): Xaa is any aa, unknown, or other
  misc_feature (24)..(24): Xaa is any aa, unknown, or other
  misc_feature (48)..(48): Xaa is any aa, unknown, or other
  misc_feature (64)..(64): Xaa is any aa, unknown, or other
MGKGSVGASWWAFLLLXGVLLVVXATAPGGGRSGRNGPQGGPAVVQAXVRVAVRKGHPAERGMXERVPRAAPAS

SEQ ID NO: 13395 - DNA, 758 bp, Zea mays
  misc_feature: Ceres CLONE 1373825-F
  misc_feature: Encodes the peptide sequence at SEQ ID NO. 13396
atagctggagctccccgcggtggcggccgctctataactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcgtctcatcggcgtggagtacatcgtgtcgaggaagatcttcgactcgctgccggcggaggagcagcggctgtggcactcgcacgcgccacgaaatcaagtcaggcctgtggacgagcccccacgtggcggggctgcttggagaaggcggaagctgaaccaaattgccccccacgttcggacaatttctggttgccccttggcagtggtacccggggcgaacgccttgcccctggtgatccccccgcctttcttggggcccccgaaagggccaacccccgccgcagaggaggggtaccggaacttggacccg

SEQ ID NO: 13396 - protein, 201 aa, Zea mays
  misc_feature: Ceres CLONE 1373825-F
  misc_feature (26)..(201): Pfam Name: DUF1264 Pfam Description: Protein of unknown function (DUF1264)
MASSDGKPLPTPASVGGGGGSSTAPPGQPTTVASKVLDMGAAAMQSLRPVKQAKQHMCTFALYAHDPKRQVETHHYVSRLNQDFLQCAVYDSDKADARLIGVEYIVSRKIFDSLPAEEQRLWHSHAPRNQVRPVDEPPRGGAAWRRRKLNQIAPHVRTISGCPLAVVPGANALPLVIPPPFLGPPKGPTPAAEEGYRNLDP

SEQ ID NO: 13397 - DNA, 640 bp, Zea mays
  misc_feature: Ceres CLONE 1373831-F
  misc_feature: Encodes the peptide sequence at SEQ ID NO. 13398
aagctggagctccccgcggtggcggccgctctagaactagtggatcccccgggctgcaggaattcgcacgagaccattacctagaacatcctaatcgaaaaccttctccgccgccacgctagagaggaagagcgcgcggagagcgagagcccgggagaaacagcggccggcggcaaaatggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgggaagaagatccaaggaattccacacctgagacctgctgagtacaagaggtctaggttgccaaggaaccgcaggactgtgaaccgtccatatggtggtgttctgtctggtaccgcagtcagagagaggatcatccgtgcctttttggtcgaggagcagaagatcgtgaagaaggttttgaagatccaaaagaccaaggataaggcctccaagaactaggcgatataggcatcttccacaatgttcaagtcccttagatgatatggtttaaattttgagcggaagttgcggatccttttatttttttaaaatctcggtggag

SEQ ID NO: 13398 - protein, 119 aa, Zea mays
  misc_feature: Ceres CLONE 1373831-F
  misc_feature (5)..(103): Pfam Name: Ribosomal_L34e Pfam Description: Ribosomal protein L34e
MVQRLTYRKRHSYATKSNQTRVVKTPGGRLVYQYTKKRASGPKCPVTGKKIQGIPHLRPAEYKRSRLPRNRRTVNRPYGGVLSGTAVRERIIRAFLVEEQKIVKKVLKIQKTKDKASKN

SEQ ID NO: 13399 - DNA, 641 bp, Zea mays
  misc_feature: Ceres CLONE 1373847-F
  misc_feature (428)..(428): n is a, c, t, g, unknown, or other
  misc_feature (478)..(478): n is a, c, t, g, unknown, or other
aaagctggagctccccgcggtggcggccgctctagaactagtggatcccccgggctgcaggaattcgcacgagaccattacctagaacatcctaatcaaaaagaggcgagacgagtggccgcagcatcaggaccgtctccaactcgccagtactcagccgccgcaatcagggacagggagctcgagcgcgcgccccacctgcgccgacgcgatgcgggccaaggttcctctttccctcgcctccgctgcgttcttctttccatgatgatgcgatgaaaccgtgtcctaggtagctttgcggagctagtcattttctaggttttcgccgtgggctgtgggtggccagaggcgacaatcccagcgaggtgggtggcgttgggcgccgcatccgccttggccgtcttgctggccgccgctgcccctgccgncagggggaaggacgacacggaggagtccaggtacaaggccccgactgcanggtccctggttcaagcccaaacgaaacaaaatactcaaaccaactctcgccgcccgccgcgatggaacatcggaggagcatcccctcgtctacgttccttcggacggcagcacgaccatccggctccgacgaaacattcttgattccccgccttcacctttcg

SEQ ID NO: 13400 - DNA, 618 bp, Zea mays
  misc_feature: Ceres CLONE 1373851-F
  misc_feature: Encodes the peptide sequence at SEQ ID NO. 13401
  misc_feature (185)..(185): n is a, c, t, g, unknown, or other
  misc_feature (524)..(524): n is a, c, t, g, unknown, or other
  misc_feature (530)..(530): n is a, c, t, g, unknown, or other
  misc_feature (574)..(574): n is a, c, t, g, unknown, or other
  misc_feature (601)..(601): n is a, c, t, g, unknown, or other
aaaagctggagctccccgcggtggcggccgctctagaactagtggatcccccgggctgcaggaattcgcacgagaccattacctagaacatcctaatcgaaaaatctccagcggcttcttccaaagctccaactccgacgagaaccgccactcctcgaaatctcgaaggattttctgcggcgaanccccttcgtgacgtgacccaatgggagaggcctcgccgtcgatcgccaaggacgtcaccgagttgatcgggaacacgccgctggtgtacctcaacaaggtgaccgatgggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactgggctttatggctgctaccaagggctacaaacttacactcacaatgcctggcctcatgagcatgnagaggnagatcatattgaaggctttgggtgctgaactttgtcttactganccactctttgggaaatgaagagctgtncagaaaagcggagagat

SEQ ID NO: 13401 - protein, 128 aa, Zea mays
  misc_feature: Ceres CLONE 1373851-F
  misc_feature: SWISSPROT Homolog: EC 2.5.1.47 Cysteine synthase
  misc_feature (107)..(107): Xaa is any aa, unknown, or other
  misc_feature (109)..(109): Xaa is any aa, unknown, or other
  misc_feature (123)..(123): Xaa is any aa, unknown, or other
MGEASPSIAKDVTELIGNTPLVYLNKVTDGCVGRVAAKLESMEPCSSVKDRIGYSMITDAEEKGLITPGVSVLIEPTSGNTGIGLGFMAATKGYKLTLTMPGLMSMXRXIILKALGAELCLTXPLFGK

SEQ ID NO: 13402 - DNA, 627 bp, Zea mays
  misc_feature: Ceres CLONE 1373867-F
  misc_feature: Encodes the peptide sequence at SEQ ID NO. 13403
tggagctccccgcggtggcggccgctctagaactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggcaccatagtgccttaaaaaaagggaatggttcttaacagaaaggacaaaaggactgggcgtccaaaaatttggatatacagggacaaagttactaatgaaccaaagggtgatgcaacagtcacctatgaggatccacatgctgcttcagctgctgtggaatggttcgataacaaggatttccatgggagcactattcaggttcacatagctgagtcaaaaagcaaagatgcattcgataaccccacaagttt

SEQ ID NO: 13403 - protein, 75 aa, Zea mays
  misc_feature: Ceres CLONE 1373867-F
MVLNRKDKRTGRPKIWIYRDKVTNEPKGDATVTYEDPHAASAAVEWFDNKDFHGSTIQVHIAESKSKDAFDNPTS

SEQ ID NO: 13404 - DNA, 627 bp, Zea mays
  misc_feature: Ceres CLONE 1373870-F
  misc_feature: Encodes the peptide sequence at SEQ ID NO. 13405
  misc_feature (591)..(591): n is a, c, t, g, unknown, or other
tggagctccccgcggtggcggccgctctagaactagtggatcccccgggctgcaggaattcgcacgagaccattacctagaacatcctaatcgaaaaatctcgtctatcgtgtcccgaccgcatcgcgaacagtgatgctcctgagtctcgttctcgccggagatcagacgcgccaccgacgttcgatggatgtgtcctacggtcgttccgcaggcggaagtgactctgctccccgcttcctctggtacatctatcagaactattgcgttcgtcgctcctacgttctctgagtgatcactcacgaaggcgaggagctctatcttctgtgctatccacagaaggagaaactgtgactatgcagcatcgctttatcaccctggtaggtgcagctgtcgccggacctatcgttgacgcagctgtcggaacctgcgatcgggatacacttcgtgcgcgacgtcatgatacgtgtgaactgcctcgaggcttctggcagacctttctcactagtgtcagaaataagaattactttaatacaaccactgtctacactgaacgctgctgcttattttgcggcaacaactattaccatncaggccgggctagctactgcctactctcagcgacaa

SEQ ID NO: 13405 - protein, 34 aa, Zea mays
  misc_feature: Ceres CLONE 1373870-F
MDVSYGRSAGGSDSAPRFLWYIYQNYCVRRSYVL

SEQ ID NO: 13406 - DNA, 634 bp, Zea mays
  misc_feature: Ceres CLONE 1373890-F
  misc_feature: Encodes the peptide sequence at SEQ ID NO. 13407
  misc_feature (437)..(437): n is a, c, t, g, unknown, or other
aagctggagctccccgcggtggcggccgctctagaactagtggatcccccgggctgcaggaattcgcacgagaccatcacctagaacatcctaatcgaaaactagactacacccccatcccgcagcagccaaaacctacctagccgccgccgcaggcggccccccatcgccgccaagatgcagatctttgtgaagactctgacggagaagaccatcactttggaggtggagtcctcggacaccattgacaatgtgaaggccaagatccaggacaaggagggcatccccccggaccagcagcgtctcatcttcgccggcaagcagctcgaggacggtcgcaccctcgccgactacgacattcagaaggagtccaccctccacctggtgctccgcctccgcggtggcgcccagaagcgtaagaagaagacgtacaccangccccaagagatcaagcacaagcacaagaatgtgaagctctccgtgctgcagttctataaaggtggacgacgccacagggcaaggtgacccgcctccgcaagggagtggccccaacaaggagggcgggggcgggcgttcttcatggccaaaccatttcaaccggcactattgggggaagggggcggccccccctatg

SEQ ID NO: 13407 - protein, 115 aa, Zea mays
  misc_feature: Ceres CLONE 1373890-F
  misc_feature (6)..(74): Pfam Name: ubiquitin Pfam Description: Ubiquitin family
  misc_feature (87)..(87): Xaa is any aa, unknown, or other
MQIFVKTLTEKTITLEVESSDTIDNVKAKIQDKEGIPPDQQRLIFAGKQLEDGRTLADYDIQKESTLHLVLRLRGGAQKRKKKTYTXPQEIKHKHKNVKLSVLQFYKGGRRHRAR

SEQ ID NO: 13408 - DNA, 653 bp, Zea mays
  misc_feature: Ceres CLONE 1373893-F
  misc_feature: Translation starting site: 138
  misc_feature (351)..(351): n is a, c, t, g, unknown, or other
  misc_feature (352)..(352): n is a, c, t, g, unknown, or other
  misc_feature (367)..(367): n is a, c, t, g, unknown, or other
  misc_feature (470)..(470): n is a, c, t, g, unknown, or other
  misc_feature (471)..(471): n is a, c, t, g, unknown, or other
  misc_feature (476)..(476): n is a, c, t, g, unknown, or other
  misc_feature (573)..(573): n is a, c, t, g, unknown, or other
tggagctccccgcggtggcggccgctctagaactagtggatcccccgggctgcaggaattcgcacgagaccattacctagaacatcctaatcgcaaaactccgatcctgccctctaataacagcagcagcagccgccatggaaggcagcagcaagaagctccagccgttcctcctcacgctgctgctggtgctctccaccgccgtgacgcccatcctctcgctgtcagtgccagacgacgaggtagcctgcgactgcgacaaacccaaggcgcccaagccgtcgcacccgcccaagaccaagccctcccacccgtcgccgaagcccaagaaccccaagccacccaagggcnnggcaccgggtacccnggcgccagggcaccaaccgcccaagagccctcctacccccccgggtcgtcggcccctccccaaggcccccgtcacgcgcccggccagtcacgcgtccgccggnncgtcnggtccctccaaagggccccgtcacggcgcccgccgggtcacgcggtcccgccgggttgtccgaaaccaccggggaccttaacccgccgatcaacggnccctccgacgacgcccggcctggttgtcggaaccacccggtggacctaacccggccgatcacccggcccctcccacaacc

SEQ ID NO: 13409 - DNA, 635 bp, Zea mays
  misc_feature: Ceres CLONE 1373894-F
  misc_feature: SWISSPROT Homolog: EC 1.1.1.1 Alcohol dehydrogenase
  misc_feature (488)..(488): n is a, c, t, g, unknown, or other
  misc_feature (544)..(544): n is a, c, t, g, unknown, or other
  misc_feature (556)..(556): n is a, c, t, g, unknown, or other
aaagctggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatgagggaaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcnaggcgcaacttgatctgttccccagagtcttcggccacaggcatccggagtaatanagaagtggcggntgaaggtggtgaccgagttccaagtccggtgaccacggttctcactgtcttcccttgggggaatgcaagagctgcaagc

SEQ ID NO: 13410 - DNA, 645 bp, Zea mays
  misc_feature: Ceres CLONE 1373896-F
  misc_feature (450)..(450): n is a, c, t, g, unknown, or other
  misc_feature (451)..(451): n is a, c, t, g, unknown, or other
  misc_feature (454)..(454): n is a, c, t, g, unknown, or other
  misc_feature (539)..(539): n is a, c, t, g, unknown, or other
  misc_feature (540)..(540): n is a, c, t, g, unknown, or other
  misc_feature (579)..(579): n is a, c, t, g, unknown, or other
  misc_feature (580)..(580): n is a, c, t, g, unknown, or other
  misc_feature (599)..(599): n is a, c, t, g, unknown, or other
  misc_feature (612)..(612): n is a, c, t, g, unknown, or other
  misc_feature (626)..(626): n is a, c, t, g, unknown, or other
aagctggagctccccgcggtggcggccgctctagaactagtggatcccccgggctgcaggaattcgcacgagaccattacctagaacatcctaatcgaaaaagctctctctcccgctccttcgccctcgcacgtcgtctctttcctcgcgagcgacgcgcgcttctcacccgcatcgccgatggagacgccgctgtccaccaggaggatcactcgctcgctggccgccgcatccgcccagaagagcgccgccgcagggatggactccgccgccctcttctccctgtccaagaacgccgccgcgggtgagacacacgcacagacgcgcgcggcccttcacgacatcaccaacgacttcccccgtcgtcggccctcgccgcgggcagcctccacgccaccgacaccacccccgccagaaacccgccgcagggccccgcgctgcacgccaggnnttnccggggaggcgctcctgcgcggccaggtcaaggcgtcctgcacaagggtcgaccgagggaagcagggctgcgcccgccgccgggnnccctcgtcaggcccaagcgcatcagcggcctttgctcgnnggtctcccaggtccccggncccagcttcttgncgcccacgccggcnaaaaaggccgcagaatcgg

SEQ ID NO: 13411 - DNA, 645 bp, Zea mays
  misc_feature: Ceres CLONE 1373897-F
  misc_feature: Encodes the peptide sequence at SEQ ID NO. 13412
  misc_feature (492)..(492): n is a, c, t, g, unknown, or other
  misc_feature (522)..(522): n is a, c, t, g, unknown, or other
  misc_feature (523)..(523): n is a, c, t, g, unknown, or other
  misc_feature (530)..(530): n is a, c, t, g, unknown, or other
  misc_feature (535)..(535): n is a, c, t, g, unknown, or other
  misc_feature (539)..(539): n is a, c, t, g, unknown, or other
  misc_feature (581)..(581): n is a, c, t, g, unknown, or other
  misc_feature (582)..(582): n is a, c, t, g, unknown, or other
  misc_feature (592)..(592): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (636)..(636): n is a, c, t, g, unknown, or other
  misc_feature (644)..(644): n is a, c, t, g, unknown, or other
aagctggagctccccgcggtggcggccgctctataactagtggatcccccgggctgcaggaattcgcacgagaccattacctagaacatcctaatcgaaaaatcgtgtcgtttcttccctttcccgtttcccccgttcagttcagcttcggttggctcgccgtactcgggttgttcctcgcctcgcttcgcttccttcctccgcagtcctcgtctcgaattcgctcgcggtgggagaaatcggggcgcgaggatgaccgtgatcgacatcctcacccgggtggacgcgatctgccagaagtacgacaagtacgacgtcgacaagctcaacggcgccaacgtcgccggcgacgacccgttcgcccgcctctacgcgtccgtcgacgcggacatcaaccaatgcgtcgataaagcggaaacggcgaagcaagagaagaaacgggccccgcggtggtggcgctttaacgccgagatccggcgcaccaaggccagnccccctcgaggaggaccttcccaagctggnncgcctcncccgntaanaaaggtgaaagggctgacaagagaagaaatgcgacccgtaannggatctgggntgccgctttacctgacagaatacatcaatcccgcgggtnnntantgctactnc

SEQ ID NO: 13412 - protein, 130 aa, Zea mays
  misc_feature: Ceres CLONE 1373897-F
  misc_feature (80)..(80): Xaa is any aa, unknown, or other
  misc_feature (91)..(91): Xaa is any aa, unknown, or other
  misc_feature (93)..(93): Xaa is any aa, unknown, or other
  misc_feature (95)..(95): Xaa is any aa, unknown, or other
  misc_feature (96)..(96): Xaa is any aa, unknown, or other
  misc_feature (110)..(110): Xaa is any aa, unknown, or other
  misc_feature (114)..(114): Xaa is any aa, unknown, or other
  misc_feature (127)..(127): Xaa is any aa, unknown, or other
  misc_feature (128)..(128): Xaa is any aa, unknown, or other
MTVIDILTRVDAICQKYDKYDVDKLNGANVAGDDPFARLYASVDADINQCVDKAETAKQEKKRAPRWWRFNAEIRRTKAXPPRGGPSQAGXPXPXXKVKGLTREEMRPVXGSGXPLYLTEYINPAGXXCY

SEQ ID NO: 13413 - DNA, 642 bp, Zea mays
  misc_feature: Ceres CLONE 1373902-F
  misc_feature: Encodes the peptide sequence at SEQ ID NO. 13414
  misc_feature (297)..(297): n is a, c, t, g, unknown, or other
  misc_feature (298)..(298): n is a, c, t, g, unknown, or other
  misc_feature (384)..(384): n is a, c, t, g, unknown, or other
aaagctggagctccccgcggtggcggccgctctagaactagtggatcccccgggctgcaggaattcgcacgagaccattacctagaacatcctaatcgaaaactatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccgggctgacgacgatgnnatgggcgccggcgggctggtacccctacgcggagtacctgaggcagccgcagggcagccccgctggcggcggcgcctactaccggncggggtgtggggcagcccgagcgccatgttccagccgctccggcaacagtgctgccagcagcagatggaggatgatgggacgtgcagtccgtcgcgcagcagctgcagatgatgatgcaagcttgagcgtgccgctgccgccagcagcagcctgtacgagccagctctgatgcagcagcagcagcagctgctggcagcccagggtctcaacccatggcccatgatggatggcgcagaaatgcggggccttgggtggac

SEQ ID NO: 13414 - protein, 128 aa, Zea mays
  misc_feature: Ceres CLONE 1373902-F
  misc_feature (44)..(44): Xaa is any aa, unknown, or other
  misc_feature (73)..(73): Xaa is any aa, unknown, or other
MKMVIVLVVCLALSAASASAMQMPCPCAGLQGLYGAGAGLTTMXWAPAGWYPYAEYLRQPQGSPAGGGAYYRXGCGAARAPCSSRSGNSAASSRWRMMGRAVRRAAAADDDASLSVPLPPAAACTSQL

SEQ ID NO: 13415 - DNA, 636 bp, Zea mays
  misc_feature: Ceres CLONE 1373903-F
  misc_feature: Encodes the peptide sequence at SEQ ID NO. 13416
  misc_feature (478)..(478): n is a, c, t, g, unknown, or other
  misc_feature (481)..(481): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (527)..(527): n is a, c, t, g, unknown, or other
  misc_feature (535)..(535): n is a, c, t, g, unknown, or other
  misc_feature (536)..(536): n is a, c, t, g, unknown, or other
tggagctccccgcggtggcggccgctctagaactagtggatcccccgggctgcaggaattcgcacgagaccattacctagaacatcctaatcgaaaattcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactaccgaagggcgtggcaagaatcaggagagagatagcaagggggctagctagctgagctcgtgccacaaagaatggccggaattggcaagaacatggtggcggcgctcctggtgctcacctcatcatgtacatcatcgtcatcggcttcgcgagctggaaactgaaacacttcatcaacgggcagaccactacccccggcgtggccggcaanggncgcgacgtctactttccctggggttcccaccggccnnnnnnnnggngtgggggnncccgggtgcccaaccaggggggggggggggggcaccctgggggggcccggggggccccccaacaactggtggggaccaacaagccggcggtggttcttct

SEQ ID NO: 13416 - protein, 81 aa, Zea mays
  misc_feature: Ceres CLONE 1373903-F
  misc_feature (29)..(29): Xaa is any aa, unknown, or other
  misc_feature (43)..(43): Xaa is any aa, unknown, or other
  misc_feature (44)..(44): Xaa is any aa, unknown, or other
  misc_feature (45)..(45): Xaa is any aa, unknown, or other
  misc_feature (46)..(46): Xaa is any aa, unknown, or other
  misc_feature (49)..(49): Xaa is any aa, unknown, or other
MYIIVIGFASWKLKHFINGQTTTPGVAGXGRDVYFPWGSHRPXXXXGGXRVPNQGGGGGHPGGARGAPQQLVGTNKPAVVL

SEQ ID NO: 13417 - DNA, 642 bp, Zea mays
  misc_feature: Ceres CLONE 1373906-F
  misc_feature: Encodes the peptide sequence at SEQ ID NO. 13418
  misc_feature (589)..(589): n is a, c, t, g, unknown, or other
  misc_feature (616)..(616): n is a, c, t, g, unknown, or other
aaagctggagctccccgcggtggcggccgctctagaactagtggatcccccgggctgcaggaattcgcacgagaccattacctagaacatcctaatcgaaaaacaacaccagaatccgcgaatcacagacgcgtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaaacgggagcggcacctacatcagccgcgccgccgcgctgccagcaaagtgcggcgtcgccctgcccgtacaagatcagcaccaacgttactgcaaccgattattttnaatggaggcgccctggggcgcgtcccngggcggaggaatgattgctttggcga

SEQ ID NO: 13418 - protein, 141 aa, Zea mays
  misc_feature: Ceres CLONE 1373906-F
  misc_feature (32)..(117): Pfam Name: Tryp_alpha_amyl Pfam Description: Protease inhibitor/seed storage/LTP family
  misc_feature (124)..(124): Xaa is any aa, unknown, or other
MAAPKLATLALAVLLAATVVAPPAAVRAAMSCSTVYSTLMPCLPFVQMGGAMPPQPCCGGIRSLLQQANNTPDRRTICGCLKNVANGAKRERHLHQPRRRAASKVRRRPARTRSAPTLLQPIIXNGGALGRVPGRRNDCFG

SEQ ID NO: 13419 - DNA, 634 bp, Zea mays
  misc_feature: Ceres CLONE 1373917-F
  misc_feature: Encodes the peptide sequence at SEQ ID NO. 13420
  misc_feature (388)..(388): n is a, c, t, g, unknown, or other
  misc_feature (403)..(403): n is a, c, t, g, unknown, or other
  misc_feature (404)..(404): n is a, c, t, g, unknown, or other
  misc_feature (419)..(419): n is a, c, t, g, unknown, or other
  misc_feature (493)..(493): n is a, c, t, g, unknown, or other
  misc_feature (511)..(511): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagggacggagtggtcgaacgggaccgcaaggagggacctgcggtggtgcaagcaggcgtggcgagtggcagtacggaaaggacaccccgcnggaagagggaatgcnnagagcgagtgccgcngagcggcaccagcaagctgacgcggggcgaggacggcgaccagcggcgtggacgcctacgtctccccgctcggnaaaggggggagtgccggngccagtgcctgcgccgccacgagggccagccgtgggagacccaggagtgcattgaggcggtgccgccgccgcggactggccgtcgaaatggagcaagagtacggtcgcgccagcaagagcgcg

SEQ ID NO: 13420 - protein, 118 aa, Zea mays
  misc_feature: Ceres CLONE 1373917-F
  misc_feature (60)..(60): Xaa is any aa, unknown, or other
  misc_feature (65)..(65): Xaa is any aa, unknown, or other
  misc_feature (95)..(95): Xaa is any aa, unknown, or other
  misc_feature (101)..(101): Xaa is any aa, unknown, or other
MGKGSVGASWWAFLLLAGVLLVVAATAGAEGRSGRTGPQGGTCGGASRRGEWQYGKDTPXEEGMXRASAAERHQQADAGRGRRPAAWTPTSPRSXKGGVPXPVPAPPRGPAVGDPGVH

SEQ ID NO: 13421 - DNA, 675 bp, Zea mays
  misc_feature: Ceres CLONE 1373918-F
  misc_feature: Encodes the peptide sequence at SEQ ID NO. 13422
ggagctcaccgcggtggcggccgctctagtctagtggatcccccgggctgcaggaattcgcacgagaccattacctagaacatcctaatcgaaaaaacaaacaagaagcttgcattgtctcgttgctcgatcgttgcaggtaatggagaaccctgctccgagtatcgtagtgccccccatcgccgcacctgtatcagtgaacttcaggagactcgccttccgcaacctgtacatgcgacggacgtgtccagacagcaggtagatggtgactgtggagggaagaagaggctctagtgatcaaaccggccacatgaagtacgtgagtgacttccccgtctacgatgcgcgcggctcccgatgccgtcccggtggcttggcgggcagggcgtcaaaaccacgttccggtatttccacccaggttttttaccggttgactttcgaggttgtgcacgttaaccggtttccaggcttccttaccaaaggagggggtgcccgatggaaccccttgtaaggggaaattctcaggggcgaaccggacagttttctttatgggaggagggggcctctaaaaacaaggcccctttgccataagggaaggccccccggaaacccttgatgagctctgatttgcgcggtttttccgcccgggtcttggtcccctctcaaaaaccaaaa

SEQ ID NO: 13422 - protein, 82 aa, Zea mays
  misc_feature: Ceres CLONE 1373918-F
MVTVEGRRGSSDQTGHMKYVSDFPVYDARGSRCRPGGLAGRASKPRSGISTQVFYRLTFEVVHVNRFPGFLTKGGGARWNPL

SEQ ID NO: 13423 - DNA, 609 bp, Zea mays
  misc_feature: Ceres CLONE 1373921-F
  misc_feature: Encodes the peptide sequence at SEQ ID NO. 13424
  misc_feature (480)..(480): n is a, c, t, g, unknown, or other
tggagctccccgcggtggcggccgctctagaactagtggatcccccgggctgcaggaattcgcacgagaccattacctagaacatcctaatcgaaaaagtcgaccgccgcagaccgggagtagtcgacgcgccgtcactgaatcctcagatcacggctagccgtaatcacgccactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgagcgtgagagaggtatcacaattgatattgctttgtggaagttcgagaccaccaagtactactgcanctgtcatttgatgccccctgggacccccgggactcatcaagaatatgatactggacttcccaagtggatggggtggcttatcttgactcccaactgggggtttggaggtgtatccccaggtgggaagac

SEQ ID NO: 13424 - protein, 130 aa, Zea mays
  misc_feature: Ceres CLONE 1373921-F
  misc_feature (5)..(119): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (88)..(88): Xaa is any aa, unknown, or other
MGKEKTHINIVVIGHVDSGKSTTTGHLIYKLGGIDKRVIERFEKEAAEMNKRSFKYAWVLDKLKAERERGITIDIALWKFETTKYYCXCHLMPPGTPGTHQEYDTGLPKWMGWLILTPNWGFGGVSPGGK

SEQ ID NO: 13425 - DNA, 540 bp, Zea mays
  misc_feature: Ceres CLONE 1373923-F
  misc_feature: Encodes the peptide sequence at SEQ ID NO. 13426
  misc_feature (305)..(305): n is a, c, t, g, unknown, or other
  misc_feature (351)..(351): n is a, c, t, g, unknown, or other
  misc_feature (353)..(353): n is a, c, t, g, unknown, or other
  misc_feature (354)..(354): n is a, c, t, g, unknown, or other
aagctggagctccccgcggtggcggccgctctagaactagtggatcccccgggctgcaggaattcgcacgagaccattacctagaacatcctaatcgaaaagccccgtcccactattctctcgcctgcgcttccgcctcccgagttgcgccgccgtctccatctccacccctccatcctccgcggcgcccctgcactacggccatcgcactcccctcgctagcccttttcctctgtccccaccttgcccgcgcatcctccgtgcggccgtcgcggtttcttcgctggatctgcgcccgatcaccnggcgggttcgcggctattcagcatggctgctggcctcctccgccancnntccgtcacgaatttcacccggcaaggatggctaaggggaaaaaaatgggaacctttaaacccctttataaggggggaaaaaggtttccctcctctaaaaaaaaaaagagggggtgccctccgggggggggttttacaaaaaatttcttccacaaaaaaaaaaaagggagggggggggggggggggg

SEQ ID NO: 13426 - protein, 53 aa, Zea mays
  misc_feature: Ceres CLONE 1373923-F
MAKGKKMGTFKPLYKGGKRFPSSKKKKRGCPPGGGFTKNFFHKKKKGRGGGGG

SEQ ID NO: 13427 - DNA, 605 bp, Zea mays
  misc_feature: Ceres CLONE 1373940-F
  misc_feature: Encodes the peptide sequence at SEQ ID NO. 13428
  misc_feature (442)..(442): n is a, c, t, g, unknown, or other
  misc_feature (456)..(456): n is a, c, t, g, unknown, or other
  misc_feature (464)..(464): n is a, c, t, g, unknown, or other
aaagctggagctccccgcggtggcggccgctctagaactagtggatcccccgggctgcaggaattcgcacgagaccattacctagaacatcctaatcgaaaaataatttcccctcattcatctcacagtcccaggcctcccctccctcctccccgtcgccaaccaacctccaacccccagccgatcgcgtcggagatgctgggcgtcgcgcggaggcggctcggatccggatgcgtgctcgcccagctggcgcaggccctccgccccgccgccgctcccgccaggacctactccgccgcggccaaggagataactgtacgggaagcattgaataccgcattagatgaagaaatgtcggcagacccttctgttttcttgatgggagaagaggttggcgagtaccaaggtgcatacaagaaatatccaagggtttgctttgacnagtatggccccccnataggggntctccgaaaacctcccgaacacagtgagaggggggttttcctggggattttgggggggggggggcgcctttaaaaaggggggtgtttcccccacattttttgggagagagcccttcccccccctcttttttcttttttttc

SEQ ID NO: 13428 - protein, 113 aa, Zea mays
  misc_feature: Ceres CLONE 1373940-F
  misc_feature: SWISSPROT Homolog: EC 1.2.4.1 Pyruvate dehydrogenase (acetyl-transferring)
  misc_feature (83)..(83): Xaa is any aa, unknown, or other
  misc_feature (90)..(90): Xaa is any aa, unknown, or other
MLGVARRRLGSGCVLAQLAQALRPAAAPARTYSAAAKEITVREALNTALDEEMSADPSVFLMGEEVGEYQGAYKKYPRVCFDXYGPPIGXLRKPPEHSERGVFLGILGGGGRL

SEQ ID NO: 13429 - DNA, 665 bp, Zea mays
  misc_feature: Ceres CLONE 1373941-R
  misc_feature: Translation starting site: 412
  misc_feature (665)..(665): n is a, c, t, g, unknown, or other
ttgggtaccgggccccccctcgaggtcgacggtatcgataagcttttttttttttttttttaattaccgaacacgagtttccaaacgccagcagttcatccgtcactacgatgacagcagtcagcctgctaacacaacacatcaccactagctaccatgtccctgcccagtttacaacacacgtcgagagaagatacaacagccggcacgcgcaccggtacgctaaacaggtgaaacggttctaatgacaccgcttcatagctcctaatgattctaaaatgcttccgttaactgggagcaggtcctgttcccagggtgccgtcattctcggctccgcttggtgctgcagctgggacacttgtactgcttgatgtgctccgccttggcaggggtgatgcggacacacttgccatggaaccacttctcgcacacatcgcagcagatccagaactccccgttcgcatagctctccccacaggacccacacaggtacgcctggtcctcctctgcgtcctcccggccgctgtcctcctcttctttttggtggggctggcttccccgggcttactggtagaaattggtcagttttgatggtttagagataagccttgctgccttttgctgcctgcccttggggggcttttcaattgcttcttaagcacccn

SEQ ID NO: 13430 - DNA, 1164 bp, Zea mays
  misc_feature: Ceres CLONE 1373962
  misc_feature: Encodes the peptide sequence at SEQ ID NO. 13431
ctagttcccatccattggtgtggacgtgtcacgtgtggtggttgcgttgcggggccccgatttcgagcgggtgttcaattttggtgccggatttttaaggaggatccaatttaggaagaattttggttttggggacaatggttttggactgcctgatattcgattcataggttggtcaaacgctttggagtagagaatttttttcccggaaaagaagagccatttttctagttgtgctactcgtcaatcaatccagtgaagctgaactctggaagaagaaactttcctaattagacccggtatttcgtggttggccgttggcgtctaaagtctaatttatttgtcgcgttttagtttaaaaatgaacatatttttctgtttactccgcccaaaatctttccgctggatctacttgtgaatcgggtttgtttgttttttatctgagctattcttgttgatttaggatttcgattcggcagatccaagggaacgccgaattttgcctgatttcttcgcaatttttggtccgatcaagaggctccaagccttttttttttcactcgcgagaagcaagggggctcccttttcttctttcgccatgtccatggcgttgagccgcttcacgcaatggctgtggccggggggcgccgcggcgcgggtggacacccacgagcaccccagcggggggctaacgagctcctccttccctgacttcccctccgggttccgggagcccgacaccgtcacgttctacaccggccgccagcgcgcgcgcccgaggagggtcaggaatcgccgccgcagccgcggggaggcccgtgtcgaccgggagtacgacatggtcatcgtcccgtccgacggcggtggctgcctgtctggctccgactccgacgactccgactggtccatcggctggctcgagccacaggcgccggagcttcagacggacggcgaccccgagaactgcttcgccgtcctcgtgccgtgttaccgccacggccgccaagagcagcagccccggaggcaggagggcaggtttcttggcgccggcgccctcaccgatggtggtccctctggtgagcacgctcacctcatgtgtgatttcatcgacatgctttctttagtaattctaattaaataaaatcgaaaaaaaaaaaaaaaaaa

SEQ ID NO: 13431 - protein, 180 aa, Zea mays
  misc_feature: Ceres CLONE 1373962
MSMALSRFTQWLWPGGAAARVDTHEHPSGGLTSSSFPDFPSGFREPDTVTFYTGRQRARPRRVRNRRRSRGEARVDREYDMVIVPSDGGGCLSGSDSDDSDWSIGWLEPQAPELQTDGDPENCFAVLVPCYRHGRQEQQPRRQEGRFLGAGALTDGGPSGEHAHLMCDFIDMLSLVILIK

SEQ ID NO: 13432 - DNA, 610 bp, Zea mays
  misc_feature: Ceres CLONE 1373968-F
  misc_feature: Translation starting site: 180
  misc_feature: Pfam Name: Ribosomal_S3Ae Pfam Description: Ribosomal S3Ae family
  misc_feature (200)..(200): n is a, c, t, g, unknown, or other
  misc_feature (381)..(381): n is a, c, t, g, unknown, or other
  misc_feature (442)..(442): n is a, c, t, g, unknown, or other
  misc_feature (455)..(455): n is a, c, t, g, unknown, or other
  misc_feature (470)..(470): n is a, c, t, g, unknown, or other
  misc_feature (501)..(501): n is a, c, t, g, unknown, or other
  misc_feature (505)..(505): n is a, c, t, g, unknown, or other
  misc_feature (565)..(565): n is a, c, t, g, unknown, or other
  misc_feature (572)..(572): n is a, c, t, g, unknown, or other
  misc_feature (578)..(578): n is a, c, t, g, unknown, or other
aaagctggagctccccgcggtggcggccgctctagaactagtggatcccccgggctgcaggaattcgcacgagaccattacctagaacatcctaatcgaaaatctcccgcagagcagccgacaactctctaccgtccgagaccccaagcaccagcgcggcggcggcggcggcggcgaccatggctgtcgggaagacaagnagatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggnttggctagctgatcttcagggcgacgagggatcagcttacaggaaatcaggctccgtgctngagatgtgcaggncaggaatgtgctcancaacttttggggtatgatttttaccactgantaantgaggtcccctagtgaagaagtggcagacattaatcgaagcccatggtgatgttcagacnaccgacnactacntggttgcgtttggtctgcatcggcttcaccag

SEQ ID NO: 13433 - DNA, 557 bp, Zea mays
  misc_feature: Ceres CLONE 1373979-F
  misc_feature (491)..(491): n is a, c, t, g, unknown, or other
aagctggagctccccgcggtggcggccgctctataactagtggatcccccgggctgcaggaattcgcacgagaccattacctagaacatcctaatcgaaaaacactcgccaaccccgtcatcgatctcgtttcaaatccatccatcctcgtttcctccgtcccgcagcatctcaaccccatggccaagatcaagatcgggatcaatggggttcggcaggatcgggaagggctggtggcccaggggtgggctctggcagagtggacgaatgtccagcttcgttcggccgggggaaagaacccccctttattcagggccccggaataaagtggaccctaaattggttcaaagaaacaaaacctggtaaaccggggaggggggagaacccccctttgtaaatcccggggggggagaagtctccaaaaaacactttttttttttttttttaaaaaaaaaaaaaaatttttttttttttttttttttttttttttnagaaaccccccccccggggagaaaaaacccccccccgggggggtttttttttttttgtttttattg

SEQ ID NO: 13434 - DNA, 650 bp, Zea mays
  misc_feature: Ceres CLONE 1373980-F
  misc_feature: Encodes the peptide sequence at SEQ ID NO. 13435
  misc_feature (298)..(298): n is a, c, t, g, unknown, or other
  misc_feature (331)..(331): n is a, c, t, g, unknown, or other
  misc_feature (372)..(372): n is a, c, t, g, unknown, or other
  misc_feature (373)..(373): n is a, c, t, g, unknown, or other
  misc_feature (396)..(396): n is a, c, t, g, unknown, or other
  misc_feature (415)..(415): n is a, c, t, g, unknown, or other
  misc_feature (559)..(559): n is a, c, t, g, unknown, or other
aagctggagctccccgcggtggcggccgctctataactagtggatcccccgggctgcaggaattcgcacgagaccattacctagaacatcctaatcgaaaaatatatgtaacttcattcttgcaacatcacaagcacacaggctttcacacccatcttgcattggctctccggctgctgttcttgcttcctcgctgcacacaaccaagcaaagtcacttttccaaggtaaagaagcatgcatccgagctgctctccactggcagtgcctccgggcttccggttccacccgacagacgnagagctcctctactactacctgaggaaagaggntgcctatgagcccatagatcttgatgtcataaggggagtgnnacctcacaagctttgaacatggnacctcaaagatccgtgcangattgggacggcggaacctcaggacgagtggtatttcttccagcacaggaacagaagtaccctacggggacgcgaaacaaccgggcgaccacgggtgggttcttggaaagcgaccggaccggaacaaggccatctttcctcggnaacgcttgggaagaagatatcgcctgaagaaaaaccctggtgttttacccttggcaggggcaccccatggcaaagaagacgggactggata

SEQ ID NO: 13435 - protein, 50 aa, Zea mays
  misc_feature: Ceres CLONE 1373980-F
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature (21)..(21): Xaa is any aa, unknown, or other
  misc_feature (32)..(32): Xaa is any aa, unknown, or other
  misc_feature (46)..(46): Xaa is any aa, unknown, or other
MHPSCSPLAVPPGFRFHPTDXELLYYYLRKEXAYEPIDLDVIRGVXPHKL

SEQ ID NO: 13436 - DNA, 614 bp, Zea mays
  misc_feature: Ceres CLONE 1373985-F
  misc_feature: Encodes the peptide sequence at SEQ ID NO. 13437
aaagctggagctccccgcggtggcggccgctctagatctagtggatcccccgggctgcaggaattcgcacgagaccattacctagaacatcctaatcgaaaaatcagtagtaaccactcctcgtcgtctctctcgcggtctcgcctcctgcagctagcgctcgccagaaagggaaaccgcatctgctccagcctcccgtcccgtctcggcgccgccgcctgatcgaccagagcccagcgcggggcgtcgaggccgtccggggcgggtccggcgctcagatctgaggcgagtagcaagcgaagaacatgcagatgcaggtcggaggaggcgcggccgacagcccgggcgctgcggcggcggcgggcgcggaggcgccgcgcccgagccgctacgagtcgcagaagcggcgggactggcacacgttcgggcagtacctgcgcaaccaccggccgccgctggagctggcgcggtgcagcggcgcgcacgtggctcgaggtccctgggctacctcagaccaggttcggaaagaacaagggtccacgcggcgggggttgcccccttctttcgggcacccggtcgcccggcccgggccggggccccgtggcccggttgcg

SEQ ID NO: 13437 - protein, 101 aa, Zea mays
  misc_feature: Ceres CLONE 1373985-F
MQVGGGAADSPGAAAAAGAEAPRPSRYESQKRRDWHTFGQYLRNHRPPLELARCSGAHVARGPWATSDQVRKEQGSTRRGLPPSFGHPVARPGPGPRGPVA

SEQ ID NO: 13438 - DNA, 651 bp, Zea mays
  misc_feature: Ceres CLONE 1373991-F
  misc_feature: Translation starting site: 502
  misc_feature (499)..(499): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaaactcacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcggacaccatccgcacggccatcggcgtcatcggtgggtagtagtcaatacctgcttagcaatgggaccgccctagtgctcttcctctccccggtgcctacgttcatccgcatctggaagaaggggtcggtggagcagtactcgccgatcccgtacgtggcgacgctgctgaactngcatgatgtgggtgttgtacgggctgccgctggtgcacccgcacagcatgctggtgatcaccatcaacggcaccggcatgctcatccagctgacctacgtggcgctcttcctcgtctactcccgcggggncggcgcgccgcaaggtgtccct

SEQ ID NO: 13439 - DNA, 633 bp, Zea mays
  misc_feature: Ceres CLONE 1373995-F
  misc_feature: Translation starting site: 210
  misc_feature (344)..(344): n is a, c, t, g, unknown, or other
  misc_feature (370)..(370): n is a, c, t, g, unknown, or other
  misc_feature (401)..(401): n is a, c, t, g, unknown, or other
  misc_feature (402)..(402): n is a, c, t, g, unknown, or other
  misc_feature (407)..(407): n is a, c, t, g, unknown, or other
  misc_feature (411)..(411): n is a, c, t, g, unknown, or other
  misc_feature (464)..(464): n is a, c, t, g, unknown, or other
aaagctggagctccccgcggtggcggccgctctagaactagtggatcccccgggctgcaggaattcgcacgagaccattacctagaacatcctaatcgaaaactcacaaaaccctcgccagcttatcccccttccctccctcacacgatctctcctcgacggctaacccggattgccgtctcaggctcgggatccgggcgctcgcggcgatggacggcggcggcggcgctggcggcgcggagggggagctcacggcgcaggagacagcgctctacgaccgccagatccgcgtctggggcgtcgatgcccagaagagttctgcaagaatattgttctagctggangtggaaagttatccttgatggatgantatgtagtcacagagggagatctgaatgcannattcntaantcctcctgatgagagcatatatggtggtagatctcgagcccaagtttgctgcnagcctttgatagattccaatcctatgttaagagtttcgggtgaaaaggtgatccatcattattggagggagattccttggacaagtcaaacttggtggacttaaccgggggttccttaaaaaaaaattgttgattaaggaaaatgggcaaaaaaaaacaaatttttggt

SEQ ID NO: 13440 - DNA, 649 bp, Zea mays
  misc_feature: Ceres CLONE 1373999-F
  misc_feature: Encodes the peptide sequence at SEQ ID NO. 13441
  misc_feature (369)..(369): n is a, c, t, g, unknown, or other
  misc_feature (485)..(485): n is a, c, t, g, unknown, or other
aagctggagctccccgcggtggcggccgctctagaactagtggatcccccgggctgcaggaattcgcacgagaccattacctaggacatcctaatcgaaaaatcgcttatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcngcatagacatattcaaggggaaaaagcttgaagatattgttccttcatcacacaactgtgacattccgcatgtgaaccgtactgagtatcagctgattgatatttctgaggatggnattgtgagccttcttacttcagatgccaacactaaggatgatcttagactcccaactgatgagactcttgtggcccagattaaggaaagggttcgaaagcgggaagatcttgttgtgactgtccagtctgcgatgggggaggacacatctgcccgttaaggatg

SEQ ID NO: 13441 - protein, 153 aa, Zea mays
  misc_feature: Ceres CLONE 1373999-F
  misc_feature (86)..(153): Pfam Name: eIF-5a Pfam Description: Eukaryotic initiation factor 5A hypusine, DNA-binding OB fold
  misc_feature (30)..(65): Pfam Name: KOW Pfam Description: KOW motif
  misc_feature (63)..(63): Xaa is any aa, unknown, or other
MSDSEEHHFESKADAGASKTYPQQAGTVRKNGFIVIKNRPCKVVEVSTSKTGKHGHAKCHFVXIDIFKGKKLEDIVPSSHNCDIPHVNRTEYQLIDISEDGIVSLLTSDANTKDDLRLPTDETLVAQIKERVRKREDLVVTVQSAMGEDTSAR

SEQ ID NO: 13442 - DNA, 660 bp, Zea mays
  misc_feature: Ceres CLONE 1374004-F
  misc_feature: Encodes the peptide sequence at SEQ ID NO. 13443
  misc_feature (630)..(630): n is a, c, t, g, unknown, or other
aagctggagctccccgcggtggcggccgctctagaactagtggatcccccgggctgcaggaattcgcacgagaccattacctagaacatcctaatcgaaaaataggcactagcacctcctcgcctccagctccgtcctcttcgatcccgtccaatcccccgcgtcccggtgcccctctccgccggcggctttgctgggtcccgcgctcctcctcctcctaggctgttctggttggggctgcggcgtagggaactaggtaaggatgaaggaaaggggaggcttgagggagagcgcatcgcgagcaggcagcagcgatgacatcgcacgcggatctggaccgccacatatcgcacgtgcgcgattgcaagctcttgccggaggagaacgtcaaaacgatatgggagcaggccatggcgatcctcatggaggagcgtaactgcatcacatcgccgtgccgccccaatgtctgcgagggcctctctaggaactcgatcagaacatgcacgtctttcgcatccatggccgcgctccgcaccctcgtagtctctttatgcgcgacgaccatccacgtgactactactctgcggatacggtcgccttattggtcctccgcagactccgcctcgacangaataggacattgagaggaactcatgatag

SEQ ID NO: 13443 - protein, 109 aa, Zea mays
  misc_feature: Ceres CLONE 1374004-F
  misc_feature: SWISSPROT Homolog: EC 3.1.3.16 Phosphoprotein phosphatase
  misc_feature (106)..(106): Xaa is any aa, unknown, or other
MTSHADLDRHISHVRDCKLLPEENVKTIWEQAMAILMEERNCITSPCRPNVCEGLSRNSIRTCTSFASMAALRTLVVSLCATTIHVTTTLRIRSPYWSSADSASTXIGH

SEQ ID NO: 13444 - DNA, 646 bp, Zea mays
  misc_feature: Ceres CLONE 1374006-F
  misc_feature: Translation starting site: 151
ggagctccccgcggtggcggccgctctagaactagtggatcccccgggctgcaggaattcgcacgagaccattacctagaacatcctaatcgaaaaagccgcatcccttctttcattcgccgccgccgcctcctctctgctgccgtcgccatggggagaaggcctgcgagatgctatcgccaaatcaagaacaagccataccccaagtccaggtactgccgtggtgtccctgaccccaagattaggatctacgatgttggcatgaagagaaaagggtgttgatgagttcccctactgtgtgcaccttgtctctttgggagaaaggagaatgtctcccagtgaggctcttgaagctgcccgtattgcctgcaacaaggaccttgaccaagtctgcaggaaaggatgccttcccccctttccggtccggggttccccccttcccttggccctttcggaacaacaaaaaaggcttttcggggggtggggcctgaaaggctcccaaactggaaatgggggggggccttttggaaacccccaagggacccggggtctaaggggggaacattggccaaggaacacccctttttgggttcggagcggaggcaaaaaaagggggtggacaatggcacagggaaaaaccttccgc

SEQ ID NO: 13445 - DNA, 657 bp, Zea mays
  misc_feature: Ceres CLONE 1374007-F
  misc_feature (257)..(257): n is a, c, t, g, unknown, or other
  misc_feature (298)..(298): n is a, c, t, g, unknown, or other
  misc_feature (311)..(311): n is a, c, t, g, unknown, or other
  misc_feature (343)..(343): n is a, c, t, g, unknown, or other
  misc_feature (350)..(350): n is a, c, t, g, unknown, or other
  misc_feature (353)..(353): n is a, c, t, g, unknown, or other
tggagctccccgcggtggcggccgctctagaactagtggatcccccgggctgcaggaattcgcacgagaccattacctagaacatcctaatcgaaaaacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctcntctagagctgagcaccaccttgctgaaggcagctagctagncgacgaccatggntctccctcggacaacatccgcacggccatcgncgtcatncgnaatgggacccgcctgggggttctttcctctcccccgggggcctacgttcatccccaatttgggaaaaaaggggcccggggaaaaaaaaactccccaatccccaaagggggaaaccttttaaaaacaaaaaaggggggggttaaaaggcttcccccgtgggccccccccaaaattttgggggtaaccactaaagggggccgggggggttccccccgggaaacaaaggggggggttttttttttaaaaaatactgggggggggggggggccccccaacaaaggaggccccccccttgtgggggggg

SEQ ID NO: 13446 - DNA, 617 bp, Zea mays
  misc_feature: Ceres CLONE 1374011-F
  misc_feature: Encodes the peptide sequence at SEQ ID NO. 13447
  misc_feature (322)..(322): n is a, c, t, g, unknown, or other
aagctggagctccccgcggtggcggccgctctagaactagtggatcccccgggctgcaggaattcgcacgagaccattacctagaacatcctaatcgaaaaacgggtcaccagtcaccacatccctccctcactgccatttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcggnggcagtttcgtcgccgtcgcctccatgacgtccgccgccgtctccacccagggtgggagaacaagaagccattttggccctcccagggaagggaaattggccccgggttacactttttaagggggcccctccccaaaaaggaggagaaatttttttctcccggcggccctgttggggtgggggggtacaaaaaaataaattgttgggcaccccccccaccccccccctccgaaaaagggggtgtgggtgccccccaaaaaaattctctccccccccgccccccaacacaaatagg

SEQ ID NO: 13447 - protein, 62 aa, Zea mays
  misc_feature: Ceres CLONE 1374011-F
MALRLHDVALCLSPPLAARRRSGGSFVAVASMTSAAVSTQGGRTRSHFGPPREGKLAPGYTF

SEQ ID NO: 13448 - DNA, 699 bp, Zea mays
  misc_feature: Ceres CLONE 1374020-F
  misc_feature: Encodes the peptide sequence at SEQ ID NO. 13449
  misc_feature (598)..(598): n is a, c, t, g, unknown, or other
  misc_feature (615)..(615): n is a, c, t, g, unknown, or other
  misc_feature (621)..(621): n is a, c, t, g, unknown, or other
  misc_feature (637)..(637): n is a, c, t, g, unknown, or other
  misc_feature (699)..(699): n is a, c, t, g, unknown, or other
tggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggtgagggggaatcggggaaggaggaggtgagggagtatgagagcgacatgaggaagctggaggagctgctttctaagctgaacccctcggcggaggagttcgtgccgcagtcccgccgccgcgtggacggcggcgctccccgcctttcggccgacgcgcccgtgttcgtgtcgccggcgatcgactactacgcgcgccaccaccagctcccgccgccgcagcttctgcagcagcagcagccgatgcacgtgctgcangtttgtgggtggcgtcnggcgtngtttggcatgggtggncggcgggtgggatggactccagcagcgacggatccggcaatgttcagccgatccgacggaan

SEQ ID NO: 13449 - protein, 154 aa, Zea mays
  misc_feature: Ceres CLONE 1374020-F
  misc_feature (57)..(74): Pfam Name: PAM2 Pfam Description: Ataxin-2 C-terminal region
  misc_feature (121)..(121): Xaa is any aa, unknown, or other
  misc_feature (127)..(127): Xaa is any aa, unknown, or other
  misc_feature (129)..(129): Xaa is any aa, unknown, or other
MVAVAVDGLIRGADAVPAAEREAVRAAAAEAAAKGGEGESGKEEVREYESDMRKLEELLSKLNPSAEEFVPQSRRRVDGGAPRLSADAPVFVSPAIDYYARHHQLPPPQLLQQQQPMHVLXVCGWRXAXFGMGGRRVGWTPAATDPAMFSRSDG

SEQ ID NO: 13450 - DNA, 723 bp, Zea mays
  misc_feature: Ceres CLONE 1374023-F
  misc_feature: Encodes the peptide sequence at SEQ ID NO. 13451
  misc_feature (484)..(484): n is a, c, t, g, unknown, or other
  misc_feature (713)..(713): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctcggnaaaggggcgagtgccggcgccagtgcctgcgccgccacgagggccatgccgtggaggacccagtagggtcatggaggcggtgccgccgccgccggactggccgtcgacatggggcaaagaagtacggtcgcggcagcgagagcgcgggcaagtttcccgggaaagaggtgcgagcgccaccacccgcgggggaatttggttggaaagagcagcgctgcctgatgatgcnaaaaaacccg

SEQ ID NO: 13451 - protein, 171 aa, Zea mays
  misc_feature: Ceres CLONE 1374023-F
  misc_feature (92)..(92): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSXKGRVPAPVPAPPRGPCRGGPSRVMEAVPPPPDWPSTWGKEVRSRQRERGQVSRERGASATTRGGIWLERAALPDDAKKP

SEQ ID NO: 13452 - DNA, 740 bp, Zea mays
  misc_feature: Ceres CLONE 1374025-F
  misc_feature: Pfam Name: CLP_protease Pfam Description: Clp protease
  misc_feature: SWISSPROT Homolog: EC 3.4.21.92 Endopeptidase Clp
  misc_feature (507)..(507): n is a, c, t, g, unknown, or other
  misc_feature (632)..(632): n is a, c, t, g, unknown, or other
tccccgcggtggcggccgctctagaactagtggatcccccgggctgcaggaattcgcacgagaccattacctagaacatcctaatcgaaaaaaaagagtgtgtgctgtgtgttatccatttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtcaggcggccatgcgctcgcgcttgcgcttgggccccctcgcagcgaccgcagcaaggggcactcgtcagcctcaagccttgcgcctcactggcaccacaagctcctctgtggcgcgcggagtcggatgccgcgggggggtggtgccggcgccggcgatgtcatgggcctcctcctccgggagcgcatagtcttcctcggcaacgagatcgaggacttcctcgcnggacgccgtcgtcagccagctcctcctccttgacgccatcgacccggactctgacatccgcctcttcgtcacttcaaccagggggatcccttagcgcaacatggccatctatgatgtaatgcagncttgtgagggcagacgtgtcaaactattggaatggggcatagctggatcaacagcttcataaaatcccttggtgggtggcacgaaggggcaagcgatttgccatgccc

SEQ ID NO: 13453 - DNA, 731 bp, Zea mays
  misc_feature: Ceres CLONE 1374028-F
  misc_feature: Translation starting site: 560
  misc_feature: Pfam Name: Ribosomal_L3 Pfam Description: Ribosomal protein L3
ggagctccccgcggtggcggccgctctagaactagtggatcccccgggctgcaggaattcgcacgagaccattacctagaacatcctaatcgaaaaattgtggctcctcacttccgagacgatggccccttcaggtaacgaacaggaggactgcaggatgctccttcgaatcctctgagcacccgaaggacgagtccctcggcttgcttatcaggtaagtgttcctcccgccaccacggcaaggtgaagtgattccccaggatatgaccccgagaattcttgccatctcactgccttccttggctaccaggctgcaatgactcacattgtttgtgatgctgagaatgcagcatccacaatccataacaatgaaatgttgtgaggctgttaccatcattggaacccctcctcttggcattgctgcgttcgcgtcatatgtgtagactcctcgtggcctccgaacattcaagtgtgtttgtctacaacatcttaccgaagatgcgaggagaaggttctacaacgaactggcgcaagagcatcaagaagggtttcacaaaggatgctctcaaatatgaaaatgatgctgccgaataaggacattcatctgctgcttgagaagatgaagaaatatgcttctgatagccgtgtcattgctcatacccatattacgaagatgaagggtatgaaacagaagaaggctcacctgatggagattcacgtcaatgctgtca

SEQ ID NO: 13454 - DNA, 689 bp, Zea mays
  misc_feature: Ceres CLONE 1374029-F
  misc_feature: Translation starting site: 234
  misc_feature: Pfam Name: NAM Pfam Description: No apical meristem (NAM) protein
  misc_feature (356)..(356): n is a, c, t, g, unknown, or other
  misc_feature (390)..(390): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (526)..(526): n is a, c, t, g, unknown, or other
  misc_feature (527)..(527): n is a, c, t, g, unknown, or other
  misc_feature (689)..(689): n is a, c, t, g, unknown, or other
tggagctccccgcggtggcggccgctctagaactagtggatcccccgggctgcaggaattcgcacgagaccattacctagaacatcctaatcgaaaactccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcncgcgccgcggggcgccgcccgccggtgtccatcnatcgccgaggtcgacctgtaccgcttcgacccctgggacctgccggagcgcgccctcttcggnnncgccgcgagtggtacttcttcacgccgcgggaccgcaagtaccccaacggctcccgccccaccgcgccggnncggggtcgggcttactgggaaggccacgggcgcggacaagcccggggaagcaacggggggccggaaccggcggggaatcaagaaaggcgcctcgtgtttctaccacggcaaggccggcccgggcgggggtccaggaagggaagtggaatcatgccacgagan

SEQ ID NO: 13455 - DNA, 740 bp, Zea mays
  misc_feature: Ceres CLONE 1374030-F
  misc_feature: Encodes the peptide sequence at SEQ ID NO. 13456
  misc_feature (716)..(716): n is a, c, t, g, unknown, or other
  misc_feature (740)..(740): n is a, c, t, g, unknown, or other
aagctggagctccccgcggtggcggccgctctagaactagtggatcccccgggctgcaggaattcgcacgagaccattacctagaacatcctaatccaaaaaggccctagcaacaaatccggatcccgagtccggcgacggcagtatccgagctcgcactcgcgcacccgtccatcgcatcgcatctgtcctcccatcccctcagcgccaccgcaccgcaatcacacgcgcgccacccgcgatgacgccggcggcggcgatctccggctccagcagccacgtcgtcgtctcctccgcccgcctcagggagccgttcacgctccctccgcgcaccgcttgcccaatcgccgccgccgcctcgcccgtgacccgccgcggggtcgcggtcgccgccgtgtcgagccccgttgtgtccgccgccgcggggaaggatgccaaacaggctcctaaggatttccttcgaatcattgattttgacaaggatacgataatgaagattcttaatcgagccatcgaggttaaggcattgataaagtctggagacgagagcttccaaccgtgcaaagggaacacaatgtccatgatgtttgccaagccataaatgaggacccgtgtatcatgtgcgacgagattcattttacattgggacatgctatttatacgttgcctgatgacagccagatgtgcaaacgagaggagactcgtgatgttgctanagtactctcagccgatgatgacgn

SEQ ID NO: 13456 - protein, 119 aa, Zea mays
  misc_feature: Ceres CLONE 1374030-F
  misc_feature: SWISSPROT Homolog: EC 2.1.3.3 Ornithine carbamoyltransferase
MTPAAAISGSSSHVVVSSARLREPFTLPPRTACPIAAAASPVTRRGVAVAAVSSPVVSAAAGKDAKQAPKDFLRIIDFDKDTIMKILNRAIEVKALIKSGDESFQPCKGNTMSMMFAKP

SEQ ID NO: 13457 - DNA, 678 bp, Zea mays
  misc_feature: Ceres CLONE 1374033-F
  misc_feature: Encodes the peptide sequence at SEQ ID NO. 13458
tggagctccccgcggtggcggccgctctataactagtggatcccccgggctgcaggaattcgcacgagaccattacctagaacatcctaatcgaaaaaaaaacgtgacacctccgcccaccctcgccccctccctaccggcaccgcccagatggcctgctcccacatcgccgccgcgggggtctcctcccccgccgcagcggcggctcgttccccggcgcattctcccgcttccgccttcgcgcgcctccggtcgacgcctcgtttcgcgagcgctggcttgtcggttaagggaaacggagcggcgttcccgttggtcgccgccgcggggccggccgcggcggcaccggtggccgacctggacggccgcccggccacggagaagcagcccatcatcgtcatcgacaactacgacagcttcacatacaacctctgccagtatatgggggagcttggattgaacttcgaagtataccgcaatgatgaactgaccatagaagatgtgagaaggaagaacccaaggggaatacttatttctccaggacctggtgaaccacaagattcgggaatatcattgcagactgttcttggattaggcccaaccatcccaatttttggagtttggatgcctctgcaatggattgcagaggcatttggaggaaaggatatccgtgctcct

SEQ ID NO: 13458 - protein, 176 aa, Zea mays
  misc_feature: Ceres CLONE 1374033-F
  misc_feature: SWISSPROT Homolog: EC 4.1.3.27 Anthranilate synthase
MACSHIAAAGVSSPAAAAARSPAHSPASAFARLRSTPRFASAGLSVKGNGAAFPLVAAAGPAAAAPVADLDGRPATEKQPIIVIDNYDSFTYNLCQYMGELGLNFEVYRNDELTIEDVRRKNPRGILISPGPGEPQDSGISLQTVLGLGPTIPIFGVWMPLQWIAEAFGGKDIRAP

SEQ ID NO: 13459 - DNA, 728 bp, Zea mays
  misc_feature: Ceres CLONE 1374038-F
  misc_feature: Encodes the peptide sequence at SEQ ID NO. 13460
  misc_feature (471)..(471): n is a, c, t, g, unknown, or other
tcacccgcggtggcggccgctctagaactagtggatcccccgggctgcaggaattcgcacgagaccattacctagaacatcctaatcgaaaagcagatcagagagaccgaggcgcccgcggttctgctttccttccttgccccgttcacgagagaattttctggagtcttcgactcgagcagggttccgatggcgctgcaatggatgatcctggcgtgcgtggtggcggtggaagctgcggtggctgcgctggtcacgctcccggtgccccgcgctgtgcggggccagatcgtcgcgctcacgtccttgttcctgcagcccctgtccagtgtgatacccttcgccgccttccagatcctcgatctctactggaagaaggagcacagactgatgtgcacctcggagatttgcaccgccgaagagcgcattcgcttcgagaaatctatgtttaaagctcagagaaatgtcatntctttgtgtttcagcatgtctcctttattggtgcatttatcgtattgtaaaattgaacaaggatattaaggctttggaagagaccgagaagcgcctcaaggaagagtagatctattgtgttttaaagggtggctgttgtctgctcctggtcttcagaaaatattgtaaaatatcatggttctagggatatctagtgtatagtcttctgcacaaaaaaaagaatatgttttgctgtttcagaaacatctggaagttga

SEQ ID NO: 13460 - protein, 116 aa, Zea mays
  misc_feature: Ceres CLONE 1374038-F
  misc_feature (94)..(94): Xaa is any aa, unknown, or other
MALQWMILACVVAVEAAVAALVTLPVPRAVRGQIVALTSLFLQPLSSVIPFAAFQILDLYWKKEHRLMCTSEICTAEERIRFEKSMFKAQRNVXSLCFSMSPLLVHLSYCKIEQGY

SEQ ID NO: 13461 - DNA, 733 bp, Zea mays
  misc_feature: Ceres CLONE 1374040-F
  misc_feature: Encodes the peptide sequence at SEQ ID NO. 13462
  misc_feature (598)..(598): n is a, c, t, g, unknown, or other
  misc_feature (696)..(696): n is a, c, t, g, unknown, or other
  misc_feature (697)..(697): n is a, c, t, g, unknown, or other
  misc_feature (725)..(725): n is a, c, t, g, unknown, or other
aagctggagctccccgcggtggcggccgctctagaactagtggatcccccgggctgcaggaattcgcacgagaccattacctagaacatcctaatcgaaaagctggccgctgcttaacaaaccgccgccacaggacaagacaaacttattacagctccacctcagtgctgcagagactgagggccagccaaaccgctcaccgcacacgcggaattcaagcagcatgtacgccgacgccgggttcgccttcgccttcgccgccgcctactcccccaccctcacttcctcgcagccccagccgccgccgccgccgttcgactacgccttctcctccgagccacccctcctctccatgcccgccatggaccacgacgcctacctggggaacttggtacagccatccatggtatcagaatatgacctgggaggagaaggggacctgttcaaagctccagaagccatcatcgaggaaccgctgctcagcctcgatcctgtcgcagctgccttttcaatgatggtgggcaatggaagtgctgtcatggatcaaactattaaggacgcaggcaccggcaccatccaaaatgacccctccctgagntgaggtggctgtacgagtgcgagaaggactctcagggagaagtccacaatcgaagagacaatttctgaaaactaatgggatgttaagattcctatgcnntgcaagttgaagaaatcccaagcaaagnctggaaca

SEQ ID NO: 13462 - protein, 124 aa, Zea mays
  misc_feature: Ceres CLONE 1374040-F
MYADAGFAFAFAAAYSPTLTSSQPQPPPPPFDYAFSSEPPLLSMPAMDHDAYLGNLVQPSMVSEYDLGGEGDLFKAPEAIIEEPLLSLDPVAAAFSMMVGNGSAVMDQTIKDAGTGTIQNDPSL

SEQ ID NO: 13463 - DNA, 664 bp, Zea mays
  misc_feature: Ceres CLONE 1374042-F
  misc_feature: Encodes the peptide sequence at SEQ ID NO. 13464
  misc_feature (405)..(405): n is a, c, t, g, unknown, or other
  misc_feature (456)..(456): n is a, c, t, g, unknown, or other
gctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgcntgggaagcacgttccccgtggcaatcttcgttgatctagaacccactgtgnatcgatgaggtgcgcactggcacgtaccgccagctcttccaccctgagcagctcatcagtgggcaaggaggatgccgctaacaatttcgcccgtggccactacacattggcaagggagatttgttgatctgtgccttgaccgtatccgcaagcttgctgacaactgcaccggcctccagggcttcctgtcttcaaagggcggttggtg

SEQ ID NO: 13464 - protein, 70 aa, Zea mays
  misc_feature: Ceres CLONE 1374042-F
MRECISVHIGQAGIQVGNACWELYCLEHGIQPDGQVPGDKTAGHHDDAFSTFFSQTGAWEARSPWQSSLI

SEQ ID NO: 13465 - DNA, 664 bp, Zea mays
  misc_feature: Ceres CLONE 1374048-F
  misc_feature: Encodes the peptide sequence at SEQ ID NO. 13466
  misc_feature (517)..(517): n is a, c, t, g, unknown, or other
  misc_feature (564)..(564): n is a, c, t, g, unknown, or other
  misc_feature (629)..(629): n is a, c, t, g, unknown, or other
tggagctccccgcggtggcggccgctctagaactagtggatcccccgggctgcaggaattcgcacgagaccattacctagaacatcctaatcgaaaaatcgcccataatattttgagcattcaaaaacacacaaagggaagtgcactagcaacttcctaacaacaatggctaccaagatattagccctccttgcgctcctttccctttcagtgagcgcaacaactgcattcattattccacaatgctcacttgctcctaatgccattattccacagttcctcccatcagttacatcaatgggcatcgaacaccctattgtgcaagcctataggctacaacaagcgcttgcggcgagcgtcttacaacaaccgtttgcccaattacaacaacaatccttggcacatctaaccatacaaaccatcgcaacacaactagagcaacagtttgtgcccgcattgagccaactagccgcggtgaaccctgtctcctactttgcacagcaactgcttgcatccnacccacttgctctggcgaacacagccgcaaacagcaacaactacggntgcaacaggttctaccagctcttaagtcactagccatgggggaccctggcacataactgcacagnaacaactgcttccatctacccacctcgtgggggca

SEQ ID NO: 13466 - protein, 143 aa, Zea mays
  misc_feature: Ceres CLONE 1374048-F
  misc_feature (1)..(144): Pfam Name: Zein Pfam Description: Zein seed storage protein
  misc_feature (118)..(118): Xaa is any aa, unknown, or other
MATKILALLALLSLSVSATTAFIIPQCSLAPNAIIPQFLPSVTSMGIEHPIVQAYRLQQALAASVLQQPFAQLQQQSLAHLTIQTIATQLEQQFVPALSQLAAVNPVSYFAQQLLASXPLALANTAANSNNYGCNRFYQLLSH

SEQ ID NO: 13467 - DNA, 726 bp, Zea mays
  misc_feature: Ceres CLONE 1374051-F
  misc_feature: Encodes the peptide sequence at SEQ ID NO. 13468
  misc_feature (653)..(653): n is a, c, t, g, unknown, or other
  misc_feature (654)..(654): n is a, c, t, g, unknown, or other
tggagctccccgcggtggcggccgctctagaactagtggatcccccgggctgcaggaattcgcacgagaccattacctagaacatcctaatcgaaaacttcgctgcgccgccgcctccgacatcgtctcttcgtccccacgagcaaccgataatccgccggcgctgagatgttggtttatcaagacctcctatctggcgacgagctcctgtcggattcattcacctacaaggagctcgagaacggcgtcctgtgggaggtcgagggaaagtgggtcacccaaggtcctgttgatgtagacattggtgccaatccatccgccgagggtggtgaggatgaaagcgttgatgacacagccgtgaaggtggttgatattgttgacacattccgtctacaggagcaacctccttttgacaagaaatcatttgtctcttacataaaaaaatacatcaagaatctcactgctgtgttggagccagagaaagcggatgagttcaaaaagggtgtcgagggtgcaaccaagtttctccttagcaagctgaaggaccttcaattttttgttggtgagagcatgaaggacgaagcggtccgtggtattcgcctatttccaaggatggtgccactaatccgacattcctctatttctctcatggnnctaaaggagatcaagtggctagattattaaccccatgttgggcaaactattatagtgttctattggtatagc

SEQ ID NO: 13468 - protein, 171 aa, Zea mays
  misc_feature: Ceres CLONE 1374051-F
  misc_feature (1)..(159): Pfam Name: TCTP Pfam Description: Translationally controlled tumour protein
  misc_feature (162)..(162): Xaa is any aa, unknown, or other
MLVYQDLLSGDELLSDSFTYKELENGVLWEVEGKWVTQGPVDVDIGANPSAEGGEDESVDDTAVKVVDIVDTFRLQEQPPFDKKSFVSYIKKYIKNLTAVLEPEKADEFKKGVEGATKFLLSKLKDLQFFVGESMKDEAVRGIRLFPRMVPLIRHSSISLMXLKEIKWLDY

SEQ ID NO: 13469 - DNA, 694 bp, Zea mays
  misc_feature: Ceres CLONE 1374054-F
  misc_feature: Encodes the peptide sequence at SEQ ID NO. 13470
tccccgcggtggcggccgctctagaactagtggatcccccgggctgcaggaattcgcacgagaccattacctagaacatcctaatcgaaaaccccatttcgaagcccaccgaattccctgcgattcctctcccctcgcctcctcgtctccccctagggttagcacctcgctgcctccgattcaatcataatatggtctcttctccctttgatctgtagatttggggctttggctccgcctcgcgcgcccgatccgggccgtcctccttttttcccctcttatatttgatcggtttctttgcgtcgttcacgcagggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcagcagcccgctgatgttgccggacccagcgagggggtggcggcgatctccaaaggggggaa

SEQ ID NO: 13470 - protein, 108 aa, Zea mays
  misc_feature: Ceres CLONE 1374054-F
  misc_feature (14)..(38): Pfam Name: zf-A20 Pfam Description: A20-like zinc finger
MEHKEAGCQAPEGPILCINNCGFFGSAATMNMCSKCHKEMITKQDQAKLAASSIDSIVNGSDAVMEPVVAGSNTVVAVAQVELQTMNVQQPADVAGPSEGVAAISKGG

SEQ ID NO: 13471 - DNA, 674 bp, Zea mays
  misc_feature: Ceres CLONE 1374057-F
  misc_feature: Translation starting site: 213
  misc_feature: Pfam Name: Ribosomal_L2_C Pfam Description: Ribosomal Proteins L2, C-terminal domain
aagctggagctccccgcggtggcggccgctctagaactagtggatcccccgggctgcaggaattcgcacgagaccattacctagaacatcctaatcgaaaaaccttcgtatccgacggcccaccccgctcgtctatatccgcctccaaaccctagctcttccattcttccccctccggcgccgcctcccccagacacttcgccgccggcaagatgggccgcgtgattcgcgctcagcgcaagggtgcggggtccgtgttcaagtcccatacccatcaccgcaagggccctgcccggttccggtccctcgacttcggcgagcgcaacgggtacctgaagggcgtggtcaccgacgtcatccacgacccgggccgcggcgcgccgctggacaaggtcaccttccgccatccattccggtacaagcaccagaaggagctgttcgtggctgctgagggcatgtacactggccagttcgtttactgcggacgccgtgctacactctccattggcaacgtcctgtcgctcagggggatccctgaggggtgtcgttgtctgcaacgttgagcaccacgtcggcggatcgcggcgtcttcgacagggcgtctggggactacgcgattgatatgagccataaacgagggaacggcatgttgagaatgaaggttccctacggtg

SEQ ID NO: 13472 - DNA, 675 bp, Zea mays
  misc_feature: Ceres CLONE 1374059-F
  misc_feature: Encodes the peptide sequence at SEQ ID NO. 13473
  misc_feature (102)..(102): n is a, c, t, g, unknown, or other
  misc_feature (121)..(121): n is a, c, t, g, unknown, or other
  misc_feature (402)..(402): n is a, c, t, g, unknown, or other
  misc_feature (415)..(415): n is a, c, t, g, unknown, or other
  misc_feature (448)..(448): n is a, c, t, g, unknown, or other
  misc_feature (461)..(461): n is a, c, t, g, unknown, or other
  misc_feature (462)..(462): n is a, c, t, g, unknown, or other
  misc_feature (477)..(477): n is a, c, t, g, unknown, or other
aagctggagctccccgcggtggcggccgctctagaactagtggatcccccgggctgcaggaattcgcacgagaccattacctagaacatcctaatcgaaaanatcacactcgcgaaccccngtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaaagtcaggtgaggactcaaaacctttctcttgtgagaangagtgctgtgttngctgcagaaaccctgagagatccgtgggttcgntggggctgatatnngtgtgagctactgtngtttcactgaccagagaggctgcagctcactggagggtggtgccagaaggtgccatttctgttctagcaagatgccccatgttttgcctggggccacaaaaaggataaaagttgaacttaaattggtcccagggtaagggaaaacaattggtttgcccctttggaagggcaaaaggaaaaattcgaaatcttgggggg

SEQ ID NO: 13473 - protein, 90 aa, Zea mays
  misc_feature: Ceres CLONE 1374059-F
  misc_feature (4)..(86): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (73)..(73): Xaa is any aa, unknown, or other
  misc_feature (77)..(77): Xaa is any aa, unknown, or other
MAKIKIGINGFGRIGRLVARVALQSDDVELVAVNDPFISTDYMTYMFKYDTVHGQWKHHESQVRTQNLSLVRXSAVXAAETLRDPWVRWG

SEQ ID NO: 13474 - DNA, 691 bp, Zea mays
  misc_feature: Ceres CLONE 1374060-F
  misc_feature: Encodes the peptide sequence at SEQ ID NO. 13475
  misc_feature (307)..(307): n is a, c, t, g, unknown, or other
  misc_feature (358)..(358): n is a, c, t, g, unknown, or other
  misc_feature (659)..(659): n is a, c, t, g, unknown, or other
tggagctccccgcggtggcggccgctctagaactagtggatcccccgggctgcaggaattcgcacgagaccattacctagaacatcctaatcgaaaagttccgcaccccacggcaggcgcttgagagtacttgactactaccctcccacctgcgagactgcaacgccgttgcttcaactcgactccagcatccctcgtccccgcatcaccgcgccgccgacactccgctcgctttcgctcccgagacccgggcctgccgagccgccgccatggacgaggagtacgacgtgatcgttctgggcacggngctcaaggagtgcatcctcagcggtctcctctctgtcgacggcctcaaggntctacacatggatagaaatgattactacgggagagattccaccctccctaaaccctgacccagctctggaagaaggtttagggggggaagacaaagcaccgggcacatcttaggggcgaggcaaagatttaaaggggaaaccttggttccaaaggttttaggtgggaaaacggggatttttgggttcgaaccccttttttttcccggggggggggaaaaaaaattttttgtcttttccaaaaaggtgtggggaggggagaaaaaattttttcttcttccccccccacggcggggggggganttttttatacggggggatcctcccctcccccc

SEQ ID NO: 13475 - protein, 48 aa, Zea mays
  misc_feature: Ceres CLONE 1374060-F
  misc_feature (13)..(13): Xaa is any aa, unknown, or other
  misc_feature (30)..(30): Xaa is any aa, unknown, or other
MDEEYDVIVLGTXLKECILSGLLSVDGLKXLHMDRNDYYGRDSTLPKP

SEQ ID NO: 13476 - DNA, 677 bp, Zea mays
  misc_feature: Ceres CLONE 1374066-F
  misc_feature: Encodes the peptide sequence at SEQ ID NO. 13477
  misc_feature (401)..(401): n is a, c, t, g, unknown, or other
  misc_feature (643)..(643): n is a, c, t, g, unknown, or other
tggagctccccgcggtggcggccgctctagaactagtggatcccccgggctgcaggaattcgcacgagaccattacctagaacatcctaatcaaaaaaaatcctccgaaccccgccgccgacgagcgagctatggcgctggcgcggtggctgctccgccttactccctacctcggcacgctctcgctcccaccccccaactcgcatctcctccggaatcgcacctatgtctctgacatgcgccgctctgccttcgtcgaccgcttgctccgttccgtacgctccgagatctccttcctcgataactccgccccgccaccgccgccaccgcctcctaagccattcaccattgaggaccgcccgggcgagcagtgggcccgcctgcgccgcggtccgcggggncccgagagggaattcataagcaactgggatgacatgcaaaagatctggcatcacagcttctataatgagcttcgtgtgagaccagaagagcacccagctcttcgtacagaggctcctcttaaccctaaggctaacagggaaaagatgacacgaatcatgtctgaaaactgtcagtggtcctggctatgaatggtgctattcaaggtgtcctttccctttatgctagtggccggaccactggnattggtccggagtccgggagacgggggcagccac

SEQ ID NO: 13477 - protein, 152 aa, Zea mays
  misc_feature: Ceres CLONE 1374066-F
  misc_feature: SWISSPROT Homolog: EC 2.7.10.2 Non-specific protein-tyrosine kinase
MALARWLLRLTPYLGTLSLPPPNSHLLRNRTYVSDMRRSAFVDRLLRSVRSEISFLDNSAPPPPPPPPKPFTIEDRPGEQWARLRRGPRGPEREFISNWDDMQKIWHHSFYNELRVRPEEHPALRTEAPLNPKANREKMTRIMSENCQWSWL

SEQ ID NO: 13478 - DNA, 695 bp, Zea mays
  misc_feature: Ceres CLONE 1374073-F
  misc_feature (343)..(343): n is a, c, t, g, unknown, or other
  misc_feature (377)..(377): n is a, c, t, g, unknown, or other
  misc_feature (380)..(380): n is a, c, t, g, unknown, or other
  misc_feature (489)..(489): n is a, c, t, g, unknown, or other
  misc_feature (576)..(576): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcaccacggccggggcggaggacgagtgtcaacgggaccgcaaggaggactgcggtggtgaagcnagcgtgcgagtgcagtacgtaaggacacccgcgnaanagggatgcgagagcgagtggcgcgagcggcaccagcagctgacgcgggcgaggacggcgacagcggcgtggacgcctacgtctcccgctcccggaggggcgagtgccgncgccagttgctgcgccgccaccagggccagccggggaaggacccaggagtgcatggagggggggccgccgcccgggcattggcgtcnaattggaacaaaaagtaccggtcccggaaacaaaaagcgggcaaatggcccggaaaaagggggaaagggcccccccccgggggaaattgggggggaaaaagaaccccttccctatgaat

SEQ ID NO: 13479 - DNA, 704 bp, Zea mays
  misc_feature: Ceres CLONE 1374078-F
  misc_feature: Encodes the peptide sequence at SEQ ID NO. 13480
  misc_feature (274)..(274): n is a, c, t, g, unknown, or other
  misc_feature (281)..(281): n is a, c, t, g, unknown, or other
  misc_feature (319)..(319): n is a, c, t, g, unknown, or other
  misc_feature (320)..(320): n is a, c, t, g, unknown, or other
  misc_feature (366)..(366): n is a, c, t, g, unknown, or other
  misc_feature (460)..(460): n is a, c, t, g, unknown, or other
gctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggtgcgnaggacgnagtggtcgaacgggaccgcaggtaggaccctgcgtggnntgcagcagcgtgcgagtggcagtacggaaaagacaccccgccgaanagggaatgcaagagcgagtgccgcgagcggcaccaacagctgacgcgggcgaggacagcgaccgcggggtggacgcctacgtctccgctccggnagggcggagggccgccccaatggctgcgccgccacgagggccagccggggaaaaccacgaatggattgggggggtgcccccccccccggaattggcctccacattgaagaagaagatcgtccccgcaaacaaaaagggggtcaatgtcccggggaaaggggggaaggcgcccccccccgggaattgtggggaaaaagagaagtgtgcgtgaggaacgaggcaaatgcgagtgccactagaaagc

SEQ ID NO: 13480 - protein, 39 aa, Zea mays
  misc_feature: Ceres CLONE 1374078-F
  misc_feature (30)..(30): Xaa is any aa, unknown, or other
  misc_feature (32)..(32): Xaa is any aa, unknown, or other
MGKGSVGASWWAFLLLAGVLLVVAATAGAXDXVVERDRR

SEQ ID NO: 13481 - DNA, 665 bp, Zea mays
  misc_feature: Ceres CLONE 1374079-F
  misc_feature: Encodes the peptide sequence at SEQ ID NO. 13482
  misc_feature (582)..(582): n is a, c, t, g, unknown, or other
tggagctccccgcggtggcggccgctctagaactagtggatcccccgggctgcaggaattcgcacgagaccattacctagaacatcctaatcgaaaactcgcgggctttcccgcagcaagatcaacgtcgtcgttcaagccagcggtagtagagactacgaccgaggctagctaagctaagagatggcggatcaccagtactcggcgtggacgacttccgctgctcgtcatcgggtcttctcctgtgcgctcatggctcttgttagttttgtggctgcaggacgacccatggtgctcgccgacgccatcgtctttcacgtggcgaacaggtgcccgttcccggtgtggccggcgtccgcccctaacaccggccacccagtgctcgccggcggcggcttctacgtcccgcagggcaagtcgaaggcgcgtcgtcgcgccggccaactggaacgggcgcttctgggcccgcaccggttgcaacttcaccgcgaacggctgggggcgtagcgggctgcctcaccgcggactggcgagggccggctcgcctgtaacgggggtccgttgggcgccccgcccgcccgncttagtcgaggtgagccctgcacgaggacgcccccgaaagggagcctcctacgacgggagcccttggttgaacgggtaccaac

SEQ ID NO: 13482 - protein, 107 aa, Zea mays
  misc_feature: Ceres CLONE 1374079-F
MADHQYSAWTTSAARHRVFSCALMALVSFVAAGRPMVLADAIVFHVANRCPFPVWPASAPNTGHPVLAGGGFYVPQGKSKARRRAGQLERALLGPHRLQLHRERLGA

SEQ ID NO: 13483 - DNA, 652 bp, Zea mays
  misc_feature: Ceres CLONE 1374090-F
  misc_feature: Encodes the peptide sequence at SEQ ID NO. 13484
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgctagagcgagtgccgcgagcggcaccagcaagctgacgcggccgaggacggcgacagcggcgtggacgcctacgtctcccgctccggaaggggaggagtgccgtggacagtgcctgcgtcgtcatgagggtcagccgtgtgagacccaagatagattgatgtgatgcaaccacgggaaatgtgcgaccgatttgaggaaaacttgcaagctaaccacttcgttgaacggattggagactttctttaaaaag

SEQ ID NO: 13484 - protein, 63 aa, Zea mays
  misc_feature: Ceres CLONE 1374090-F
MGKGSVGASWWAFLLLAGVLLVVAATAGAEDGVVERDRKEDLRWCKQACEWQYGKDTPRKREC

SEQ ID NO: 13485 - DNA, 829 bp, Zea mays
  misc_feature: Ceres CLONE 1374094-F
  misc_feature: Encodes the peptide sequence at SEQ ID NO. 13486
  misc_feature (430)..(430): n is a, c, t, g, unknown, or other
  misc_feature (462)..(462): n is a, c, t, g, unknown, or other
  misc_feature (829)..(829): n is a, c, t, g, unknown, or other
tccccgcggtggcggccgctctagaactagtggatcccccgggctgcaggaattcgcacgagaccattacctagaacatcctaatcgaaaagaaagcaaaaaccaaccaaacaagctagctagagctagccaagccgcggcgtgcctccgctccggccggcccgcccctgtcagagcccccaccgccgctgccacctccgccagccgtcaccccaggcgttggatcggggccctctcgatccgcgcccggcgaatccagacggacccgcattggggttggggccccttcgatccggcgcttggtgggggtttggctgggagctccaggctgaggggacggggcggggggacctgatccttcattccgttcggatttcgcttttcccccgtgggtctcgactgcccggaggggaggaagacatggatttgncgtcggtcaacgaggagctggccgagatcgancggcagatcggcgatatcctccgcgtattgcaaaatggggtccagaaggctggagaaaatcaggatggcaaccgccgcagcaggcagcttgaaaagtttactgataaaaatgcgagacttgcagaaaaatcatcaaagaacttccgagggagttagcaaagctggagcttggagcatacttgatcccgcaacacggaaaaaatgtttgcttggaaaaaaaacacccccatgaacaaaaaaaataaaccccccacgcggggctcaaaaaaaacgggggggcgagggaaaaaacaagaaaaccatatttttttttagggcccaaagtggtataaaaagtctttttggggaaaaaaagcgcctcgtaaan

SEQ ID NO: 13486 - protein, 65 aa, Zea mays
  misc_feature: Ceres CLONE 1374094-F
  misc_feature (4)..(4): Xaa is any aa, unknown, or other
  misc_feature (14)..(14): Xaa is any aa, unknown, or other
MDLXSVNEELAEIXRQIGDILRVLQNGVQKAGENQDGNRRSRQLEKFTDKNARLAEKSSKNFRGS

SEQ ID NO: 13487 - DNA, 816 bp, Zea mays
  misc_feature: Ceres CLONE 1374095-F
  misc_feature: Encodes the peptide sequence at SEQ ID NO. 13488
  misc_feature (434)..(434): n is a, c, t, g, unknown, or other
  misc_feature (468)..(468): n is a, c, t, g, unknown, or other
  misc_feature (488)..(488): n is a, c, t, g, unknown, or other
  misc_feature (610)..(610): n is a, c, t, g, unknown, or other
  misc_feature (664)..(664): n is a, c, t, g, unknown, or other
tggagctccccgcggtggcggccgctctagaactagtggatcccccgggctgcaggaattcgcacgagaccattacctagaacatcctaatcgaaaaacaacaccagaatccgcgaatcacagacgcgtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatggggcgggccatgccgccccagccgtgctgcggcggcatccgcagcctgctgcagcaggccaacaacacccccgaccgnccgcacatctgcgggtgccctcagaacgtcgccnacgggcgcaacgggagcggnacctacatcagccggcgcgccgcgctgcccagcaaagtgcgcgtcgccctgccgtacaagatcagcaccaacgtttactggcacacgattaataaaatgaggcgtcctgtggcccctccggncgaggaatgcatgcatggcggaaaagaaaaaaggaatggctactgggatttttncgctaaaacgggggggggccggccctaaccttttaagggggtaacaaccccgccacaaatttcaaaaccggggttccgggggggctgtgttccccgaaaaaaaaccctagcttgaacccggggggggcctttctgggggggacccccctcag

SEQ ID NO: 13488 - protein, 159 aa, Zea mays
  misc_feature: Ceres CLONE 1374095-F
  misc_feature (32)..(119): Pfam Name: Tryp_alpha_amyl Pfam Description: Protease inhibitor/seed storage/LTP family
  misc_feature (86)..(86): Xaa is any aa, unknown, or other
  misc_feature (133)..(133): Xaa is any aa, unknown, or other
  misc_feature (151)..(151): Xaa is any aa, unknown, or other
MAAPKLATLALAVLLAATVVAPPAAVRAAMSCSTVYSTLMPCLPFVQMGRAMPPQPCCGGIRSLLQQANNTPDRPHICGCPQNVAXGRNGSGTYISRRAALPSKVRVALPYKISTNVYWHTINKMRRPVAPPXEECMHGGKEKRNGYWDFXAKTGGGRP

SEQ ID NO: 13489 - DNA, 761 bp, Zea mays
  misc_feature: Ceres CLONE 1374101-F
  misc_feature: Encodes the peptide sequence at SEQ ID NO. 13490
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (761)..(761): n is a, c, t, g, unknown, or other
aagctggagctccccgcggtggcggccgctctagaactagtggatcccccgggctgcaggaattcgcacgagaccattacctagaacatcctaatcgaaaaaaaactgcattacaccacgatacactccactacaccctctcgagcaacaccaggaaccataccaaatcccaagtagagaagagcaagggctgcagctggcaagaagctttgctcagaaatggagttcctgtcgcagatgtggtcgctcctgggcctgctcaccatcctgcagaacgtcctccccacgcagctgctctccttgctgcactcgctgtgacagtcgctccaagactctctcacgcactactcctacttcgacgtgcccgagttcctcggctctgcggccgtcgagcccaacgcgctctaccgtcatatccagttctacctccaccgttccgtccgtctctcctcgcctccgccgacaagcgtcagggtctcgatgctgcgctccctccgccggttccggcggccacgcccaacggggatgggccatccccgccggtcggtgcgtctcccaaacatcgtcgagacactgaacaacggnnnnnnnnnnnngnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnncn

SEQ ID NO: 13490 - protein, 32 aa, Zea mays
  misc_feature: Ceres CLONE 1374101-F
MEFLSQMWSLLGLLTILQNVLPTQLLSLLHSL

SEQ ID NO: 13491 - DNA, 784 bp, Zea mays
  misc_feature: Ceres CLONE 1374102-F
  misc_feature: Encodes the peptide sequence at SEQ ID NO. 13492
  misc_feature (566)..(566): n is a, c, t, g, unknown, or other
  misc_feature (735)..(735): n is a, c, t, g, unknown, or other
tggagctccccgcggtggcggccgctctagaactagtggatcccccgggctgcaggaattcgcacgagaccattacctagaacatcctaatcgaaaaattcgcaccaccgccgcgccgcccaaaccctagccgccgccgccgccgccgccgccatggtcgccgtcaaccgccccctcgtctccgtgaaggccctagagggcgacatggtaaccgacgcccccggcatcgccttaccgcccgtcttcggggcgccgatccgccccgacgtggtcaggttcacccacaagctgctgtcctgcaacaagcgccagccctacgcagtctcccgccgcgccgggcaccagacgtcggtcgagtcctggggtaccggccgcgccgtgtctcgtatcccccgcgtccccggcggcggcacccaccgcgccggtcagggagcgttcggcaacatgtgccgcggcgggcgcatgttcgcgcccaccaagatctggcgcaagtggcaccgccgcgtcaacatcaacctccgccgtgtcgccgtcgcctccgcgctcgccgtcaccgtcgtcacggncctcgtccaggcgcgcggtcacggcatcgagtctgtccccgagatgccccttgtcatttccgactccgcggagtccattgagaagactgcctagcgctctagatcctcaagcagatcggcgcccacgccgacgccgagaaagccaagactccgtcgtaatcgccccggncagggtaagatgcgcaaccgtcgctacttcaacccggaggtcccgatca

SEQ ID NO: 13492 - protein, 168 aa, Zea mays
  misc_feature: Ceres CLONE 1374102-F
  misc_feature (23)..(168): Pfam Name: Ribosomal_L4 Pfam Description: Ribosomal protein L4/L1 family
  misc_feature (138)..(138): Xaa is any aa, unknown, or other
MVAVNRPLVSVKALEGDMVTDAPGIALPPVFGAPIRPDVVRFTHKLLSCNKRQPYAVSRRAGHQTSVESWGTGRAVSRIPRVPGGGTHRAGQGAFGNMCRGGRMFAPTKIWRKWHRRVNINLRRVAVASALAVTVVTXLVQARGHGIESVPEMPLVISDSAESIEKTA

SEQ ID NO: 13493 - DNA, 942 bp, Zea mays
  misc_feature: Ceres CLONE 1374103-F
  misc_feature: Encodes the peptide sequence at SEQ ID NO. 13494
  misc_feature (1)..(1): n is a, c, t, g, unknown, or other
  misc_feature (2)..(2): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
nncccccccccccccccccccccacnnnaagggggnaaaagaannnannacaaaactggcgctccaccgcggtggcggccgctctagaactagtggatcccccgggctgcaggaattcgcacgagaccattacctagaacatcctaaaaaaacaatcaggcggaggagagaaactcccggccatttccaagcacaagaagtgggaagagagaacaggagggcgctgagctctctgatcgctgttctgagtggtggcggctgcagctgcccgcgcggcgaagatggctgcgccatggcttcttgcttgcagcttgctgctgctctccctggcgacctttcacggagctgagggcgcgatcggcgcgaactacggcatgatcgccaacaacctgccggcgccggagcaggtcgtctccatgtacaagggcgagaatatcagctacgtgcgtctgttccacccggacacgaccgtgctgaacgcgctcccgcggctccggcaatcggggccatcctggggcacgctgaaacgaggacctcccggcgcctgggcgtcccgaccccgtcccttcgcccgggccggggggggggccaccaaagggggcagccccttccggccgggggctggcccaagttcccgggcaccatccaaacggggggggcaaccggaagggtccatcccccgggggggaccccgggccgggggccaggggggctccccgggcccaaggaaaaaaacccggggaggcccgggcgctcccggggtcccgcggggggggtcggggggggggggttcccccgttacccggacggcccgggggcacaacacaagggtggcccccggacggcggttctaaaccccgcgccggcccccaggggggggccctctttccccgaggggggaggcccccgcaaaggggggagaggggccgccccgccctctct

SEQ ID NO: 13494 - protein, 190 aa, Zea mays
  misc_feature: Ceres CLONE 1374103-F
  misc_feature: SWISSPROT Homolog: EC 3.2.1.39 Glucan endo-1,3-beta-D-glucosidase
MAAPWLLACSLLLLSLATFHGAEGAIGANYGMIANNLPAPEQVVSMYKGENISYVRLFHPDTTVLNALPRLRQSGPSWGTLKRGPPGAWASRPRPFARAGGGATKGGSPFRPGAGPSSRAPSKRGGQPEGSIPRGGPRAGGQGGSPGPRKKTRGGPGAPGVPRGGSGGGGSPVTRTARGHNTRVAPGRRF

SEQ ID NO: 13495 - DNA, 760 bp, Zea mays
  misc_feature: Ceres CLONE 1374105-F
  misc_feature: Encodes the peptide sequence at SEQ ID NO. 13496
  misc_feature (332)..(332): n is a, c, t, g, unknown, or other
  misc_feature (380)..(380): n is a, c, t, g, unknown, or other
  misc_feature (393)..(393): n is a, c, t, g, unknown, or other
  misc_feature (432)..(432): n is a, c, t, g, unknown, or other
  misc_feature (505)..(505): n is a, c, t, g, unknown, or other
  misc_feature (760)..(760): n is a, c, t, g, unknown, or other
tccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcgntggtgcaagcaggcgtgcgagtggcagtacggaaaggacaccccgcgnaagaggggatggnaaaagcgagtgccgcgagcggcaccagcaagctgacgcngggcgaggacggcgaccggcgggcgtgggacgcctacgtctcccgctcggaagggggggcaaaagggcccggncccaatggcctgggccccgcccgaggggcccaccccgtgggaaaaccccagggagtggcttgggaggggggggccccccccccccgggaaaatgtggcccccaaaattgggggacaaaaagagagaccggtgccccgggagaaaaaaaaaaaggcgggggaaaaagatgccccccggaagaaaggggggggggcgcggggccccccccccccgccggcggtaatattttgttgtgggaggggagaggggtatccn

SEQ ID NO: 13496 - protein, 74 aa, Zea mays
  misc_feature: Ceres CLONE 1374105-F
  misc_feature (64)..(64): Xaa is any aa, unknown, or other
MGKGSVGASWWAFLLLAGVLLVVAATAGAEDGVVERDRKEDLRWCKQACEWQYGKDTPRKRGWXKRVPRAAPAS

SEQ ID NO: 13497 - DNA, 729 bp, Zea mays
  misc_feature: Ceres CLONE 1374106-F
  misc_feature: Translation starting site: 173
aagctggagctccccgcggtggcggccgctctagaactagtggggatcccccgggctgcaggaattcgcacgagaccattacctagaacatcctaatcgaaaaaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgaacagctcgtcttcgaagcgcccgctcagcccgtgaggggagactacgtccagaacgcccgtcagtttctctcccaccccaggtcaggggggctcccccgtcgtctacaggcgatccttcctcgagaagaagggccttagcaccgaggagatcgaccgaggctttcgaagggttccctgatccttcaacccaggactatcggttacccattttttccgaaggaaggaggggccaaaaggcccgaatcaaacccgtcgggggggaagtttattggcccagaaaaaacttggggcaccccaaaaaaggttggggcccgggggggcccttttcaaaggggagccccaggggtttaagttggggaacacaaaattttccgggggggggaggggttttttttttttgggttttggggggcaaaacgcgttttttttgtttttttaataaaaaaaagagtgggtccttttcttcagagggtcaaagg

SEQ ID NO: 13498 - DNA, 855 bp, Zea mays
  misc_feature: Ceres CLONE 1374107-F
  misc_feature: Translation starting site: 336
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (597)..(597): n is a, c, t, g, unknown, or other
nnnnnnnnccccnnnnnnnnnnnnaaccccccccctccccccccccgccccgatagctggggctccccgcggtggcggccgctctagaactagtggatcccccgggctgcaggaattcgcacgagaccattacctagaacatcctaatcgaaaatcctttctccgggcacaccatactgttcttgctacttctagatagaggaacaagagagagaaggccaccgacatcgcctcttaacccgacaagccccattgcccaggagaaccccgtgccggggagcgagccgcgcgcattccccgtcccgtgccaccggaccaggggaaggaggacacacatgtcgtcgtctctctctccagcggcggcagccgcgcccctggatctggacggcaactccgtcgcgcccctcaccatctgcatgattggtgccggcggcttcatcggctcccacctctgcaagaagctcatggccgagacgcgccatgtcgtcctcgccgtcgacgtatactgcgataagatccgccacctcgtcgaccccgcgccgccgcacctcgcggggcgcatctccttccaccgcctcaacatcaagaatgactccnggctcgagggcctcatcaagatggccgatctgaccatccaacctggcggctatctgcacgccggcggactacaacacgcgccccctcgacaccatctacagcaacttcatcgatgcactcccaggggtcaggtactgctccgagaacagcaagggtctcatccacttctcccacgtggcgagggctatggcaagaccattcggcagcttccttccccaaagaccacccgctccgcaagggaaaccttgaattttatga

SEQ ID NO: 13499 - DNA, 707 bp, Zea mays
  misc_feature: Ceres CLONE 1374108-F
  misc_feature: Encodes the peptide sequence at SEQ ID NO. 13500
  misc_feature (462)..(462): n is a, c, t, g, unknown, or other
gctctagaactagtggatcccccgggctgcaggaattcgcacgagaccattacctagaacatcctaatcgaaaactagaaccgtctccaatggcgctactccgagcgctccggcgagcccttccggcgctctcctcgccggcggcggttctcccccgtcgcgccccgcacccactacctcctccgcccgctcctcgtcggttcctggacccgatcgggctccgctccttctccgccgccgccgccaccgcgtcgcaggcgccgcccatgggggccaccctgttcggcgggctcatggacacccggttcccgaagcgccggccgggcttcgccaaccgccggaagagggctagcttgcgccccaaaggtccgtactactgggtgaagtgcaagcctgacgagcccataccagttagtcagccgaaccaagggagcgtacgagggaggaaggagaagaagcggnatcagcagcgccaggactttatcatgggctgaaaagaaaaaccgcaaagctcaaaaatttcgcgtgggtggtaaaaaaaaagggggggaaaaccaaaacaaaaaggaaaaatggtgtttttgggggaaaaaagagggggcgtgtgtgggccccccgggggttttaaaaaacccaaaaaaaaaaatttttttggggagaaaaacaacgttttttgtggaaaaaccccccccctccaaaaaaaaagg

SEQ ID NO: 13500 - protein, 134 aa, Zea mays
  misc_feature: Ceres CLONE 1374108-F
  misc_feature (125)..(125): Xaa is any aa, unknown, or other
MALLRALRRALPALSSPAAVLPRRAPHPLPPPPAPRRFLDPIGLRSFSAAAATASQAPPMGATLFGGLMDTRFPKRRPGFANRRKRASLRPKGPYYWVKCKPDEPIPVSQPNQGSVRGRKEKKRXQQRQDFIMG

SEQ ID NO: 13501 - DNA, 822 bp, Zea mays
  misc_feature: Ceres CLONE 1374110-F
tccccgcggtggcggccgctctagaactagtggatcccccgggctgcaggaattcgcacgagaccattacctagaacatcctaatcgaaaaatcgcacatattattgagaccacctagcaccatacaaagcacaatattgcaccaataatgccagccaaaatatattgcctcattatgctccttgtcctttctgcaagtgctgctacggcgagcattttcccgcaatgatcacaaggtcctatagattcccttcttcccccatacctctcaccagcgatgtcttcagtatgtgaaaatccaattcttctaccctacaggatccaacaggcaatcgcagaaggcatcttacctttatcacccttgctcctccaacaatcatcagccctattacaacaggtacctttggtgcatttattgtcacagagcatcatggtacaacaactactacaactcggtgctagcacacccttgctgccctagtctccgaaacagaagttaccttttgggggcatttgctggaacacaacatcagggcacaaacaaataccacgactcatgctaccaaaccttgctgcctaattctcaaaacaaaaggttcctgcaattcaccaactaactgtcttgaaacttgccggttattttgtggaaaaaaaaatcctatctttcacccgttttgttttggccaaccccccggaatttcttcctttccccagagggggaagaattaaacctcctgggtttgtgggcgcccccgagccaaaaacacctttttcccccctaaattgtgggggaacctcgtttttctttttttaaaaaaaaac

SEQ ID NO: 13502 - DNA, 786 bp, Zea mays
  misc_feature: Ceres CLONE 1374111-F
  misc_feature: Encodes the peptide sequence at SEQ ID NO. 13503
  misc_feature (370)..(370): n is a, c, t, g, unknown, or other
  misc_feature (419)..(419): n is a, c, t, g, unknown, or other
  misc_feature (444)..(444): n is a, c, t, g, unknown, or other
  misc_feature (445)..(445): n is a, c, t, g, unknown, or other
tggagctccccgcggtggcggccgctctagaactagtggatcccccgggctgcaggaattcgcacgagaccattacctagaacatcctaatcgaaaaattcctcccaacaccacctcgcctgcgatcttcgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgccttttcagcatcaatgtcgagaacgttgaggagaaccgccgtgccctccgtgagctcctattctgctgccctggtgctctccagtacatcagcgntgtgatcctcttcgaggagaccctgtaccagaagaccaggatggcaagncctttttgtgatgtcctcaggaggnnagcgtccctcctgccatcaggttgaccagggcaccattgagttggttggactgaataggaaacaccacccaggccatgacgaccttggcaagcgctgcccaagactacgaggccggtgcccgttttgcaaaggggggcgctgtcctcaaaattggcccaatgaaccatcaaagtttgcatcgacctgacgttcaagggctggttccttttgccacatctgccaagaaaatggcctgggccaattgttgaccccgaaacctttgggggggcccccaagaattggaccgtgggcttaacacaatgaaaacgcctttgtgtgccggtaaaagggggtcaaaaaa

SEQ ID NO: 13503 - protein, 103 aa, Zea mays
  misc_feature: Ceres CLONE 1374111-F
  misc_feature (11)..(104): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (71)..(71): Xaa is any aa, unknown, or other
  misc_feature (87)..(87): Xaa is any aa, unknown, or other
  misc_feature (96)..(96): Xaa is any aa, unknown, or other
MSAYCGKYKDELIKNAAYIGTPGKGILAADESTGTIGKRLFSINVENVEENRRALRELLFCCPGALQYISXVILFEETLYQKTRMAXPFCDVLRRXASLLPSG

SEQ ID NO: 13504 - DNA, 878 bp, Zea mays
  misc_feature: Ceres CLONE 1374115-F
  misc_feature: Encodes the peptide sequence at SEQ ID NO. 13505
  misc_feature (223)..(223): n is a, c, t, g, unknown, or other
gctctagaactagtggatcccccgggctgcaggaattcgcacgagaccattacctagaacatcctaatccaaaaaggccctagcaacaaatccgtatcccgagtccggcgacggcagtatccgagctcgcactcgcgcacccgtccatcgcatcgcatctgtcctcccatcccctcagcgccaccgcaccgcaatcacacgcgcgccacccgcgatgacgccnggcggcggcgatctccggctccagcagccacgtcgtcgtctcctccgcccgcctcaggcagccgttcacgctccctccgcgcaccgcttgcccaatcgccgccgccgcctcgcccgtgacccgccgagggggtcgcggtcgccggcgtgtcaagccccgttgtgtccgccgccgccggagaaggatgccaaacagggctcctaagggatttccttcaaaacaattgatttttgacaacggatacaaaaaatggaagaatcctttaatcgaagccctccggagggttaaaggaatttgaaaaaaagtcctgggaagaaaaagaagctttcccaacccggttccaaaaggaaaaaacaaaggggcccatggaattttttggccaaagcccatccaatggagggcaccccggtgttttcagtttggaaaccgcggaatccgtgttttaacttgggggggccaagggaatttctaattttgggggccaaaatgggtaatccaagaagggggcaaaggggggaggaggatcgcggggaagggggctaaaaaaaatctttcggggattaaaaggaaaccccttccggggccagacggcctttgtttaaccaaaagattttccggagccggggaagaaagtgccgcgggccccgggcacaaa

SEQ ID NO: 13505 - protein, 37 aa, Zea mays
  misc_feature: Ceres CLONE 1374115-F
MPNRAPKGFPSKQLIFDNGYKKWKNPLIEALRRVKGI

SEQ ID NO: 13506 - DNA, 805 bp, Zea mays
  misc_feature: Ceres CLONE 1374122-F
  misc_feature: Encodes the peptide sequence at SEQ ID NO. 13507
  misc_feature (785)..(785): n is a, c, t, g, unknown, or other
  misc_feature (786)..(786): n is a, c, t, g, unknown, or other
  misc_feature (796)..(796): n is a, c, t, g, unknown, or other
  misc_feature (803)..(803): n is a, c, t, g, unknown, or other
ccccgcggtggcggccgctctagaactagtggatcccccgggctgcaggaattcgcacgagaccattacctagaacatcctaatcgaaaaaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagcgctggcaaacctttctccctactctcagcaacaacaatttcttccattcaaccaactgtctacattgaaccgtgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaagccgtgcttccttcttgacacagcaacagttgctgccttttctaccagcagtttggcgctaacccccgcacccctctacnnactacacaantgtgccntt

SEQ ID NO: 13507 - protein, 203 aa, Zea mays
  misc_feature: Ceres CLONE 1374122-F
  misc_feature (1)..(202): Pfam Name: Zein Pfam Description: Zein seed storage protein
  misc_feature: SWISSPROT Homolog: EC 3.1.13.4 Poly(A)-specific ribonuclease
MATKIFSLLMLLALSACVANATIFPQCSQAPIASLLPPYLPSMIASVCENPALQPYRLQQAIAASNIPLSPLFQQSPALSLVQSLVQTIRAQQLQQLVLPVINQVALANLSPYSQQQQFLPFNQLSTLNRAAYLQQQLLPFSQLATAYSQQQQLLPFNQLAALNPAAYLQQQILLPFSQLAAASRASFLTQQQLLPFLPAVWR

SEQ ID NO: 13508 - DNA, 967 bp, Zea mays
  misc_feature: Ceres CLONE 1374126-F
  misc_feature: Encodes the peptide sequence at SEQ ID NO. 13509
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (43)..(43): n is a, c, t, g, unknown, or other
nttgggggggggnnnnnnncccccccgcccgccccgccccgcncgccgcgcgcgggggagaaaggtgggagctccccgcggtggcggccgctctagaatagtggatcccccgggctgcaggaattcgcacgagaccattacctagaacatcctaatcgaaaaatattttcagcattcaaaaacacaccaagcgaagcgcactagcaacgacctaacaccaatggctaccaagatattagccctccttgcgcttcttgcccttttagtgagcgcaacaaatgcgttcattattccacagtgctcacttgctcctagtgccagtattccacaggtcctcccaccagttacttcaatgggtttcgaacatccagccggtgcaagcctaccggctacaactaagcgcttgcggcggagcgcccttacaacaacccaattggcccaatttggcaacaaacaatccttggggaacatcctaaccccttacaaagcccattgggaaagggcaacgaaccgaccaacccccccgggtttcccggggcccttccacttgggggcccccccctaagccccggggggcgggaaaccccctgggtccccccccaaaactttggccaacaacaagcccacccctgggcttttgggaaaattccaccaaaaccgccacactttgtggcttccttgcggcgggggaaacggcgagacacctttggcggcatccccgcgggtaaagtcgagggatagcggggggtgggggaaaacggagttttattagggcgcgagaggggggcgtccggcgccacccctcgaacgccgtgggggggaaaaaccccctgggggcgggttttcaacctaataagagcacgtatttttccgtgcctaacgcccccccctcttctgggtggggggcagaaaagtggtccccccgctcgggagcccgtcaacaccaccgagagggtggggtgcggcg

SEQ ID NO: 13509 - protein, 114 aa, Zea mays
  misc_feature: Ceres CLONE 1374126-F
MATKILALLALLALLVSATNAFIIPQCSLAPSASIPQVLPPVTSMGFEHPAGASLPATTKRLRRSALTTTQLAQFGNKQSLGNILTPYKAHWERATNRPTPPGFPGPFHLGAPP

SEQ ID NO: 13510 - DNA, 758 bp, Zea mays
  misc_feature: Ceres CLONE 1374128-F
  misc_feature: Translation starting site: 255
tggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgccagctcttcaccctgagcagctcatcagtggcaaggaggatgccgctaacaatttcgcccgtggccactacacaattggcaaggagattgttgatctgtgccttgaccgtatcccgcagcttgctgaacactgcacccggctccagggcttcctgtcctcaatgccgttgggggggcactggctctggcctggttcccctccttgagcgcctggctggggagaacggaagaaaatccagtgggcttccctgg

SEQ ID NO: 13511 - DNA, 803 bp, Zea mays
  misc_feature: Ceres CLONE 1374129-F
  misc_feature: Encodes the peptide sequence at SEQ ID NO. 13512
  misc_feature (574)..(574): n is a, c, t, g, unknown, or other
  misc_feature (630)..(630): n is a, c, t, g, unknown, or other
  misc_feature (635)..(635): n is a, c, t, g, unknown, or other
  misc_feature (648)..(648): n is a, c, t, g, unknown, or other
  misc_feature (649)..(649): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (727)..(727): n is a, c, t, g, unknown, or other
  misc_feature (728)..(728): n is a, c, t, g, unknown, or other
  misc_feature (730)..(730): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (783)..(783): n is a, c, t, g, unknown, or other
  misc_feature (784)..(784): n is a, c, t, g, unknown, or other
  misc_feature (787)..(787): n is a, c, t, g, unknown, or other
  misc_feature (788)..(788): n is a, c, t, g, unknown, or other
tcaccgcggtggcggccgctctagaactagtggatcccccgggctgcaggaattcgcacgagaccattacctagaacatcctaatcaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttggccgtatgcgtcaagacgtacccgctaacttgctcgtgctttgatcgggttgagcgctgctccgacgcctgtaaggagtgcgtggaaacggaggactcgcgccacgtctgcgtcgacaggtaccgtggcgaccccgggcccaggtgccacgacgaggaacgggaggagcggcggacccgctgacgacgnacgctggtgggcaagcgacgcccgacggcagtggatggcagatgacaagaaagcangcggncggcgacacgacnnaaaaaaaaaaggcgtgaaaaaggggtgcgacgtgcaatctgcacagctgtgnnncccccccgggggtggcctggcganncncnnnnnnggggggggggggggggccagactgcgctgannnnnnnnnnnnnngnnggnngggggggggggcccc

SEQ ID NO: 13512 - protein, 130 aa, Zea mays
  misc_feature: Ceres CLONE 1374129-F
MAMGAASILLMMVSLEALLLAAAAGGGTIRLPSDVGGVAADLVTAMARARARAKHQLRDEERPWGECCDLAVCVKTYPLTCSCFDRVERCSDACKECVETEDSRHVCVDRYRGDPGPRCHDEEREERRTR

SEQ ID NO: 13513 - DNA, 837 bp, Zea mays
  misc_feature: Ceres CLONE 1374131-F
  misc_feature: Encodes the peptide sequence at SEQ ID NO. 13514
agagctggagctccccgcggtggcggccgctctataactagtggatcccccgggctgcaggaattcgcacgagaccattacctagaacatcctaatcgaaaaatcttattttcctgcgccaatgctgagcctgaaccgaaccttccttcagttcagctcctccgaccgcggacgagctcgaagaccacctccgcgccgacggggcagactacgccaactgtccttgacgcaacttgactccgactccatgccttggcccagggaacgacgatctgatgctcccattgctgcagccgaagacaggggccgcgccaaccgataccctgaggctgtcgatgatgctcaggatgagggcgtcttcccgcttcccccagtacttgatcaccgcactgttggtcggtgtccgccccgttgccatgagcaccaactgcccctccgccgccgccattggatctctcgcttcgcgctgctctatgcccgataattccttgcaaagggaagttagtacggataatcgctactactctataagcacggtgtgtaggcgtgcacaccgtgcgccatcgttctgccagcctcccgatgctcccctgccaggatccggtcacacttttgtcgccgcaatcatcggctacctgcccctcaaaatcctccccctccgctccccggtcaggatctccatcgcgcattggatggggttcctcgctgccccccctcgcagccccttgcccccgtccgagggttggccgctgccaatcccactcccaatcgtaactaagctgtgcccttggttgtttgaccaaggggacttaaatccccccattaagaatcccggcg

SEQ ID NO: 13514 - protein, 187 aa, Zea mays
  misc_feature: Ceres CLONE 1374131-F
MLPLLQPKTGAAPTDTLRLSMMLRMRASSRFPQYLITALLVGVRPVAMSTNCPSAAAIGSLASRCSMPDNSLQREVSTDNRYYSISTVCRRAHRAPSFCQPPDAPLPGSGHTFVAAIIGYLPLKILPLRSPVRISIAHWMGFLAAPPRSPLPPSEGWPLPIPLPIVTKLCPWLFDQGDLNPPIKNPG

SEQ ID NO: 13515 - DNA, 795 bp, Zea mays
  misc_feature: Ceres CLONE 1374132-F
  misc_feature: Encodes the peptide sequence at SEQ ID NO. 13516
  misc_feature (167)..(167): n is a, c, t, g, unknown, or other
  misc_feature (220)..(220): n is a, c, t, g, unknown, or other
  misc_feature (234)..(234): n is a, c, t, g, unknown, or other
  misc_feature (375)..(375): n is a, c, t, g, unknown, or other
  misc_feature (418)..(418): n is a, c, t, g, unknown, or other
  misc_feature (462)..(462): n is a, c, t, g, unknown, or other
  misc_feature (464)..(464): n is a, c, t, g, unknown, or other
tccccgcggtggcggccgctctagaactagtggatcccccgggctgcaggaattcgcacgagaccattacctagaacatcctaatcgaaaaataggcactagcacctcctcgcctccacctccgtcctcttcgatcccgtccaatcccccgcgccccggcgcccctnctccgccggcggctttgctgggtcccgcgctcctcctcctcctaggctgttcntggttggggctgcnggcggagggaactaggtaaggggaaggaaaggggaggtttgagggagagcgcagcggcagcggcagcagcgatgccatcgcacgcggatctggaccgccagatctcgcagctgcgggattgcaaagtccctgctgaggcgnaggtcaaaacgctatgcgagcaggccaaggcgatcctcatggnagagtggaacgtgcagcccgtgcgctgccccgtcactgtctgcngncgacatcacggccagttctacgacctcatcgagctctttcgcatcggtggggacgcgcccgaaacaattacctccttatgggcgactacgtcgaccggggctaatacctcaaggaaaactggggcccttattggggggtttcaaaaagaccgtataaagacggaacccccaattttggaggggaatcctggagagaaacaaaaactcagggggtagggttccaaagggaaaggttggcgaaaaaggaaagcgaaaagggggggaaaaactttaaaaactttgtggggaatttgccccccccccgctcttaaaaaaaaaaaaactttccggc

SEQ ID NO: 13516 - protein, 124 aa, Zea mays
  misc_feature: Ceres CLONE 1374132-F
  misc_feature: SWISSPROT Homolog: EC 3.1.3.16 Phosphoprotein phosphatase
  misc_feature (24)..(24): Xaa is any aa, unknown, or other
  misc_feature (38)..(38): Xaa is any aa, unknown, or other
  misc_feature (53)..(53): Xaa is any aa, unknown, or other
MPSHADLDRQISQLRDCKVPAEAXVKTLCEQAKAILMXEWNVQPVRCPVTVCXRHHGQFYDLIELFRIGGDAPETITSLWATTSTGANTSRKTGALIGGFQKDRIKTEPPILEGNPGEKQKLRG

SEQ ID NO: 13517 - DNA, 793 bp, Zea mays
  misc_feature: Ceres CLONE 1374133-F
  misc_feature: Encodes the peptide sequence at SEQ ID NO. 13518
ggagctccccgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagtagcgctcgcccgcgcgctcgtttatattatatctgtgcgactgtgcctcccctccccgagccatagcctcctcgtcccctcgagaactgtaccatcacgcgccgcctttgattgagcagggactgggacagaggacaagagagggtgaaaggaggcaagaaaacgcttcttgttgcctttgtgcttcaacggatccgcggtggctgcgcacgccggcggtgaagaggagtcgcgaccggcgcgcctccagtcttttttcgcctccgtgctctccgggctcttcggccaggccgaggccgaggacgaggacgaggacgaagagatgcccacgcgcaaccacaacgctgccgcggctgccgctccgcagcatcaccatcacaaccgaggtggtgctcccgctcttgcaaagagcaaggacgtgcccggacgagctgatgccatgaaccggcgagcccccctcggcgatattggcaacctcgtcagcgtccgcccagccgaaggaaaatctcagctgcagcagagatcgatcgtcccatcacgcgtagcttcggggctcagatcgtgaagacgtgcatgcgatgcgcaatcagaaatggcggcatctacccgcgagtatgcg

SEQ ID NO: 13518 - protein, 80 aa, Zea mays
  misc_feature: Ceres CLONE 1374133-F
MPTRNHNAAAAAAPQHHHHNRGGAPALAKSKDVPGRADAMNRRAPLGDIGNLVSVRPAEGKSQLQQRSIVPSRVASGLRS

SEQ ID NO: 13519 - DNA, 737 bp, Zea mays
  misc_feature: Ceres CLONE 1374140-F
  misc_feature: Encodes the peptide sequence at SEQ ID NO. 13520
  misc_feature (557)..(557): n is a, c, t, g, unknown, or other
aagctggagctccccgcggtggcggccgctctagaactagtggatcccccgggctgcaggaattcgcacgagaccattacctagaacatcctaatcgaaaagattgggtccaacaccagccgccgccatgtcgaagcgaggcaggggaggtttggcggggaacaagttccgcatgtcgctgggtctgccggttgccgcgacggtgaactgcgcggacaacacgggcgccaagaacctctacatcatctccgtcaagggcatcaagggccgcctcaaccgcctcccgtccgcctgcgttggcgacatggtcatggccaccgtcaagaaggggaagcccgacctcaggaagaaggtgatgcccgccgtcatcgtccgccagcgcaagccgtgtcgccgcaaggacggtgtctacatgtacttcgaagataatgctgcagtgattgtgaatcccaaggctgagatgaaaaggtccgctatcactggacctatcggcaaggagtgtgctgatctttggcctaggattgctagcgcagcaaacgccatcgtttgagagcttngtggaatatggtcagacttctatatgatcatcttattatcagtggctaggagtgctattgggcttaatgttacctttatgtttgttcactcaatttttgtagaaaacgaaattgggtataccagggggatctatatatcactgattgcaataaatttggctgactaaaaaaaaaaaaaaa

SEQ ID NO: 13520 - protein, 140 aa, Zea mays
  misc_feature: Ceres CLONE 1374140-F
  misc_feature (19)..(140): Pfam Name: Ribosomal_L14 Pfam Description: Ribosomal protein L14p/L23e
MSKRGRGGLAGNKFRMSLGLPVAATVNCADNTGAKNLYIISVKGIKGRLNRLPSACVGDMVMATVKKGKPDLRKKVMPAVIVRQRKPCRRKDGVYMYFEDNAAVIVNPKAEMKRSAITGPIGKECADLWPRIASAANAIV

SEQ ID NO: 13521 - DNA, 708 bp, Zea mays
  misc_feature: Ceres CLONE 1374142-F
  misc_feature: Encodes the peptide sequence at SEQ ID NO. 13522
  misc_feature (654)..(654): n is a, c, t, g, unknown, or other
  misc_feature (682)..(682): n is a, c, t, g, unknown, or other
tggagctcaccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccgtggaggcgaagcaggcgctctactcgagggacctcgctcgcaacctgcgcttcgcctccaacttcgacctcttcaaggctgctgcggccgactggcgcgacacgctccttctgcgaggtggctccgaacccgccgncgcgggaggagctgccggtagcactcangaacgtgatgctgaagtacggcgcgg

SEQ ID NO: 13522 - protein, 188 aa, Zea mays
  misc_feature: Ceres CLONE 1374142-F
  misc_feature: SWISSPROT Homolog: EC 1.14.11.20 Desacetoxyvindoline 4-hydroxylase
  misc_feature (171)..(171): Xaa is any aa, unknown, or other
  misc_feature (180)..(180): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPVEAKQALYSRDLARNLRFASNFDLFKAAAADWRDTLLLRGGSEPAXAGGAAGSTXERDAEVRR

SEQ ID NO: 13523 - DNA, 698 bp, Zea mays
  misc_feature: Ceres CLONE 1374143-F
  misc_feature: Encodes the peptide sequence at SEQ ID NO. 13524
  misc_feature (698)..(698): n is a, c, t, g, unknown, or other
aagctggagctccccgcggtggcggccgctctagaactagtggatcccccgggctgcaggaattcgcacgagaccattacctagaacatcctaatcgaaaactagacgcaccccttcctcgtttcgccgcctccgccgacaccgactgcctccctcagctgccgtcgccatgggcagaaggcctgctagatgctatcgccagatcaagaacaagccataccctaagtccaggtactgccgtggtgtccctgacccgaagatcaggatatacgatgtcgggatgaagaggaagggtgttgatgagctcccctactgtgtgcaccttgtctcttgggagaaggagaatgtctccagtgaggcgcttgaggctgcccgcattgcctgcaacaagtacatgaccaagtctgcaggaaaggatgccttccaccttagggtccgggttcacccgttccatgtcctccgtatcaacaagatgctttcgtgtgctgaggctgataggctccagactggaatgaggggtgcctttggcaagcctcatggcacctgtgctagggtggacattggtcaggtcctcctttccgggcgatgcaaggacaacaatgctggccatgccagcgaagctctgcgtcgcgctaagttcaagtcccctggcccgccaaaaatctttgaaaacagaaggtggggcttcaccaagttcn

SEQ ID NO: 13524 - protein, 176 aa, Zea mays
  misc_feature: Ceres CLONE 1374143-F
  misc_feature (5)..(167): Pfam Name: Ribosomal_L16 Pfam Description: Ribosomal protein L16
MGRRPARCYRQIKNKPYPKSRYCRGVPDPKIRIYDVGMKRKGVDELPYCVHLVSWEKENVSSEALEAARIACNKYMTKSAGKDAFHLRVRVHPFHVLRINKMLSCAEADRLQTGMRGAFGKPHGTCARVDIGQVLLSGRCKDNNAGHASEALRRAKFKSPGPPKIFENRRWGFTKF

SEQ ID NO: 13525 - DNA, 790 bp, Zea mays
  misc_feature: Ceres CLONE 1374144-F
  misc_feature: Encodes the peptide sequence at SEQ ID NO. 13526
ggagctccccgcggtggcggccgctctagaactagtggatcccccgggctgcaggaattcgcacgagaccattacctagaacatcctaatcgaaaaacatcccagttggaagggcagccaataagggaaggggtgacgaaaatggctccgacgaccgccaccaaggacgacagtggctacggcgaccagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggagacgcggcgcgaggacctattcgagcaggtgaggcacgcggccgagacggtgggcttcttctggctggtgaaccacggcgtgccggaggagctgatgatcgtcatgctccgcggagtgcgccagttcaacaaggcccccgtggaggcgaagcaggcgctctactccagggagctggatcgcaacctgcgcttcgcctccgacttcgacctcttcgagccgctgcgttcgactgacgcgacacgctccttctgcgatgtggctccgaacccgtcgacgcggtatgagctgtcggagcactggagaacgtgatgctgaatacgggcgcgagcgacaaaactgggggcggtcgtggtcgagctgctgcccgagtacctcggatgccagcgacaactggaactaaatgcaggcatgc

SEQ ID NO: 13526 - protein, 181 aa, Zea mays
  misc_feature: Ceres CLONE 1374144-F
  misc_feature: SWISSPROT Homolog: EC 1.14.11.20 Desacetoxyvindoline 4-hydroxylase
MAPTTATKDDSGYGDQRRRELQAFDDTKLGVKGLVDSGVKSIPSIFHHPPEALSDIISPAPLPSSPPSGAAIPVVDLSETRREDLFEQVRHAAETVGFFWLVNHGVPEELMIVMLRGVRQFNKAPVEAKQALYSRELDRNLRFASDFDLFEPLRSTDATRSFCDVAPNPSTRYELSEHWRT

SEQ ID NO: 13527 - DNA, 740 bp, Zea mays
  misc_feature: Ceres CLONE 1374145-F
  misc_feature: Encodes the peptide sequence at SEQ ID NO. 13528
  misc_feature (644)..(644): n is a, c, t, g, unknown, or other
tggagctccccgcggtggcggccgctctagaactagtggatcccccgggctgcaggaattcgcacgagaccattacctagaacatcctaatcgaaaaaacgaagaaccgaatgcccagtcctgaatcacgtcttcacccgtgctcgtgcgctgcgcccatcccttccgcctccacgctccccacgtgcaccgtgcacagcaccacacagccaggtccccatggcggcggcggcggcggttgcgtctgcgacgacggcggaagacgaatcgcgcctgctgcgcctggaggagcaggcggagcacggcggcggcggcgcctgggaatacctctgcctcgcccgccggctccgcgcccgccgccccgctcacgtcctccgcgtcggcctcgccctcctcaacaacgcctccgcgcgctccggccttgcctcagaacagtggacgctctacgagcaggtgtccacggcggccatggattgccagcgtctctatgtggcaaaggactgtattgcagtcctttccaaacaatttcctgggagcacacgggctagcccggatagaagctcgtctgtttgaagcaaaaggtgaatgcgttgaaactgaaagagcctacgccgttaatcctgaaaaacaatccatttggacanaattgtcccacaagaggaaaaatggctatcgcaaaagcacgaggggggtatgtccaaaagtgaattgattattctcaaataaggaatcctgaaatt

SEQ ID NO: 13528 - protein, 117 aa, Zea mays
  misc_feature: Ceres CLONE 1374145-F
MAAAAAVASATTAEDESRLLRLEEQAEHGGGGAWEYLCLARRLRARRPAHVLRVGLALLNNASARSGLASEQWTLYEQVSTAAMDCQRLYVAKDCIAVLSKQFPGSTRASPDRSSSV

SEQ ID NO: 13529 - DNA, 835 bp, Zea mays
  misc_feature: Ceres CLONE 1374146-F
  misc_feature: Encodes the peptide sequence at SEQ ID NO. 13530
aagctggagctcaccgcggtggcggccgctctagaactagtggatcccccgggctgcaggaattcgcacgagaccattacctagaacatcctaatcgaaaaaaggctcatctcgctttggatcgattggtttcgtaactggtgagggactgagggtctcggagtggattgatttgggattctgttcgaagatttgcggaggggggcaatgtcgaccgcggggaaggtgatcaagtgcaacgctgcgttgccatgggaggccggcaagccactgtccatcgaggaggtggaggtagcgcctccgcaggccatggaggtgcgcggtcaagatcctcttcacctcgcttctgcacacccaacgtcttatttctgggaaggcccaagaggcacactccccgggttcccctcggaatcttttgccccccccagggttgggaggttatccatataacaaggcgttcgaaaaaagcttggttaaattggacagtaaccttcccggggcagacccatggctcctttctcttgggggtcccacttggggggaagtggaaaaggtagttggtggctccacattggcacagagtccggcacaaaaaagcgaaacttggtgtgggattttggcctccaggatttcacaccccccaaccccgccggtggttgatctattctgccctaatggccaaaatcccgcggttcttccccattgcaagtgggaaaagccctatcctacccacctttgggctggggaatttcccaccttttacacggaatacaccgggcatttggataggcggctgagggtatacaaaaatacataccttcaaggttctcctttg

SEQ ID NO: 13530 - protein, 80 aa, Zea mays
  misc_feature: Ceres CLONE 1374146-F
  misc_feature: SWISSPROT Homolog: EC 1.1.1.1 Alcohol dehydrogenase
MSTAGKVIKCNAALPWEAGKPLSIEEVEVAPPQAMEVRGQDPLHLASAHPTSYFWEGPRGTLPGFPSESFAPPRVGRLSI

SEQ ID NO: 13531 - DNA, 727 bp, Zea mays
  misc_feature: Ceres CLONE 1374148-F
  misc_feature (608)..(608): n is a, c, t, g, unknown, or other
tggagctcaccgcggtggcggccgctctagaactagtggatcccccgggctgcaggaattcgcacgagaccattacctagaacatcctaatcgaaaaaacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttccctcgtacctctcaccagcggtgtcttcggtatgtgaaaacccaattcttcaaccctacaggatccaacaggcaattgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacatcagtttcttccattcaaccaactagctgcattgaactctgcttcttatttgcaacaacaacaactaccattcagccagctatctgctgcctacccccagcaatttcttccattccnccaactgacagcattgaactctcctgtttattacagcagcacaactactacgtttcagccagttagctgttgtgaagcctgctaacttctggacacaacacagttgatgccggtctacc

SEQ ID NO: 13532 - DNA, 722 bp, Zea mays
  misc_feature: Ceres CLONE 1374149-F
  misc_feature: Pfam Name: Pollen_Ole_e_I Pfam Description: Pollen proteins Ole e I family
tggagctccccgcggtggcggccgctctagaactagtggatcccccgggctgcaggaattcgcacgagaccattacctagaacatcctaatcgaaaaacacaccagagtgaggttcctttcaattatcgtatctccgccgagctgctaaacaacaccaactcctcagccgcttgagttttgatgacgcaagcaagaggacccatcgatggcctccttgaaggaccactgtgccgtggtggcagttgtagtgttgatctgcttcgtcgtcctcgccgccgccctcccttcgcacgcgtcgacggcgctggacgagccgtggaactataagcccagcagagcgccagcgccgtcccctgcatctgcatcatcctacgccccgccgccggtccagcccgtgatcgtcgtcccaggccgacatctactgcaagtcctgccagcctccagggatacaacagcggtatgcacgcgtcccctctccccatgctacggagaagctggagtgctacgtcgacgcggacagcaagtaccgggtgctgaaccataagaccacggccaccgacactaacggctacttcctcgtgatggtgtacgaacggggccatgttccgacccgcggagcctgcagggtggaacctcccctcctcccccgaaggaagcttctgccccaatgccctttgatcccgtccaaaccccaaagttggggtactcacccctctgggag

SEQ ID NO: 13533 - DNA, 726 bp, Zea mays
  misc_feature: Ceres CLONE 1374150-F
  misc_feature: Encodes the peptide sequence at SEQ ID NO. 13534
  misc_feature (575)..(575): n is a, c, t, g, unknown, or other
aagctggagctccccgcggtggcggccgctctagaatagtggatcccccgggctgcaggaattcgcacgagaccattacctagaacatcctaatcgaaaaacaggctcatctcgctttggatcgattggcttcgtaactggtgagggactgagggtctcggagtgcattgatttgggattctgttcgaagatttgcgaaggggtacaatggcgaccgcggccaaggtgatcaagtgcaaagctgcggtggaatgggaggacgaccagcctctgtcgatcgatgaggtgcagatagcgcctccgcaggccatgcacgtgcttgtcaagatcctcttcacctcgctctgacacaccgacgtctacttctgggaggccagggtgaatactcccgtgttccctcggatctttgatcacgaggctgaaggtatcatatacagtgtctcatagggtgtgactgacttaactctcggcgaccatgtccttcgtgtggtcactggggagtgcaaggagtgtgtccactgcaagtcggacaagagcaacatgtgtgatctgctcacgatcaacagcgaccgcgntgtgatgattgccgatggcaagtcgcgacttttcatcaatggagagcctatctaccactttgcctgggacttcaacctacagcgagtacaccgtcatgcatggtgggttgggttgaaagatccaccctcagggtcccctgggtaaagttgg

SEQ ID NO: 13534 - protein, 46 aa, Zea mays
  misc_feature: Ceres CLONE 1374150-F
  misc_feature: SWISSPROT Homolog: EC 1.1.1.1 Alcohol dehydrogenase
MATAAKVIKCKAAVEWEDDQPLSIDEVQIAPPQAMHVLVKILFTSL

SEQ ID NO: 13535 - DNA, 705 bp, Zea mays
  misc_feature: Ceres CLONE 1374151-F
  misc_feature: Encodes the peptide sequence at SEQ ID NO. 13536
tggagctccccgcggtggcggccgctctagaactagtggatcccccgggctgcaggaattcgcacgagaccattacctagaacatcctaatcgaaattccttcagctgtccgcccgcggcccacccctccgtcgtctccaccattccgccgttcccaccacgccactcgccagttcgtcactccctcctgtctccccccttgccgagacggcgcggacgccccgtcgcccaccccgatggcttccactctcctccacgccgccaccgcctcgctccagagctcctcccagcccgcacgcgcgggcgccgccaccgcctttcaccccctcgcgtccaccccatccatacgcctcgcgcgctcctcgttctcgtccaatcgccgcctcgaggtttcactccgggcggtttcggccggtcaccggttcgcggtgaggggagcaccccggtgccgccgcgtcgtcgccgccctagcaggtgagcagactgagggttcagaggtgggcgatgacaaggataacagcaacggggagataaagcccgaggaggctcaagaagcttggaaggttatgttggagcagttcaaggctgaggccctgcggatgccagtcctgccaatgcaggggtatgaagtttactcccaaaggaccaaggaagttcttgctggaaacctcctgaaaagttgaagaatccgggcgaatatagcac

SEQ ID NO: 13536 - protein, 148 aa, Zea mays
  misc_feature: Ceres CLONE 1374151-F
MASTLLHAATASLQSSSQPARAGAATAFHPLASTPSIRLARSSFSSNRRLEVSLRAVSAGHRFAVRGAPRCRRVVAALAGEQTEGSEVGDDKDNSNGEIKPEEAQEAWKVMLEQFKAEALRMPVLPMQGYEVYSQRTKEVLAGNLLKS

SEQ ID NO: 13537 - DNA, 666 bp, Zea mays
  misc_feature: Ceres CLONE 1374153-F
  misc_feature: Encodes the peptide sequence at SEQ ID NO. 13538
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggccgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggaggggctggccgtggccacgccggtgttcctgatcttcagccccgtgctcgtccccgccgcgctgctcatcgggacggtcgtcatggggttcctcacgtcaggcgcgctggggctcgggggtctgtcctcgctcacgtggctcgccaaaaagggggcgggaaggggttccaacgcacccccggattaagtggaaggaggggcacccgcaagatgggggaaagccccgggggcccaccccttc

SEQ ID NO: 13538 - protein, 135 aa, Zea mays
  misc_feature: Ceres CLONE 1374153-F
  misc_feature (44)..(132): Pfam Name: Oleosin Pfam Description: Oleosin
MADRDRSGIYGGAHATYGQQQQQGGGGRPMGEQVKGMLHDKGPTASQALTVVTLFPLGGLLLVLSGLALTASVEGLAVATPVFLIFSPVLVPAALLIGTVVMGFLTSGALGLGGLSSLTWLAKKGAGRGSNAPPD

SEQ ID NO: 13539 - DNA, 721 bp, Zea mays
  misc_feature: Ceres CLONE 1374154-F
aagctggagctccccgcggtggcggccgctctagaactagtggatcccccgggctgcaggaattcgcacgagaccattacctagaacatcctaatcgaaaaatctccagcgtcttcttccagagctccaactccgacgagaaccgccactcctcgaaatctcgaatgattttctgcggcgaacccctcgtgacgttgaccaatgggagaggcctcgccgtcgatcgccaagaacgcacccaagttgatgggaacacgccctggttgacctaaaaagggtgaccatgggtgtcgctggcccggtccccccaaattcaagtccttggaaccccgtccccagggcaaaggtatggtttgggttcccctttttccccggccccccaggggaaaaaagggcttttaaccccgcggggggggggggttttatttggcccccccaattgggggaaaccccccggcttgggggggggggcctattggggcggggcggcgaggggaaaacaaaaattttacatccccataggtgcgggcccccccgggggggcggggggggggggggggataatattgagggctgtttttgggggggaaaaatttctttccttacggccccccccttttgaaaaaagaaaaaggggggtgctccaaaaaaaaggggtttatatataaaaaaaaaacacccccccccgccccaccctttgtttacttatagaaaatataag

SEQ ID NO: 13540 - DNA, 488 bp, Zea mays
  misc_feature: Ceres CLONE 1374155-F
  misc_feature: Encodes the peptide sequence at SEQ ID NO. 13541
ggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgtcggaggggggcaatgggcgaccgcgggggaaagtgatcaaagtgccaaaagttggcggttgaacatgggaaaggcccgtctaaaggccctggccgaatccaaaggaagttggaaagggaaaacggcctcccgccaagggccattgtgaagggtggcgggcggtcaaaggaaatccctttttttttcaaaccttttggggtttttggcacaaaaaaaccgagagatttttttattttttttggggaaagggggcaaaaaagaagcttccccccgggggggtgttcccccccccgggt

SEQ ID NO: 13541 - protein, 75 aa, Zea mays
  misc_feature: Ceres CLONE 1374155-F
GAPRGGGRSRTSGSPGLQEFARDHYLEHPNRKTGSSRFGSIGFVTGEGLRVSEWIDLGFCSKICRRGAMGDRGGK

SEQ ID NO: 13542 - DNA, 718 bp, Zea mays
  misc_feature: Ceres CLONE 1374157-F
  misc_feature: Encodes the peptide sequence at SEQ ID NO. 13543
  misc_feature (304)..(304): n is a, c, t, g, unknown, or other
  misc_feature (518)..(518): n is a, c, t, g, unknown, or other
  misc_feature (519)..(519): n is a, c, t, g, unknown, or other
  misc_feature (590)..(590): n is a, c, t, g, unknown, or other
  misc_feature (598)..(598): n is a, c, t, g, unknown, or other
  misc_feature (718)..(718): n is a, c, t, g, unknown, or other
tggagctccccgcggtggcggccgctctagaactagtggatcccccgggctgcaggaattcgcacgagaccattacctagaacatcctaatcgaaaaaaggctcatctcgctttggatcgattggtttcgtaactggtgagggactgagggtctcggagtggattgatttgcgattctgttcgaagatttgcggaggggggcaatgccgaccgcgtggaaggtgatcaagtgcaaagctgcggtgccatgggaggccggcaagccactgtcgatcgaggaggtggaggtagcgcctccgcaggncatggaggtgcgcgtcaagatcctcttcacctcgctctgccacaccgacgtctacttctgggaggccaaggtgcagactcacgtcgtccctcggatctttggccacgaggctggaggtatcatagagagtgttggagagggtgtgactgacgtacctcccggcgaccatgtccttccctgtgtcactggggagtgcaaggagtgtgcccactgnncagtcgcagagagcaacatgtgtgatctgctcaggatcacaccgaccgcggtgtgatgattgccgatggcnagtcgcgntttttcatcatggggatgcctatctaccactttgttgggacttccaccttcagcgagtaccccgtcatgcatggtggttggtgtgcaaagatcaaccctcaggctccccttgaataagtn

SEQ ID NO: 13543 - protein, 123 aa, Zea mays
  misc_feature: Ceres CLONE 1374157-F
  misc_feature (34)..(123): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (34)..(34): Xaa is any aa, unknown, or other
  misc_feature (105)..(105): Xaa is any aa, unknown, or other
  misc_feature (106)..(106): Xaa is any aa, unknown, or other
MPTAWKVIKCKAAVPWEAGKPLSIEEVEVAPPQXMEVRVKILFTSLCHTDVYFWEAKVQTHVVPRIFGHEAGGIIESVGEGVTDVPPGDHVLPCVTGECKECAHXXVAESNMCDLLRITPTAV

SEQ ID NO: 13544 - DNA, 653 bp, Zea mays
  misc_feature: Ceres CLONE 1374169-F
  misc_feature: Encodes the peptide sequence at SEQ ID NO. 13545
  misc_feature (614)..(614): n is a, c, t, g, unknown, or other
aagctggagctccccgcggtggcggccgctctagaactagtggatcccccgggctgcaggaattcgcacgagaccattacctagaacatcctaatcgaaaacccggccgtctcgatcccagcatccgagagagctccacaggccaggtccccatcgccgcggcgcttgccccacctctcccccgcccggtagtagcctcgccgccgttgccgagatggggttcgtgtccttcgtcgggagggtgctcttcgtcgccgctttcctcctctccgcctaccaggagtttaatgaattcggtgctgatggtggaccagcagctaaggcccttcggcccaaattcaacgtgtttgtcaaaaatgtatctgctcatctgggagtagctgtgccacacattgaggtgaagcatgtgattgctgctacaatgggtcctaagggccctggaaacctcctttttattttggagaggtttcccggggtttatcccccggggggggaaccttggttttgagaacccccaattaccccccggggttttttaaaacaaaaaaatttgggggaaagagggaaaaaattttttggggcgccttttttttgatgaaaaacccccccccccncttttttttttgggcggggcgacaaaaaaagaaaaccct

SEQ ID NO: 13545 - protein, 97 aa, Zea mays
  misc_feature: Ceres CLONE 1374169-F
  misc_feature (1)..(97): Pfam Name: HR_lesion Pfam Description: HR-like lesion-inducing
MGFVSFVGRVLFVAAFLLSAYQEFNEFGADGGPAAKALRPKFNVFVKNVSAHLGVAVPHIEVKHVIAATMGPKGPGNLLFILERFPGVYPPGGEPWF

SEQ ID NO: 13546 - DNA, 638 bp, Zea mays
  misc_feature: Ceres CLONE 1374172-F
  misc_feature: Encodes the peptide sequence at SEQ ID NO. 13547
  misc_feature (271)..(271): n is a, c, t, g, unknown, or other
  misc_feature (429)..(429): n is a, c, t, g, unknown, or other
ggtggagctccccgcggtggcggccgctctagaactagtggatcccccgggctgcaggaattcgcacgagaccattacctagaacatcctaatcgaaaaagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtancagccacggccggggcggaggacggagtggtcgaacgggaccgcaaggaggacctgcggtggtgcaagcaggcgtgcgagtggcagtacggaaaggacaccccgcggaaagaggaatgcgatagcgagtggcgcgagcggcacccccagctgacgcgncgaggacgcgacagcgcgtggacgctacgctcccgctcggaggggcaatgccggcccagtgcctgccccgccacagggccagccgggggaaacccagaatggatgaggggggccccccgccgcgactgggcccccaaaattgaaaaaaaaaaacggcccgggaaaaaaaaacgccgccaaaatgcccggaaaagggccgaggccccccc

SEQ ID NO: 13547 - protein, 145 aa, Zea mays
  misc_feature: Ceres CLONE 1374172-F
  misc_feature (24)..(24): Xaa is any aa, unknown, or other
MGKGSVGASWWAFLLLAGVLLVVXATAGAEDGVVERDRKEDLRWCKQACEWQYGKDTPRKEECDSEWRERHPQLTRRGRDSAWTLRSRSEGQCRPSACPATGPAGGNPEWMRGAPRRDWAPKIEKKKRPGKKKRRQNARKRAEAP

SEQ ID NO: 13548 - DNA, 744 bp, Zea mays
  misc_feature: Ceres CLONE 1374174-F
  misc_feature: Encodes the peptide sequence at SEQ ID NO. 13549
atagctggagctccccgcggtggcggccgctctagaactagtggatcccccgggctgcaggaattcgcacgagaccattacctagaacatcctaatcgaaaaaaaccggtcgtctagcttggctgttggttcgtccctgtccggtacccttctctcaactctcaagccgcgcagttgtcgaagtcgaaactatccgctgctgtaatagagatgctctcgatgcggtcacccagcaccaccttgtcccgccggacgagacggggtcgcctcgtgggagccgccgcgccgcaatatgttagcgctgcggtaccggcgcccgctctggagacagctgcgcctccggagagcgactcctttccgattctggtgaatggctgcactgataacatggccctatctgtcgctgaggctgctgctctgaggggccttcacctactccctgtttccttcagcagcatagagaatgttggaaaaacagtgcaagttggacaagcagacattccgatattgggcccttcctaaaagagaagatgttctttcatctattgctgatgaattcccagaagtcattgttggggactaccacggaacccgccttcctgtgaactctaatgttgacctctattggaggtttggattgcccattttcgatggggcccaatggcggggaacaatcctttggctccaacaaacccctggcgaaatttcaaaaaattagagcataacattctctccccggagggg

SEQ ID NO: 13549 - protein, 103 aa, Zea mays
  misc_feature: Ceres CLONE 1374174-F
  misc_feature: SWISSPROT Homolog: EC 1.3.1.26 Dihydrodipicolinate reductase
MLSMRSPSTTLSRRTRRGRLVGAAAPQYVSAAVPAPALETAAPPESDSFPILVNGCTDNMALSVAEAAALRGLHLLPVSFSSIENVGKTVQVGQADIPILGPS

SEQ ID NO: 13550 - DNA, 736 bp, Zea mays
  misc_feature: Ceres CLONE 1374180-F
  misc_feature: Encodes the peptide sequence at SEQ ID NO. 13551
  misc_feature (607)..(607): n is a, c, t, g, unknown, or other
aagctggagctccccgcggtggcggccgctctagaactagtggatcccccgggctgcaggaattcgcacgagaccattacctagaacatcctaatcgaaaaatccaatcacaggctcaccacaccaaccaacaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatacggaggctggcgcggcggggcggcgtgaagcgcatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcgcttaagcgccagggccgcaccctctacggcttcggcggctaggcctgccgcgccgcgattcgccgtcgctgcggttctggtgttgctgcagttcgcaagttggttgtgtgggcggaaaaatgctagatactgtagaactgcagtgcggtatgtgcacatggtgtgnttgtctgaagaaatggtgtcaatgctgccttgctctggactcaacatgctccattttgtgtcactgtgcctccgttggacaagcgagccatttcaaaaaaaaaaaaaaagctatcgataccgtcgactc

SEQ ID NO: 13551 - protein, 103 aa, Zea mays; identical to SEQ ID NO: 6459
  misc_feature: Ceres CLONE 1374180-F
  misc_feature (25)..(94): Pfam Name: Histone Pfam Description: Core histone H2A/H2B/H3/H4

SEQ ID NO: 13552 - DNA, 717 bp, Zea mays
  misc_feature: Ceres CLONE 1374183-F
  misc_feature: Encodes the peptide sequence at SEQ ID NO. 13553
  misc_feature (614)..(614): n is a, c, t, g, unknown, or other
atagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccgggcggcggcaccgcgctcgcaggggctagccaacgagacggcagcaatggcggaccgtgaccgcagcggcatctacggcggcgcccacgccacctacgggcagcagcagcagcagggaggaggcggtcgcccgatgggtgagcaggtgaagggcatgctccacgacaaggggccgacggcgtcacaggcgctgacggtggtgacgctgttcccgctgcgcgggctgctgctggtgctgtcggggctggcgctgacggcctccgtggtggggatggccgtgaccacgccgatgttcctgatcttcagccgcgtgctcgtccccgccgcgctgctcatcgggacggccgtcatggagttcctcacgtcgggcgcgctggggctcgagggactggtctcgatcacgtgcctcgacaacacggagcggcaggagttccagcgcaacccggactacttgnatgaggcgcaccgcaggatggcggaggcccttgatgcacgcggtgccacaatgaccgcgcaaggagggccacgccatccagggcacgggctgcaggaggccgt

SEQ ID NO: 13553 - protein, 170 aa, Zea mays
  misc_feature: Ceres CLONE 1374183-F
  misc_feature (44)..(150): Pfam Name: Oleosin Pfam Description: Oleosin
  misc_feature (137)..(137): Xaa is any aa, unknown, or other
MADRDRSGIYGGAHATYGQQQQQGGGGRPMGEQVKGMLHDKGPTASQALTVVTLFPLRGLLLVLSGLALTASVVGMAVTTPMFLIFSRVLVPAALLIGTAVMEFLTSGALGLEGLVSITCLDNTERQEFQRNPDYLXEAHRRMAEALDARGATMTAQGGPRHPGHGLQEA

SEQ ID NO: 13554 - DNA, 742 bp, Zea mays
  misc_feature: Ceres CLONE 1374184-F
aaagctggagctccccgcggtggcggccgctctagaactagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcaaccctgccgcgtccgtattatgcacgccaggtcctggacgcgccctccctgcaggacgacttctatctcaacctcgtcgactggtcctcgcagaacgtgctcgctgtcggcctcggcacctgcgtctacctctggtccgcgtccaatagtaaggtcaccaagctctgcgatttgaggcctagggacagcgtatgcgcagtgcattggtcacgggaaggctcttatctttccattggcaccggccttggagatgtccagatttgagatagttctcgttgtaagcggattagaaatatgggaagtcaccaaacaaggactggggtattagcatgcagctcatgcatcttgtcatcgggtaga

SEQ ID NO: 13555 - DNA, 737 bp, Zea mays
  misc_feature: Ceres CLONE 1374187-F
  misc_feature: Translation starting site: 360
  misc_feature: SWISSPROT Homolog: EC 3.4.11.18 Methionyl aminopeptidase
  misc_feature (737)..(737): n is a, c, t, g, unknown, or other
aagctggagctccccgcggtggcggccgctctagaactagtggatcccccgggctgcaggaattcgcacgagaccattacctagaacatcctaatcgaaaaacacgtttctttaccctaaccttttcgctgctccagcgaagaacacagccaccgccgtttcttcgtcttcctcgcagcgccggcgcgccatctcggtacgaaggcgacggcggcgttcaggatcgggatctcagcgacgacgtcagaggcttcccatcccgacccccgccagtcgcctcgcgccctcgactccggactccggtcctccgcacaccggccggtgaccctgcgtttgaacctgctatagaaatttataaaatggccgcggttgatgcgacaaccaaggagatggatgcactgcatgttggacaaaatgatgaaacaaaagagactctgattaaagaagacaaagctgcaaacagcaatcattctgttgttgcagctcagtccttgctaccagaggacgacgatgatgatgaagcacaagctgatggtccatctcaagatggagcagcagctgtaaagaagaaaaagaagaaaacaaatccaaaaagaagaagggcccccttcaacagacagatcctccatcaatacctgttgatgagcttttcccctcaggagaatttccagagggccgaatccaccaataccaggatgacaatctgtggagaacaactagtggaggaaagagggacn

SEQ ID NO: 13556 - DNA, 703 bp, Zea mays
  misc_feature: Ceres CLONE 1374189-F
  misc_feature: Encodes the peptide sequence at SEQ ID NO. 13557
  misc_feature (361)..(361): n is a, c, t, g, unknown, or other
  misc_feature (370)..(370): n is a, c, t, g, unknown, or other
  misc_feature (464)..(464): n is a, c, t, g, unknown, or other
  misc_feature (471)..(471): n is a, c, t, g, unknown, or other
  misc_feature (479)..(479): n is a, c, t, g, unknown, or other
  misc_feature (529)..(529): n is a, c, t, g, unknown, or other
  misc_feature (531)..(531): n is a, c, t, g, unknown, or other
aagctggagctccccgcggtggcggccgctctagaactagtggatcccccgggctgcaggaattcgcacgagaccattacctagaacatcctaatcgaaaaatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcggncctgatcgncgcggcggaggcgcacgcgttcgcgctagtcgtggcggtgtctgtgggcgcgaacatcctccggcgggcacgtgacccctgcccgtgaccttcngcagccntcgtggangcggaaccatcacccctgtttgggggggcccccggtaactggggggggcnancttgttggggcccccccgggggggggtttcccgggccccgttttccaaagggggggaagggccccggggaccctttcgtttaaaggcgtttcttgtggggaaacgctttggccttaaaaaacggagaaacctccggcgggggggcccccgggtgcaccccccggggggggac

SEQ ID NO: 13557 - protein, 88 aa, Zea mays
  misc_feature: Ceres CLONE 1374189-F
  misc_feature (57)..(57): Xaa is any aa, unknown, or other
  misc_feature (60)..(60): Xaa is any aa, unknown, or other
MPINRIALGSHQEVYHPGALKAAFAEFISTLIFVFAGQGSGMAFSKLTGGGPTTPAXLIXAAEAHAFALVVAVSVGANILRRARDPCP

SEQ ID NO: 13558 - DNA, 709 bp, Zea mays
  misc_feature: Ceres CLONE 1374192-F
  misc_feature: Encodes the peptide sequence at SEQ ID NO. 13559
aagctggagctccccgcggtggcggccgctctagaactagtggatcccccgggctgcaggaattcgcacgagaccattacctagaacatcctaatcgaaaagcaccagcaccagcacggcgaccaaccctctcccaacccgactagtcggactcgcagctccgccccaagtccaggtcgaagcatggaagtcgcggcggcgtcggcgaggcccgtcctgcgcgtggctgccatctgcggctccctccgcaaggtctccttcaaccgcggcctcctccgcgccgccgcggaggtgtgcgaggactccatcccggggctccgcatcgacgagctcgacatctccgacctgcccatcatcaacaccgacctcgagaccggcagcggcagtagcaccgtcttcccgcccgccgtcgaggccttccgcgccaaggtctgccaggccgactgcttcctcttcggcgcgcccgagtacaactactccatcgccaccccgctgaagaacgcacttgactgggcctctagaggaaagaactgttgtgcagacaaacctgctgcgatcgtgagtgcaggcggtggctttggaggagggaggtcgcagtaccatctccgtcaggttggggttttcctgaatctccatttcattaacaagcagaactgtgcgtccaatcttccagcagccacccaagtttgacagcgatggaaatctggtc

SEQ ID NO: 13559 - protein, 168 aa, Zea mays
  misc_feature: Ceres CLONE 1374192-F
  misc_feature (12)..(167): Pfam Name: FMN_red Pfam Description: NADPH-dependent FMN reductase
  misc_feature: SWISSPROT Homolog: EC 1.6.5.2 NAD(P)H dehydrogenase (quinone)
MEVAAASARPVLRVAAICGSLRKVSFNRGLLRAAAEVCEDSIPGLRIDELDISDLPIINTDLETGSGSSTVFPPAVEAFRAKVCQADCFLFGAPEYNYSIATPLKNALDWASRGKNCCADKPAAIVSAGGGFGGGRSQYHLRQVGVFLNLHFINKQNCASNLPAATQV

SEQ ID NO: 13560 - DNA, 606 bp, Zea mays
  misc_feature: Ceres CLONE 1374195-F
  misc_feature: Encodes the peptide sequence at SEQ ID NO. 13561
aaagctggagctccccgcggtggcggccgctctagaactagtggatcccccgggctgcaggaattcgcacgagaccattacctagaacatcctaatcgaaaactcttttccgccgcccatggtggccgcgccaccaccgccgccgcagtttgccaagcacttcgctgctgggccgcccccgccgccccaagctggtgctgggcgccgcacgccgaccccgccctcgtctggatccggcgggaacgggtgcgaagaaaataaaaccatttgggtcggtgacctccagtactggatggatgaaaactacctacataactgcttcgggcccagcggcgaggtggttacaataaaagttatccgcaataggcaaacaggacagtgggaggggtatggatttgttgagttcttttctcatgcatcagcagagaaagctcttcagaattttactggtcatgtgatgccaaacactgaccggccatttaaattgaactgggcatcgtatagcatgggtgaaaagcgatctgaagtggcttctgatcactcgatatttgttggcgatctagctgctgatgtcactgatgaaatgctgctggagcttttctccag

SEQ ID NO: 13561 - protein, 162 aa, Zea mays
  misc_feature: Ceres CLONE 1374195-F
  misc_feature (50)..(121): Pfam Name: RRM_1 Pfam Description: RNA recognition motif. (a.k.a. RRM, RBD, or RNP domain)
  misc_feature: The sequence is a functional homolog of SEQ ID NO 536 in the 10/666,642 US patent application
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
MVAAPPPPPQFAKHFAAGPPPPPQAGAGRRTPTPPSSGSGGNGCEENKTIWVGDLQYWMDENYLHNCFGPSGEVVTIKVIRNRQTGQWEGYGFVEFFSHASAEKALQNFTGHVMPNTDRPFKLNWASYSMGEKRSEVASDHSIFVGDLAADVTDEMLLELFS

SEQ ID NO: 13562 - DNA, 659 bp, Zea mays
  misc_feature: Ceres CLONE 1374205-F
  misc_feature: Encodes the peptide sequence at SEQ ID NO. 13563
  misc_feature (621)..(621): n is a, c, t, g, unknown, or other
tggagctccccgcggtggcggccgctctagaactagtggatcccccgggctgcaggaattcgcacgagaccattacctagaacatcctaatcgaaaaaccaaaagttcaaaaccccatccaattccaaatcccacttctcgccagttcacctccgcctccgctcctcccctccccctcccgtcctgccatggccaccgcagcacgcgccctcgtcgccgcacgcccggcacggccgatgatgacgtctcggggcctcccgtcctcctcttccatccgtcccgcgcggaaaagtgctgacgacgagtgcgtccgctgcatggatcggcggccgatattccacctattccccgctgcgttcgggacagggcgttgaccgcgaaccgactgaaatggagcctctgttccctggctgcgactaccagaactgactcatcgacatggacaagcccggcggcgagggcgccaccaagcagcaaatgatagattgctacatccacacccttgaccaggtggtagggagtgaagaggaggcgaacaacacgatatataatgtgtcctgcgagcgctattttggattcggatgcgaaattgacgacgatacctccaacaaactcgaaagncttacagggcttcattttgtgcttcctgacacttacgt

SEQ ID NO: 13563 - protein, 73 aa, Zea mays
  misc_feature: Ceres CLONE 1374205-F
  misc_feature (61)..(61): Xaa is any aa, unknown, or other
MDKPGGEGATKQQMIDCYIHTLDQVVGSEEEANNTIYNVSCERYFGFGCEIDDDTSNKLEXLTGLHFVLPDTY

SEQ ID NO: 13564 - DNA, 634 bp, Zea mays
  misc_feature: Ceres CLONE 1374207-F
  misc_feature (527)..(527): n is a, c, t, g, unknown, or other
tggagctccccgcggtggcggccgctctagaactagtggatcccccgggctgcaggaattcgcacgagaccattacctagaacatcctaatcgaaaaaacaacggtcaagggcctagctatttgttaactctggcccctcacctgctccccttctgtccagcccacgggagggcgactagggttaggggcgaccggaggtccccgcgcctgcccaaatccacccatcccttccgttcaagccgccggagctcccaggccgctggtgtcgaagccgtcgccccttccttccaggcccgcctcctctctgtccgttctgtcttggtcgccgaagctcaagaccacagtgtcaggaagttctccaatcttccagccaaacacaattcatcagtcagatacactttgaccgaggaattattcagaatcactccacgagaggatcagctttcgaagctagagaagcagagctctacccaaacaggccaggacgtctctcaaatccccagttcagtaactgggctaactgtangaaaaggaaagagagatggaaaacgcgcgcgcttaaaaggcgacgtcccccgacatgggaacgaacatggcctgtgaaacaattctggagaggcaggcaaggcaatg

SEQ ID NO: 13565 - DNA, 638 bp, Zea mays
  misc_feature: Ceres CLONE 1374209-F
  misc_feature: Encodes the peptide sequence at SEQ ID NO. 13566
  misc_feature (409)..(409): n is a, c, t, g, unknown, or other
  misc_feature (460)..(460): n is a, c, t, g, unknown, or other
  misc_feature (489)..(489): n is a, c, t, g, unknown, or other
  misc_feature (525)..(525): n is a, c, t, g, unknown, or other
  misc_feature (526)..(526): n is a, c, t, g, unknown, or other
tccccgcggtggcggccgctctagaactagtggatcccccgggctgcaggaattcgcacgagaccattacctagaacatcctaatcgaaaaaatcaatcaaaaaaaaagttcgttttctttctcaaaccctttctagcgatgtcaggttaccctccgacgagccaaggctacagttacggctacggcggtggaaatcaacctccccctcctcagccaccttactcctccaccggaaacaatcctccgacgagccaaggtcacggttacggctacggcggcggaaacaatcctccgtacggatcatcatctccttacgctgtcccctacggcgcgtcgaagccccaatcctcgtctgctccttctgctcccacgtacgctccttctcctccctcaggggacttcacccgncaaaggacaagcctttcggcggcggctacggagctttcgccgcgtctgggncttacggtgctgctcctccccccgtcggnaggatacggagctgctcccgcgcattcgaataccgnngggtacggcgctgggccgggtcttaagggggatacggagctgctgctcgccccgtcggggttcctgaaaaacggggggtaaacgggggggctccccctcggccagagggaaa

SEQ ID NO: 13566 - protein, 155 aa, Zea mays
  misc_feature: Ceres CLONE 1374209-F
  misc_feature (117)..(117): Xaa is any aa, unknown, or other
  misc_feature (129)..(129): Xaa is any aa, unknown, or other
MSGYPPTSQGYSYGYGGGNQPPPPQPPYSSTGNNPPTSQGHGYGYGGGNNPPYGSSSPYAVPYGASKPQSSSAPSAPTYAPSPPSGDFTRQRTSLSAAATELSPRLGLTVLLLPPSXGYGAAPAHSNTXGYGAGPGLKGDTELLLAPSGFLKNGG

SEQ ID NO: 13567 - DNA, 602 bp, Zea mays
  misc_feature: Ceres CLONE 1374213-F
  misc_feature (160)..(160): n is a, c, t, g, unknown, or other
  misc_feature (186)..(186): n is a, c, t, g, unknown, or other
  misc_feature (201)..(201): n is a, c, t, g, unknown, or other
  misc_feature (202)..(202): n is a, c, t, g, unknown, or other
  misc_feature (222)..(222): n is a, c, t, g, unknown, or other
ggagctccccgcggtggcggccgctctagaatagtggatcccccgggctgcaggaattcgcacgagaccattacctagaacatcctaatcgaaaaccgggtttccagggaaacccacccccagatccaaatccagcgaagcgacagagatcaaggatggnagctggagtggggtgcgcttcgccgncgagtacctggtggnngcagcgatcatgatggccgngtggtgctcccgctggcggaactgatcttcccgacaaggggtcgccgtcttccgcttcggcccggggcctccttcctttccaaagaagaaaaaaagggtcatctgatcttaagagaagggggaaacaacggccctcccccgaggggtggagatctggcgggttttgggccccggaatacttcaaatgggtttttcgaaaggggggtctttcccgccaaaaataaatggttaaaaaccaatcccctttttaaccttggtaggaaaaaaacaaacggtgggtttggtcgggtttgatcaaaaaataaaacaagggggtgacttttttgtgggggtgcactacagacaacatttcatacggagtgtttttaaaccacccaaaa

SEQ ID NO: 13568 - DNA, 655 bp, Zea mays
  misc_feature: Ceres CLONE 1374223-F
  misc_feature: Encodes the peptide sequence at SEQ ID NO. 13569
  misc_feature (240)..(240): n is a, c, t, g, unknown, or other
  misc_feature (293)..(293): n is a, c, t, g, unknown, or other
  misc_feature (295)..(295): n is a, c, t, g, unknown, or other
  misc_feature (316)..(316): n is a, c, t, g, unknown, or other
  misc_feature (368)..(368): n is a, c, t, g, unknown, or other
  misc_feature (410)..(410): n is a, c, t, g, unknown, or other
  misc_feature (412)..(412): n is a, c, t, g, unknown, or other
  misc_feature (413)..(413): n is a, c, t, g, unknown, or other
  misc_feature (429)..(429): n is a, c, t, g, unknown, or other
  misc_feature (432)..(432): n is a, c, t, g, unknown, or other
  misc_feature (433)..(433): n is a, c, t, g, unknown, or other
  misc_feature (520)..(520): n is a, c, t, g, unknown, or other
  misc_feature (523)..(523): n is a, c, t, g, unknown, or other
tggagctccccgcggtggcggccgctctagaactagtggatcccccgggctgcaggaattcgcacgagaccattacctagaacatcctaatcgaaaaatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggngctgcagggcttgtacggcgctggcgccggcctgacgacgatgatgggcgccngncgggctgtaccccctacgcgnagtacctgaggcagccgcagtgcagcccgctggcggcggcgcctactaacancccggtggtggggcagacgagcgccatgtaccagccgctccngnncacagtgctgccagcncannattgagaattatggggcccgtgaattccggtcgcgcagcaacttgcgtatgatgatgcaccctttggaggtggccctttgccgccanaanaaaccttgacgagcccatttttaatgcagcagcagcagcagcggctggaaaccccaggtctcaaccatgtcacttagtgattgtggccaaaaatggggccccagggggggggccctccaccagtaccagtac

SEQ ID NO: 13569 - protein, 56 aa, Zea mays
  misc_feature: Ceres CLONE 1374223-F
  misc_feature (29)..(29): Xaa is any aa, unknown, or other
  misc_feature (47)..(47): Xaa is any aa, unknown, or other
MKMVIVLVVCLALSAASASAMQMPCPCAXLQGLYGAGAGLTTMMGAXRAVPPTRST

SEQ ID NO: 13570 - DNA, 649 bp, Zea mays
  misc_feature: Ceres CLONE 1374226-F
  misc_feature: Encodes the peptide sequence at SEQ ID NO. 13571
aaagctggagctccccgcggtggcggccgctctagaactagtggatcccccgggctgcaggaattcgcacgagaccattacctagaacatcctaatcgaaaaattgatccctgaaacccatccacaattggtagctcgttgatccaaatccaagacctcacgtcaacgcactgtctcgactgttaattagtcggcgacgccgtcgtctatgtccaggctgatggctgccatgctgctcggaggcgcgcgcgtcgccggcgccgcaaagctcaccggtaacggcaacgctgctggcatgcatgatcttcccatgccggcgtgcttccttccgccgcgcccgcaggtagcgacctggacccgcctctgcttgcaggctgcgccaagatcgtcccagggcatacgacaacgcgccggaagaccggagagaactaggggactagtacaaggacgcggcgaaggaggctcaatgacgccacctgtggacgacaaggatcactgctgagaggatagccagtctagaccaatagcatgctctgaggacaaggctctgtcgattagcaggacccatgcgtaagaccatggacgaagcgtgataattgaccacgctgcaacgatggtagggacttgactaacgagagatactagcgta

SEQ ID NO: 13571 - protein, 97 aa, Zea mays
  misc_feature: Ceres CLONE 1374226-F
MSRLMAAMLLGGARVAGAAKLTGNGNAAGMHDLPMPACFLPPRPQVATWTRLCLQAAPRSSQGIRQRAGRPERTRGLVQGRGEGGSMTPPVDDKDHC

SEQ ID NO: 13572 - DNA, 633 bp, Zea mays
  misc_feature: Ceres CLONE 1374229-F
  misc_feature: Translation starting site: 290
  misc_feature (390)..(390): n is a, c, t, g, unknown, or other
  misc_feature (577)..(577): n is a, c, t, g, unknown, or other
  misc_feature (578)..(578): n is a, c, t, g, unknown, or other
  misc_feature (625)..(625): n is a, c, t, g, unknown, or other
ggagctccccgcggtggcggccgctctagaactagtggatcccccgggctgcaggaattcgcacgagaccattacctagaacatcctaatcgaaaactttcctctccgatccggatctccccacccgctccggcgagccatcgccgcgtcgcctccacgcgaccgactacttctcatatcaatctatctatccggcttacccgccgccgcacgcaccaaggttgcgttcaccatattacctgtttgcttatcttctcccgagcccagcaaaccctagccgccgccacccatggacatagaggccgacggacgattcggcaacaaacgagtgcacaatcgcctaggcccgggctccggcggcgctccaccatctaccaacggaaaggtctngcaactactggcgtgccggtcggtgcaaccgctttccgtgccccttcctccacagcgagctccccgaggctgcgccgcccaagcgccccactgggaccccggggggaacgtatggcgcaaccccaacaccggagggacgaggaggtggccttcacaatagaattgggggaagggcccaggagggggnncagcgggattgcgagccacaagcccgcctgagaaggccctgcaagancttttctc

SEQ ID NO: 13573 - DNA, 615 bp, Zea mays
  misc_feature: Ceres CLONE 1374237-F
  misc_feature: Encodes the peptide sequence at SEQ ID NO. 13574
tcaccgcggtggcggccgctctagaactagtggatcccccgggctgcaggaattcgcacgagaccattacctagaacatcctaatcgaaaaatagatctctctccctttcccccctctctctctctccgaactctaccccgcagtctcggccgcggccatggcggaggacgcccccaacgccgtcgccgagggcagccagcccgcggcctccgagggatccgccgacgccgccctgccggctgccgcgagcgccaacggcgcggaggcgctgctcccgacgctcaggatctggctgacggcagaacgaacgcgcgacgccgtggtgcgcagcctcgtgcatacgcacacggtacccgtcgtcgtctcggagcgctacggtgccaatgtcggagatcgaggtacgaacgcgccgccgagcgacgtggtagttcgaggccgtcggcgtcaacgccaagtatgagacgctcgtcgacgattgacaggctggctgtaagttgttgccaaggagcatggggactaaactggtaggtaagtgaaactgtcggtgatgaacgctagggtcagctcggcaaccttgactacgcaactgtcgccgccgatagtgcggcagctgt

SEQ ID NO: 13574 - protein, 100 aa, Zea mays
  misc_feature: Ceres CLONE 1374237-F
MAEDAPNAVAEGSQPAASEGSADAALPAAASANGAEALLPTLRIWLTAERTRDAVVRSLVHTHTVPVVVSERYGANVGDRGTNAPPSDVVVRGRRRQRQV

SEQ ID NO: 13575 - DNA, 677 bp, Zea mays
  misc_feature: Ceres CLONE 1374240-F
  misc_feature (548)..(548): n is a, c, t, g, unknown, or other
  misc_feature (617)..(617): n is a, c, t, g, unknown, or other
  misc_feature (619)..(619): n is a, c, t, g, unknown, or other
  misc_feature (620)..(620): n is a, c, t, g, unknown, or other
  misc_feature (622)..(622): n is a, c, t, g, unknown, or other
  misc_feature (623)..(623): n is a, c, t, g, unknown, or other
  misc_feature (677)..(677): n is a, c, t, g, unknown, or other
ggagctccccgcggtggcggccgctctagaactagtggatcccccgggctgcaggaattcgcacgagaccattacctagaacatcctaatcgaaaaaaccaaacgagctgctagcccttctaaccttgctcgacccttgcccgccgcctgaactcgcctcccccgcggccggtcccctgcatctgttcgccgcgccgcaacccggaggagactacgactacgagcaccaccaggtagcagcaactgttttgctgcaatctgacaaagtggagggtttaagagtcgctgcttcttttatgtctgaacaatctttgctttatttgggattgctgggagagtattcttgcgcgacgaggaaaaggcacaagtttctgctccactgcatgcatcaagagcccatccggtttccttggttctgaggtgtcattcgctagtgctcaaagcccggcttggttttctcgaaagatcagcagcccactcttgattcaggactttgtcacacctgatagcatctagttaatacatcttttatccaagatggcactgcnaaaacattggtgcttcaaaaacagggatgatggccttctacaggtacaagatgcccagaagtaccccanannannaaagggcccggggaaaatggtatcaagacaaatattggggaaacatggttgacn

SEQ ID NO: 13576 - DNA, 639 bp, Zea mays
  misc_feature: Ceres CLONE 1374246-F
  misc_feature: Translation starting site: 200
  misc_feature (271)..(271): n is a, c, t, g, unknown, or other
  misc_feature (456)..(456): n is a, c, t, g, unknown, or other
aagctggagctccccgcggtggcggccgctctagaactagtggatcccccgggctgcaggaattcgcacgagaccattacctagaacatcctaatcgaaaagttgtcttggcggctgcggcggagcacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggncggagctttgctcccaagccatcttctggacctcacaagtccaggggagtgccttcctctgatcctcatcatcaagaacagggctcagtatgctctgaactacccgtgaggcatttcctatcctgatgccacgcatgtacttggtgatggccaggtcaagactgaccagaactaccctggtgggntcatggaaggcatttcccatccctaagaacatggagaactaacggctggcttaagacaaccagggccggttcccgtctccaccaatcaaggatgaagatgccaaggtcagctctgcagggggagggcccgttccagtggggcaggaagggcatcccctaactgacacactaacgacggccgaa

SEQ ID NO: 13577 - DNA, 677 bp, Zea mays
  misc_feature: Ceres CLONE 1374247-F
  misc_feature: Translation starting site: 219
  misc_feature (398)..(398): n is a, c, t, g, unknown, or other
tccccgcggtggcggccgctctataactagtggatcccccgggctgcaggaattcgcacgagaccattacctagaacatcctaatcgaaaagacgcccaaaggttattccccaagcacaaacctctgagtctctgacacaccgccgccgcgccgcatccgctacaggctaccctcaccaccgcgcacaccgaagtagtagcaggcggtgccgcccccaatggcggcagactggttgtgggcgcgtagggtgtgggagaagtgggccgcgaagcacatcggcacctccgggaagccggtccaggctgcgctcctgctcaactacgacccctcccggccatctcgcctccttcccgtcgtagcagagcaagagggaacacactttcagctcttgatatgncaccactcctggactttgcccagaggggtaatctgcagactccattggtcccggttgccctggaccaactttgggcccctctcatcatggaaactgggtttggcccccctttgtttaagggccaaaaccagaagggggggggggataatttttggcaagtggggcttggtttaaaacccaaaaggggggggggtcctttgggggggcttcaaaagaaggggggggggggagatttttcacaaacttttcccgggggggccctaattttcccgagggttt

SEQ ID NO: 13578 - DNA, 662 bp, Zea mays
  misc_feature: Ceres CLONE 1374252-F
  misc_feature: Translation starting site: 229
  misc_feature (384)..(384): n is a, c, t, g, unknown, or other
  misc_feature (436)..(436): n is a, c, t, g, unknown, or other
  misc_feature (477)..(477): n is a, c, t, g, unknown, or other
ggagctccccgcggtggcggccgctctagaactagtggatcccccgggctgcaggaattcgcacgagaccattacctagaacatcctaatcaaaaaaagaaagaaaaggagaaggaacagggaagcaaaagcacaagaggtggccgccgcagtccgcaccccctccccaatcacgccacccgacaccgcgctccgcagattcgtagtcgccgctaggcttccggcgagatggacgtggtgaaggcggcgcagttgtcggggcggacgctggaacgggtagtggtggatcccttggtgctgctcatcgtcgaccactacaaccgcgtcgcccgcgacacccgcaagcggcgtcgtcggcgtcctcctcggcactcatcccgcggnttccgtcgatgtcaccaactcctacgccgtgccgttttgagggaggatgacnaggatccttaggatctgggttccttgaccacaattaccacnagccgatggttctcctgttcaagaggattattggccagggggcttgtgttttggctgaacacacacttggcccaaaaataaatggagaaccgatttggattgccctttgttttattcaaaaagtttatggtcccaaaaccgagtgtgtgggatacaatgtaccaccaatctcatggcgctttggc

SEQ ID NO: 13579 - DNA, 668 bp, Zea mays
  misc_feature: Ceres CLONE 1374253-F
tggagctccccgcggtggcggccgctctagaactagtggatcccccgggctgcaggaattcgcacgagaccattacctagaacatcctaatcgaaaagccccgtcgcgactcgcgacttcgcgagtcgccccgtcccagcctcccagccgtcccggctccccgcgaccccgccctccggcagtccggcgcgggggctcctctccgatccggtgagccgaacgaggatcccaactccccgaagaaagcggccacagccagagccagggtggctcggctctcctctcacagactgcgccgcagcgcctaacgctcggctggcagccgctccggccggtcggccccgcgcccccgcccctgctgcctacatccgcctgcagccagaagatctgcctccagcgaccgccctgcctgccccttgtggccttctgtggttctgcacaccagcacacgcacttgtccccaaacaacggcggcggcgatgagtatctcagaagagcttcccggcgaaggatctgacggttgaggaggaggtcttcatcaacgaggaggacatcatccacgagataaccatcgacggagaagatctccccgaccgcgacgaccaacaatgagatgtgctcaacggcatggttgattcccaaccacggcggagggtcgacctaaggtt

SEQ ID NO: 13580 - DNA, 731 bp, Zea mays
  misc_feature: Ceres CLONE 1374256-F
  misc_feature (1)..(1): n is a, c, t, g, unknown, or other
  misc_feature (2)..(2): n is a, c, t, g, unknown, or other
  misc_feature (8)..(8): n is a, c, t, g, unknown, or other
  misc_feature (292)..(292): n is a, c, t, g, unknown, or other
nntttttnccccccccccacaacaccctcaggcacccgccccatgccaacttaaaactgtggctccccgcggtggcggccgctctagaactagtggatcccccgggctgcaggaattcgcacgagaccattacctagaacatcctaatcgaacagtgttcttgttcgtctccgcctcaggcaactccacacggacacggtcacacctcgctcgctctcgctcccgtatcgcggtttccttttcgaagccttgctaggtttagctggggcctccgtctatcctgtcaatggcncccttaggcggctgtacttcagacttcagaggtgacgtgaggcgtggggacgcgcgtagctgattggttcgaggaggcggggatggacccggacttctcgccggcgagtgggggcccgagctttgagttcgccttcaactcgggcaattctctgaccgggtgttgccggatcgagatcctcccctggggaatgacgcccctccgagtccacgggcgccacccgcacgcaggggggcttcactctcccgcctgacacgggacgccccccccgccaaccacccaaccccccgcaccaccccctcccctcatttctaaatcactccaccgtttccccgactggaatccgctagaccccacaacgcgtgcccatcctgagaacaaaggtcgcccctcccacgattggaaggcggccatgggagaccctcggcccccccgcccg

SEQ ID NO: 13581 - DNA, 640 bp, Zea mays
  misc_feature: Ceres CLONE 1374262-F
  misc_feature: Encodes the peptide sequence at SEQ ID NO. 13582
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (449)..(449): n is a, c, t, g, unknown, or other
  misc_feature (481)..(481): n is a, c, t, g, unknown, or other
  misc_feature (503)..(503): n is a, c, t, g, unknown, or other
tccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggatggnnnagagcgagtgccgcgagcggcaccagcaagctgacgcggggcgaggacgggaccnagcggcgtgggacgcctactctcccgctcggnaaagggggggggaaagtgccgncgccagtggcctgcgcccgccacgagggcccggcccgtggaggaacccaggagtgggattgagggcggtgccgcccgccgcggggactgggccgtcgacatggagccaaagagtacgggtcgcggcagcgaaaggcg

SEQ ID NO: 13582 - protein, 74 aa, Zea mays
  misc_feature: Ceres CLONE 1374262-F
  misc_feature (64)..(64): Xaa is any aa, unknown, or other
MGKGSVGASWWAFLLLAGVLLVVAATAGAEDGVVERDRKEDLRWCKQACEWQYGKDTPRKRDGXERVPRAAPAS

SEQ ID NO: 13583 - DNA, 563 bp, Zea mays
  misc_feature: Ceres CLONE 1374266-F
  misc_feature (347)..(347): n is a, c, t, g, unknown, or other
  misc_feature (348)..(348): n is a, c, t, g, unknown, or other
  misc_feature (447)..(447): n is a, c, t, g, unknown, or other
  misc_feature (471)..(471): n is a, c, t, g, unknown, or other
tacccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgagagctgtactgcctcgagcatggcattcaggctgatgatcagatgcccggtgacaagaccattggnnggaggtgatgatgctttcaacaccttcttcagtgagactggcgctgagaagcacgtcccccgtgctggttttttgtgaccttgagcccactgtcatcgnatgagtgaggactggcacctatcngcagctctttcatcctgagcagctcatcagtggcaaggaagatgcaggccacaacttcgctcgggggcactaacccattggcaaggaaatgt

SEQ ID NO: 13584 - DNA, 672 bp, Zea mays
  misc_feature: Ceres CLONE 1374270-F
  misc_feature: Encodes the peptide sequence at SEQ ID NO. 13585
tccccgcggtggcggccgctctataactagtggatcccccgggctgcaggaattcgcacgagaccattacctagaacatcctaatcaaaaaatcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacggcgcagtgaccgatctcgtcgttcaggtcctcgacctgaagtccgtcggcacgggcaggccgggtcagtttcacagcaactggacggcaaggataagaacaaggggatggctcccaccaacttcggggctggagggcccgctccgggaaacctgaagaaacctcggggctcattcgggacatccgaataaattttgggagggcggtcaaagggaaagatggaaaaagccttgggttggcatcaaaaggggcactttgggtgggccaggggcttgaggccccaaaatcccggggggggggcaaaaaaaggaggcccccaatttggggcgaaacctcagggaaaaagggggggggggggagaaccccccctccccttataaacccacagggggggggggggag

SEQ ID NO: 13585 - protein, 75 aa, Zea mays
  misc_feature: Ceres CLONE 1374270-F
MDAAKLVTPVAVSHILAHPSAGSDGAVTDLVVQVLDLKSVGTGRPGQFHSNWTARIRTRGWLPPTSGLEGPLRET

SEQ ID NO: 13586 - DNA, 672 bp, Zea mays
  misc_feature: Ceres CLONE 1374281-F
  misc_feature: Translation starting site: 221
  misc_feature (401)..(401): n is a, c, t, g, unknown, or other
  misc_feature (447)..(447): n is a, c, t, g, unknown, or other
ggagctccccgcggtggcggccgctctagaactagtggatcccccgggctgcaggaattcgcacgagaccattacctagaacatcctaatcgaaaaactggagccctataggctatagccaccaccgcactcgcctccctctctccctcccacactccaccacccgcgccgccgcctcctactccgccccggcccctctgatccgtaccgagcgccggccatggcgctcgccttcgacgagttcgggcgccccttcattatcctgcgggagcaggagaagaagacgcgccttcgggggcttgacgcgcagaaggccaacatcgcctcggccaaggccgtcgcgcggatcctccgcacgtcgctgggacccaagggcatggacaagatgctccagtcccccngacggcgacgtcatcatcacaaatgatggagcgaccatcctggagncagatggatgttgacaaccagatagcaaagctgatgggtggagctgtcccgtagtcaagactatgaaaatcggggatggacccaccgggggtggaagtccatggcaggggctcttctcgagcaggctgagaagcttcctggagcgtggtattcaccccattaggggtggctgaagggtatgagatggcgtcaaaggtagctttttgaccacctagaaatatatcc

SEQ ID NO: 13587 - DNA, 689 bp, Zea mays
  misc_feature: Ceres CLONE 1374287-F
  misc_feature: Translation starting site: 197
  misc_feature: Pfam Name: Inhibitor_I29 Pfam Description: Cathepsin propeptide inhibitor domain (I29)
  misc_feature (370)..(370): n is a, c, t, g, unknown, or other
  misc_feature (407)..(407): n is a, c, t, g, unknown, or other
  misc_feature (548)..(548): n is a, c, t, g, unknown, or other
  misc_feature (549)..(549): n is a, c, t, g, unknown, or other
  misc_feature (593)..(593): n is a, c, t, g, unknown, or other
  misc_feature (601)..(601): n is a, c, t, g, unknown, or other
  misc_feature (618)..(618): n is a, c, t, g, unknown, or other
  misc_feature (622)..(622): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (632)..(632): n is a, c, t, g, unknown, or other
  misc_feature (678)..(678): n is a, c, t, g, unknown, or other
tccccgcggtggcggccgctctagaactagtggatcccccgggctgcaggaattcgcacgagaccattacctagaacatcctaatcgaaaaaccaaaagaaagaaaccaactaaaatcccaaaagagaggaaaggcataaacagacggtagaaggaagaaagggacgctcgtctcggctcgtcacgtgccgccgccatggctgctctgggccgtggcctgcccctcctcctgctcctcctcctcgccgtagcgggggccgccaacgccgcggcggcgcccggcggcatgtccatcatcacctacaacgaggagcacggcgcgcgggggctggagcggacggagcgggaggtgcgggccatgtacgacctntggctcgcggagcacggccgcgcctacacgcgctggngcggagggcgagggcgagcgcgaccgccgcttcctccgtcttctgggacaacctccgcttcgtcgacgcgcacaacgagcgcgcgggcggcccgcggcttccgcccctcggggatggaaaccagttcgccgacctcacccnnacgacgagttcccgcgccgcgtacctccggcgccatggtcccgncggcccgnccgggggaggccggccngggngnnnaaaggnacccgccacggacgggcgccgcccgaaggagctgccggaaaagcgncaactgggaag

SEQ ID NO: 13588 - DNA, 677 bp, Zea mays
  misc_feature: Ceres CLONE 1374292-F
  misc_feature: Encodes the peptide sequence at SEQ ID NO. 13589
  misc_feature (357)..(357): n is a, c, t, g, unknown, or other
  misc_feature (377)..(377): n is a, c, t, g, unknown, or other
  misc_feature (378)..(378): n is a, c, t, g, unknown, or other
  misc_feature (462)..(462): n is a, c, t, g, unknown, or other
  misc_feature (463)..(463): n is a, c, t, g, unknown, or other
  misc_feature (498)..(498): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (556)..(556): n is a, c, t, g, unknown, or other
tccccgcggtggcggccgctctagaactagtggatcccccgggctgcaggaattcgcacgagaccattacctagaacatcctaatcgaaaaagatatagcactcgctgctcgccttggtcccaactacccgctccctgtccagcgtccagcgtgcaaccaacacctcccacgagtccgcgacgcgtcagcgtcaccgtccgtcgtcgcaaacgagcccagtggcgattcgctttcgaaccgcactcgccctcctccgttctcttctctccctcctcctatagttggcttctcgcaaccctctgctttcgatcagctttctccgctccccatttccctctccaactccaatccatggncctccacggatcgctccacnngccggcggaggacgagcaacagcagaagcgcccgtctctcttctcgccgtaccagatgccccgcttccgctcgcccaacggggnntggtgctgggcgccgatgacccaggtgcagcgggncccccgacggcggtcccaggccccgcggggctcgcggagtaaaannncgcgcagcggnccaacgcgacacggcgggcttgctccaatctccgagggcacatttcatcctcgccgtcccggggccctggggtttcccttcgttgtccccctggggattataccaaatcaaggaaacagag

SEQ ID NO: 13589 - protein, 108 aa, Zea mays
  misc_feature: Ceres CLONE 1374292-F
  misc_feature (2)..(2): Xaa is any aa, unknown, or other
  misc_feature (9)..(9): Xaa is any aa, unknown, or other
  misc_feature (37)..(37): Xaa is any aa, unknown, or other
  misc_feature (49)..(49): Xaa is any aa, unknown, or other
  misc_feature (64)..(64): Xaa is any aa, unknown, or other
  misc_feature (65)..(65): Xaa is any aa, unknown, or other
MXLHGSLHXPAEDEQQQKRPSLFSPYQMPRFRSPNGXWCWAPMTQVQRXPRRRSQAPRGSRSKXXRSGPTRHGGLAPISEGTFHPRRPGALGFPFVVPLGIIPNQGNR

SEQ ID NO: 13590 - DNA, 494 bp, Zea mays
  misc_feature: Ceres CLONE 1374300-F
  misc_feature (57)..(57): n is a, c, t, g, unknown, or other
  misc_feature (187)..(187): n is a, c, t, g, unknown, or other
  misc_feature (214)..(214): n is a, c, t, g, unknown, or other
  misc_feature (314)..(314): n is a, c, t, g, unknown, or other
ggagctccccgcggtggcggccgctctagaactagtggatcccccgggctgcagganattcgcacgagaccattacctagaacatcctaatcgaaaaacacccattttctcctgcaagattctttataaccattttgacggtggtgagcccgaagccagcgaaaaccatcaatcccattcctctccntccgctagtagccgcccaaatccaacnaaaaaaggagcccgggggccaaggcccccccccccaaggattcaatcccgccccaaaattcccaaggacaaaaaacgggggaaggggggggtttcccccnaaacccccccccccccggggaacccggaaaagggttttttcccgcccaattaaatcgggggggtttaaagggggggaaaaaaattttgggggggggacaagggggtcttttgttttcccccaaaaaaaaaaataggggcccccccctcggggaaccccccccccccgctccgcggggggg

SEQ ID NO: 13591 - DNA, 675 bp, Zea mays
  misc_feature: Ceres CLONE 1374316-F
  misc_feature: Translation starting site: 137
  misc_feature: SWISSPROT Homolog: EC 4.2.3.1 Threonine synthase
  misc_feature (369)..(369): n is a, c, t, g, unknown, or other
  misc_feature (399)..(399): n is a, c, t, g, unknown, or other
  misc_feature (424)..(424): n is a, c, t, g, unknown, or other
  misc_feature (509)..(509): n is a, c, t, g, unknown, or other
  misc_feature (659)..(659): n is a, c, t, g, unknown, or other
aaagctggagctccccgcggtggcggccgctctagaactagtggatcccccgggctgcaggaattcgcacgagaccattacctagaacatcctaatcgaaaaactctccaatctcgccgccaagcctcaccgcaccatggcgaccttcaccgcggcctcctccctctccctcctcttctcccacccgcactcccactcccgccaaccatccgcccaggggcccaccgccagctcccacctccacctgcatccgcgcgccagccgcgcgcgctgcgcctcttccgacacgacggccacgaagcaccgccgcccagcggaggagaacatccgcgaggaggcggcgcggctccgaggccgggcccagggttnctctgcgtggtacgagcccttcccgccggncgcccggcggcgacccgaacgaggnctactcgctgggacgaggtcgtctaccgctccgggctcggggggccctcctcgacgtgcgccacgacatgggaggcgctggccgnctacccggggtcctactggcgtgacctcttcgactcccgcgtcggccgcaccgcctggccctacggctcgggcgtctggtccaagaaaggagttcgtgctccccgagatcgactccgaccacatcgtctccctcttcgagggcaactccnacctcttctgggcggg

SEQ ID NO: 13592 - DNA, 660 bp, Zea mays
  misc_feature: Ceres CLONE 1374326-F
gcaggaattcgcacgagaccattacctagaacatcctaatcgaaaaatccctcgctagaataacgcttccctcttcgaggatcttgataacattacgcaccctccactagtctcccccagcgactgggagcgccatggcgacgcctccattgacctcgacgaccctgagcggctatagccgacctccccactggtctttcccttccacctgggcgccacagcgtttcccttcccgtcaccacgaaatcccggagggacgagggagggagttcgtcccctgatcgcatcggccgatccccgccgccggaccttccaatcctttcgctgccgccctggcccaacagaaaaagcagaaggggaacccccccggcggcgcgcggttacctccccagaagaaaagcggacgcccggcaccactacaaagtccactcacaaaacccaggcgccggccgtcagcgcgcggtacgacggggaaccgcaatgggcgtgggcaacagggcggcggcgggggacaaaaaaacgcacctgcccccctgtccccccgagtgccatccagaccggaacacccaaaacccgcagcgccagcacaaaaaaggccgcgccacgcaaggctcagccgcaaccacaacacagacagcagacaggggcgagcaatgactg

SEQ ID NO: 13593 - DNA, 618 bp, Zea mays
  misc_feature: Ceres CLONE 1374328-F
  misc_feature: Translation starting site: 225
  misc_feature (605)..(605): n is a, c, t, g, unknown, or other
tggcggccgctctataactagtggatcccccgggctgcaggaattcgcacgagacaattacctagaacatcctaatcgaaaacgggatactacactacccagctcctctccagtctcaacccagcccgcctctcgaacttccagaaccgtcctctcgctacctgcggctgcggctgctatctctgtcatctagaggagagtgtaagggcactagatagagagtgatggcttctcctgatccatcggcggcagatgccggcaccgggggcgagtcgacgagccaggcggcggccgtggaaccgatccggatgccgacggtggaggagatcaaggggcaggacatctggaacaactgcgccgttcgcagcgtcgtcagtggcgtcttgggaggcgggtcttggtgtgcttatgggacttttctttggagctttggaaaatccgataatggcagagcagatgacagcaaggcagcaaatagtatacacagcaaagcagatggggtagtagaagtataagtaatgccaaaacctttgcagtcatggggtctgattttctcagcagctgaatgtaccatagaagaaggttcgggcaaagcatgacactancaatacagcggga

SEQ ID NO: 13594 - DNA, 663 bp, Zea mays
  misc_feature: Ceres CLONE 1374329-F
  misc_feature (463)..(463): n is a, c, t, g, unknown, or other
  misc_feature (497)..(497): n is a, c, t, g, unknown, or other
tccccgcggtggcggccgctctagaactagtggatcccccgggctgcaggaattcgcacgagaccaacctagaacatcctaatcgaaaagaacacgatccctttctcccctttccctgcgtagtgcggagctccagtgaaggaaccaaacagcgcaacacacgaacacaccaggcggcaggctccaccccgtccttttcctgccttttccccccgtcgagttaatccatccagtcgccaaaagctttgctaaatttcacgtgtctcgcctcgagtcgtccctaatccgacgatgccttgttctactcctaaaaaaacccaaagatcctgactttctcttgctgctagcctcccttttcccttctcccttaatcgcactgttggaagcttttcgctgtcacccccacccacctccggcgctcttttttagcattttccttgggctctggactccaaatcccagnccttttgtttgcttctctgctcttggctgatggntgtccccgggtccaggactcttgatgcttccctcggggggggggttcggtcccatggcggcagctgcgctggcaatggcagaagcaggtggtggccgagctcccgagtgaggtggaagacgccgccgtcgatgctgcgccgaggtggcccgtgggagatggcccgc

SEQ ID NO: 13595 - DNA, 589 bp, Zea mays
  misc_feature: Ceres CLONE 1374332-F
  misc_feature (90)..(90): n is a, c, t, g, unknown, or other
  misc_feature (160)..(160): n is a, c, t, g, unknown, or other
  misc_feature (177)..(177): n is a, c, t, g, unknown, or other
  misc_feature (180)..(180): n is a, c, t, g, unknown, or other
  misc_feature (181)..(181): n is a, c, t, g, unknown, or other
  misc_feature (191)..(191): n is a, c, t, g, unknown, or other
tccccgcggtggcggccgctctagaactagtggatcccccgggctgcaggaattcgcacgagaccattacctagaacatcctaatcgaanaacaaaaaattagggagttttcttctcccgtccaccttgcgtgctcgcgcgcgagctctcgtggcgcagncacaactaggcgaccgncgnncgccctacgncacgtggtcgagtctagcctcgtcgattgctccccaagttaaatgatctacaagcttcagaacatggtcagaatacaatttcaggctggggtccctgtgcactctttataagactccgggaccaagaccattgcagatatggggataaaggagatgtggatggggacattaaaccacccccagatgaagatatcccatcctatggacttgaaaatggtgggacaaatggggcagggcacttaaatcccatggcccgcgtgatccctctgctactcttggggataaaactttcccttcttgggaatatatgtggaaaaaacttaagaaatacctcacggttgagattccaaggtctcggtgaacagaaagggtccacacccaatttctaagaatataaa

SEQ ID NO: 13596 - DNA, 655 bp, Zea mays
  misc_feature: Ceres CLONE 1374340-F
  misc_feature: Encodes the peptide sequence at SEQ ID NO. 13597
tggagctccccgcggtggcggccgctctagaactagtggatcccccgggctgcaggaattcgcacgagaccattacctagaacatcctaatcgaaaaattttttttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcggcggcagtttcgtcgccgtcgcctccatgacgtccgccgccgtctccaccagggtggagaacaagaagccatttgctcctccgagggaggtacatgtccaggttacacattcaatgccatctcacaagattgaaattttcaagtcacttgatgattgggctagagataatatcttgacacatctcaagccagtcgagaagtgttggcagccacaggatttcctccctgacccagcatctgaaggatttcatgatgaagttaaggagctcagagaacgtggcaaggagatccctgatgattatttttgttgtttggttggagacatgattactgaggaagctctaccacataccagactatgcttaacacc

SEQ ID NO: 13597 - protein, 145 aa, Zea mays
  misc_feature: Ceres CLONE 1374340-F
  misc_feature: SWISSPROT Homolog: EC 1.14.19.2 Acyl-[acyl-carrier-protein] desaturase
MALRLHDVALCLSPPLAARRRSGGSFVAVASMTSAAVSTRVENKKPFAPPREVHVQVTHSMPSHKIEIFKSLDDWARDNILTHLKPVEKCWQPQDFLPDPASEGFHDEVKELRERGKEIPDDYFCCLVGDMITEEALPHTRLCLT

SEQ ID NO: 13598 - DNA, 699 bp, Zea mays
  misc_feature: Ceres CLONE 1374345-F
  misc_feature (580)..(580): n is a, c, t, g, unknown, or other
  misc_feature (625)..(625): n is a, c, t, g, unknown, or other
  misc_feature (699)..(699): n is a, c, t, g, unknown, or other
ggagctccccgcggtggcggccgctctagaactagtggatcccccgggctgcaggaattcgcacgagaccattacctagaacatcctaatcgaaaaaaatctccagccgccactacgcctccctctagctccagccgccactacgccggtcgcagagtcgccagctgcctagacgcccggaggcccgcgggcgctccctcctgggctgctggcctccttcacattattggagccagaggagcgggcggcggcttgcactccatcccatcgcttgggtgcgtcgccccgaatccaatcgcctggtcaagtctgttgctgccggaggtagacggacgccttatcgtgctcgtggccgcagctagcgcgccggagccacagctggagcgctcgccggcgacgagtcgccgccccgcaaggagcctacgaggcacgcaccgccacgtctaggcgccaggcggagacgttattacacaacattaaaggagatgccttcactccagaaagcattgcctccagaactttgctgatatgtgctcaggttatatcgtggatggctacggagggccgaagtatattgggncatcagaaacaccatacagaaacttttagccgccatgtggagacnaccattccagaaaaacttgcgtggaactggtcccggagaaaataccgaaaatggaggccgatgctgccaagggn

SEQ ID NO: 13599 - DNA, 647 bp, Zea mays
  misc_feature: Ceres CLONE 1374349-F
  misc_feature: Translation starting site: 167
aaagctggagctccccgcggtggcggccgctctagaactagtggatcccccgggctgcaggaattcgcacgagaccattacctagaacatcctaatcgaaaaaatctagggctctctcgtgctctgatctcatcttctgctcgctggtgtcccctccctctcacccatggtttcggcggtgttggcaactcaagcggagacttacttcctgcgcaactactaccagctgctgcaacaaacccccgatgacgtccaccagttctacagcgaagacaacaccatggtccgcgacgacgacctcaccgggacgaccgcgtctgccaacaacatgatggacatacactcactcatcatgtctttgaacttcacccaaattgatgatcaagactagccaattttgtgaactcatggtgagatggactggtagatatgctctctgtgctagtgcaaaccaaggagtacagccaccagaggaaatttatccagatgctcttccttgcccctcaagagaaggcttactttgtcctcaacgattactttcacttcgttgaccaagaacatgtgaagcctgcgccagtgattgctcaggaagactaccagagcaatttggcacccgacacagttgtagacaccgctcctgagtacct

SEQ ID NO: 13600 - DNA, 656 bp, Zea mays
  misc_feature: Ceres CLONE 1374350-F
aagctggagctccccgcggtggcggccgctctagaactagtggatcccccgggctgcaggaattcgcacgagaccattacctagaacatcctaatcgaaaaattatccgaagttcccaacctacgtgaagtcccagtggtccgaccgcaaaaccgacccttaatgtcccccgcctcttccatgctcaccgatcgagtggttctcctccccgattcccagtcccgcgcatcagcgccggcggcggcgtctcctccttcgctccggcgcgacgcgcgttagtcgcactctctgagcgagaggtgttgacatctttcctgcctcctgccacgtgccagggggatcataacaagagaggtggatctgaatcacccagcctgagtcgagtcgtctgagctgcaatcaatctgttagacacgtgtatccccgtcatgagtgcctcaagcgcatctgaggctatatcaggagcatatcgtcccagatccctctgaacatatgcgatgcattgggatttagaaggtgagggtcatagtcgcagcttgataaacaaatggaattccctggaaatcgcgaagatttcccaccctcaatttcttgaattggccggggaggcaccccgcccacgttcccgggaattaggttacctttatattgcgcgg

SEQ ID NO: 13601 - DNA, 668 bp, Zea mays
  misc_feature: Ceres CLONE 1374351-F
  misc_feature: Encodes the peptide sequence at SEQ ID NO. 13602
  misc_feature (392)..(392): n is a, c, t, g, unknown, or other
  misc_feature (396)..(396): n is a, c, t, g, unknown, or other
  misc_feature (429)..(429): n is a, c, t, g, unknown, or other
  misc_feature (495)..(495): n is a, c, t, g, unknown, or other
tggagctccccgcggtggcggccgctctagaactagtggatcccccgggctgcaggaattcgcacgagaccattacctagaacatctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaaagcagcgaagcagcacatgtgcacgttcgcgctgtacgcgcacgacccgaagcggcaggtggagacgcaccactacgtctccccgcctcancagnacttccctccagtgcgcgtctatgactccgacnaagccgacgcgcgtctcatcggggtggagtacatcgtgtcgaggaagatcttcaactcgctgccgncggaagagcaccggttggggaactcgaccgcgacgaaatcagtcagggctggggacgaacccgaccggggggggcttcctggaaaaaggggaaattgacccagtgccccacgtttcgaaaagttctggggccccggggagggggaacccgggaaccccttggcctgggccccc

SEQ ID NO: 13602 - protein, 147 aa, Zea mays
  misc_feature: Ceres CLONE 1374351-F
  misc_feature (26)..(142): Pfam Name: DUF1264 Pfam Description: Protein of unknown function (DUF1264)
  misc_feature (81)..(81): Xaa is any aa, unknown, or other
  misc_feature (83)..(83): Xaa is any aa, unknown, or other
  misc_feature (94)..(94): Xaa is any aa, unknown, or other
  misc_feature (116)..(116): Xaa is any aa, unknown, or other
MASSDGKPLPTPASVGGGGGSSTAPPGQPTTVASKVLDMGAAAMQSLRPVKAAKQHMCTFALYAHDPKRQVETHHYVSPPXQXFPPVRVYDSDXADARLIGVEYIVSRKIFNSLPXEEHRLGNSTATKSVRAGDEPDRGGLPGKRGN

SEQ ID NO: 13603 - DNA, 708 bp, Zea mays
  misc_feature: Ceres CLONE 1374358-R
  misc_feature: SWISSPROT Homolog: EC 1.3.3.9 Secologanin synthase
  misc_feature (451)..(451): n is a, c, t, g, unknown, or other
  misc_feature (470)..(470): n is a, c, t, g, unknown, or other
tcaattgggtaccgggccccccctcgaggtcgacggtatcgataagcttttttttttttttttttgcaaagttctatgtagcattatatatttatatacataatacgggcataaaatcccagaaagttaccagttttcaacaagttttggttctttagccttactgtttggcggatgaaaccaagtcctgaatactgacctcttatgtatacttagaccccaaaaaaaaaatcagctatcaggctacacacatacacacatccatttcacatcatcatacatccgggagtggcctcaaaactatgggaaggccgaacttaggctggagcgtgatataatccacaggcgcgtgcacgtagctcgaggaaagcgtgaaggagaacttcttcaggatcatgggcatcaccgacttcgcttccagcatcgcgaaagtctggccgatgcatgcccntcgcccgatcgagacgacngaagaagcctgcgggggcttggccgcgttcgtgatcccgtcctgaaacttcaccggtcgaaatcattggcgttgcccccccaacctttttgttttgggggaagaccggacaggttgggaaatccccttgcctttggaaagctaagggtccccacccttttttcaagggggggtttttttaaataaaaaaaaagaggccccaaaaattctttgtttctcaaaaaacccctttttctttt

SEQ ID NO: 13604 - DNA, 625 bp, Zea mays
  misc_feature: Ceres CLONE 1374358-F
  misc_feature: Encodes the peptide sequence at SEQ ID NO. 13605
  misc_feature (368)..(368): n is a, c, t, g, unknown, or other
  misc_feature (492)..(492): n is a, c, t, g, unknown, or other
tccccgcggtggcggccgctctagaactagtggatcccccgggctgcaggaattcgcacgagaccattacctagaacatcctaatcgaaaagttatttaatttggagcagttctttcttatctcgacactgcacggcacggaggagttaaagggacggcagcgcaccggcacctcctctcacacaggcagtccccccacccacccagcgtgcgaggcgatcaaaccgtgtgcggccgtgcgggcatggcggccacgctgctcctggcctcggcgaccgcgctcctggcgctggcggcggcgtggttctgggactacgtcgtggtgcgcctcctttggcggccccgcgccgtggccggcatgttcaggncgcagggggtccgcgggccgccctacagcttcctcagcggctgcaaccgcgagatgaggaggatgaaggcggaggccgacgacgggctccggctggacgtccgcgaccacaactacctccccanggtgatgccccacttcctcgcctggaagcagcagtacggggagccattcctgtactggatgggtcccgcgcccccggtctgcctcttcgactacgagtcggtaagggcagttctttttcaacaagtccggcat

SEQ ID NO: 13605 - protein, 127 aa, Zea mays
  misc_feature: Ceres CLONE 1374358-F
  misc_feature: SWISSPROT Homolog: EC 1.3.3.9 Secologanin synthase
  misc_feature (42)..(42): Xaa is any aa, unknown, or other
  misc_feature (83)..(83): Xaa is any aa, unknown, or other
MAATLLLASATALLALAAAWFWDYVVVRLLWRPRAVAGMFRXQGVRGPPYSFLSGCNREMRRMKAEADDGLRLDVRDHNYLPXVMPHFLAWKQQYGEPFLYWMGPAPPVCLFDYESVRAVLFQQVRH

SEQ ID NO: 13606 - DNA, 672 bp, Zea mays
  misc_feature: Ceres CLONE 1374361-R
cagattgggtaccgggccccccctcgaggtcgacggtatcgataagcttttttttttttttttttatatagaagataattaattacgatgaataaggatacaacgaaacttatgttaaaagaaaaaaaaaaggatacaaggaaaccaaaaacattatatgcgttctatgtatttatattatgtatgattcaccaagcaaacttattgaggttgaagagcctaattgatgtaaactcttatttagtgacctagctacaacaagcgaagtgctaaattatattggagaagttgtccataaagtctccaatgatacgaagaagctgttgcgcagcatctgaagatggactgttgttatagaaaccatgctcctcgttttcaaattcaatgtaatctacttttttccctctcatcttcttcaatttatatgcgtactctctgggcctgtctttcagaagttccgagccgccggcgatcaccaacattggctctatgctaattgattcaagtgcaggactcgtcggcccaaaagggttagccatgggatgatcccttgttgcaccttctggtagtgaaagtctccaaaacttgtcaagcaaatccaagtttagctttttctcagaggggccatcctctgacttggttctctcctccccgccaaaaaatggtcccaaa

SEQ ID NO: 13607 - DNA, 706 bp, Zea mays
  misc_feature: Ceres CLONE 1374361-F
  misc_feature: Translation starting site: 529
  misc_feature: Pfam Name: Abhydrolase_3 Pfam Description: alpha/beta hydrolase fold
agagctggagctccccgcggtggcggccgctctagaactagtggatcccccgggctgcaggaattcgcacgagaccattacctagaacatcctaatcgaaaaatatccaaaaggctttaactagaagaggaataaaatgggttcactaggagaagagcagccacaagtagcagaagactgcatgggtttgcttcaactcttgagcaacggcaccggtttgagatccaagagcattgaccttatcactcaacaaatcccactcgctaaccacgaaaccgttctcttcaaagactcggtcttccacaaaccaaacaacctccacctccgtctctacaagcctgttctcgtctctaaccgtaccatccccgtcgtggtcttcttccacggcgggggcttttgcttcggctcacgttcttgggctcactttcacaacttctgcctcactcttgcatcctccctccacgcccttgtgggggcccctgactaccgggttagcacccgagcaccgcctcccggcagcctttgaggatgcagaggctgcgcttgtttggctacgggaccaggctggttccagtgactgggaccactgggttcgaaggggggacgggcgttgacttcgacagggtttatggccttgggggattcctcccgtgggacatagctcatcaccttgctttcccggtttggtctggctcagtcgagttaa

SEQ ID NO: 13608 - DNA, 721 bp, Zea mays
  misc_feature: Ceres CLONE 1374362-F
  misc_feature: Encodes the peptide sequence at SEQ ID NO. 13609
aagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggagaccaagatattttccctccttatgctccttgctctttctacatggggtgctaacgcgacaattttccctcaatggtcacaagctcctatagcttccctttttcccccataccttccatcaattatagcttcagtatgtgaaaacccagctcttcaaccatataggcttcaacaagcaatcgcagcaagcaacatacctttatcgcccttgttgtggcaacaatcgccagccctatctttggtgcagtcattggtacaaaccatcagggcacaacagctgcagcaactcgtgctacctgtgatcaaccaagtagctctggcaaacctttctccctactctcagcaacaacaatttcttccattcaaccaactggctacactgaaccctgctgcttatttgcagcaacaactattaccatttagccagctagctactggctactctcaacaacaacaacttcttccatttaaccaattggccgcactgaaccccgctgcttatttgcagcagcaaatactactaccatttagccagctagctacagca

SEQ ID NO: 13609 - protein, 184 aa, Zea mays
  misc_feature: Ceres CLONE 1374362-F
  misc_feature (1)..(184): Pfam Name: Zein Pfam Description: Zein seed storage protein
METKIFSLLMLLALSTWGANATIFPQWSQAPIASLFPPYLPSIIASVCENPALQPYRLQQAIAASNIPLSPLLWQQSPALSLVQSLVQTIRAQQLQQLVLPVINQVALANLSPYSQQQQFLPFNQLATLNPAAYLQQQLLPFSQLATGYSQQQQLLPFNQLAALNPAAYLQQQILLPFSQLATA

SEQ ID NO: 13610 - DNA, 617 bp, Zea mays
  misc_feature: Ceres CLONE 1374373-F
  misc_feature: Encodes the peptide sequence at SEQ ID NO. 13611
  misc_feature (538)..(538): n is a, c, t, g, unknown, or other
agagctggagctccccgcggtggcggccgctctagaactagtggatcccccgggctgcaggaattcgcacgagaccattacctagaacatcctaatcgaaaaaaccgaagcaatccgacctgagaccaagacccgcaccacgcggctcgccgccgatggcgaacgccgacgccgacgaagcgccgctgctctctgtggaacacctccgtccaggatcctgcagccgcgagctcgagctgcgggagttccgcgaccgctacgtgatccgttcgctcgacggcgccgccgctttcgccgtccttcgctccggcggctccatccgccctctctccccagaggaagccgtagctgagagcgactgcaaggtttccagaatatacggggtggtaggcaccataagattgctcgctggaagctatgtactcgttatcacttctcagaaagatgctggctcttatctgggctcccctgtgtaccaagtgaaactcatgaaattcttatgctgcaacgaggctatcaagcacttgactccacaggnaaagaagggatgaggcatacttcatgtctctcctgagaattgcagaaactacttgtggattgtattattcatacgacag

SEQ ID NO: 13611 - protein, 131 aa, Zea mays
  misc_feature: Ceres CLONE 1374373-F
  misc_feature (128)..(128): Xaa is any aa, unknown, or other
MANADADEAPLLSVEHLRPGSCSRELELREFRDRYVIRSLDGAAAFAVLRSGGSIRPLSPEEAVAESDCKVSRIYGVVGTIRLLAGSYVLVITSQKDAGSYLGSPVYQVKLMKFLCCNEAIKHLTPQXKKG

SEQ ID NO: 13612 - DNA, 638 bp, Zea mays
  misc_feature: Ceres CLONE 1374375-F
  misc_feature (531)..(531): n is a, c, t, g, unknown, or other
  misc_feature (608)..(608): n is a, c, t, g, unknown, or other
  misc_feature (610)..(610): n is a, c, t, g, unknown, or other
  misc_feature (620)..(620): n is a, c, t, g, unknown, or other
gctctagaactagtggatcccccgggctgcaggaattcgcacgagaccattacctagaacatcctaatcgaaaagtgttttcttccttccccggtctcattccacgcgcccgctcctcttcgccctcgtcttcctccatcccacggtcccacctgtccctctcaccgcctcgttattttttcgcccccatctttgaacgccgggactccaactccaccgttcctccctcttcgttccctccgatcccgcccctataaatccagtcgcctcagccgccacagcgggccgcaagcacgtaaccacacagctcactgctgctcccgtcttcccgtgtcctgtcgtgctcccgtcgccgggggcggaagggttcgcgaggccggcgggcggttagggatttctccggagtccccgcgatggcgaagctgtacgtgcagggcgttccccgcccggcggatttgaaaaaaaaaaaacccgagggggttattggaatcccggggggggtggggagaagcccaaaaaccccaaatgggnttcttttccccggggggcgccccgggcccctccctcccgggttttgggggggggggcccccccggggggacaccccngnggggggaacnacccccgcggtgaaaaaa

SEQ ID NO: 13613 - DNA, 689 bp, Zea mays
  misc_feature: Ceres CLONE 1374376-F
  misc_feature: Encodes the peptide sequence at SEQ ID NO. 13614
  misc_feature (368)..(368): n is a, c, t, g, unknown, or other
  misc_feature (390)..(390): n is a, c, t, g, unknown, or other
  misc_feature (407)..(407): n is a, c, t, g, unknown, or other
  misc_feature (416)..(416): n is a, c, t, g, unknown, or other
gctctagaactagtggatcccccgggctgcaggaattcgcacgagaccattacctagaacatcctaatcgaaaattcacgacttacaaaccctcacctcttcccttcctccccgccgccgccaccgccggaaggagaaaaaaaatgggtgccgatggggaagaagcgccgcggatagtcgtgccaatggcggtggaggggacctcggagcagctggcgttcgtggaggagtcgaagctgcagaagcgcaaggagaacgcggactgggccgtcaggaaccgggagcgcaggggggtaaagcgccagcgcatccgcgacgagcacaaggtcaccgaaagggggcccgaggacttcgttgcggcgttccgnaacaaggaacgcgacttcctgnggatgaggacccgcctncaggtccgnaaggagccgcccgccgaggcgctcagctccaagctcgtcttcacacatcggatccctggaaccgaggacttgcattggcacagcaggaagggcttgaggaagctacggctgacgacggtcctcaccggcgtatacctcagagccagcggaggtgacgctgatgagtcttcttgtgggccaaacctttgtcatctagggggttccaaacttgaagaacttcaaataacttatttacaaaaagggccgtggctttttcgacaaggagcctttccc

SEQ ID NO: 13614 - protein, 182 aa, Zea mays
  misc_feature: Ceres CLONE 1374376-F
  misc_feature (30)..(98): Pfam Name: Ribosomal_L30_N Pfam Description: Ribosomal L30 N-terminal domain
  misc_feature (83)..(83): Xaa is any aa, unknown, or other
MGADGEEAPRIVVPMAVEGTSEQLAFVEESKLQKRKENADWAVRNRERRGVKRQRIRDEHKVTERGPEDFVAAFRNKERDFLXMRTRLQVRKEPPAEALSSKLVFTHRIPGTEDLHWHSRKGLRKLRLTTVLTGVYLRASGGDADESSCGPNLCHLGGSKLEELQITYLQKGPWLFRQGAFP

SEQ ID NO: 13615 - DNA, 708 bp, Zea mays
  misc_feature: Ceres CLONE 1374380-F
  misc_feature: Encodes the peptide sequence at SEQ ID NO. 13616
  misc_feature (708)..(708): n is a, c, t, g, unknown, or other
tggagctcaccgcggtggcggccgctctagaactagtggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacccggtctcctctcctgcaaagaggtacgtaactgcactttcctgctcagtcttttgatcggtttcagtgatgcactgatgctgtagagtttcgtttctgttagtactctaatcaacggacaacggtttctgttagtattcttgggttcatggctgtctgcagattgtcgcccttgctctgcctgctctattcggcctcagttcattctgtcgtaaacctcacctcgtaactgaaataagccatatgcgccgcgcgtcgaagcttagtgtctgatcgatacgctatccctacaattttctgagctgttgaactcctgcgcccgtctcctcgtcgaggacaggaagatgagctcgctacacgccacacgagcggagcttggcctggttgtcctgtacctgaacaaagccgaggcccgggacaagatctgcagggcgatccagtacggctccaagttcgtaagcaacgggcagcctggcactgcgcaggaggtcgacagatcgaccaccttggctcgcaaagn

SEQ ID NO: 13616 - protein, 58 aa, Zea mays
  misc_feature: Ceres CLONE 1374380-F
MSSLHATRAELGLVVLYLNKAEARDKICRAIQYGSKFVSNGQPGTAQEVDRSTTLARK

SEQ ID NO: 13617 - DNA, 663 bp, Zea mays
  misc_feature: Ceres CLONE 1374382-R
ccgggccccccctcgaggtcgacggtatcgataagcttttttttttttttttttgcataccaagcaaacaaaaaagcaaaccttctttttctgtacagactacagagctacgcctgacatgtctgcaaatcaccccattacacaataccgacgaagaagaaaaaataaatatatgaacaactctacttacaaacaacccattaacatgtacagacagccctgtcggcacgtggttcctacaagaacagaacaaggaaactcaaccacatcacattactgcagggctcattagtcagcacaggtgaaagctggggtgtgggtgacattcagaatgtagcagattctcatcgaaatgcccactctaaaagagtctaagctctgaatctcagcgacagagtagttcttcctttcatcagcatgagtcttcatgtaaagcctggaggaattgttgaactgttccgtggaggcaaccaaaaaccaaccgtggagcatgaggctatccgggtctgcaaaaccaaacctgttgcagtggtattactcaactctcgacaacagtccccttcagaaagactcacgccaagcaacgaagattcctcgcaaaattgacagcaaacatggaaagaatggtctaatccatccatccattcaaagatgcctgcagaa

SEQ ID NO: 13618 - DNA, 659 bp, Zea mays
  misc_feature: Ceres CLONE 1374382-F
  misc_feature: Encodes the peptide sequence at SEQ ID NO. 13619
ggagctccccgcggtggcggccgctctagaactagtggatcccccgggctgcaggaattcgcacgagaccattacctagaacatcctaatcgaaaagaccttggctaccatcgcaaaccccgcttttgtttatcattccttctctccagtcttgacttcccctctccctccctctctctctctcttcccggcggggcggccggaaatctccccctaaattcagctggtttcacgggagagctatcggccggtggagaggaaaggacgagtcttgagctggacttcttggcggattggctgctggcattcgcaggaactgtgtgtccgtgctcaggagcggggagatgagctgcttaccgtgctccggttcctcggggaaggaggacaagagcttggcggcgctctcgccgagcccccggcctgcggccaaggcggcaccagtacgatcaaattcacgtgcttcgagctccaggaaggaagattctgtacctgttcgcagagcaggaaacactgcacatggcccggcacagattttcagtttcccgggagttggctgttgccaccaaaaatttcagaagagattgcctggtgggaaaacggggctttggtcgtgtggattacggacatatggaaaatgggggggtcattgctgggaaaca

SEQ ID NO: 13619 - protein, 105 aa, Zea mays
  misc_feature: Ceres CLONE 1374382-F
MSCLPCSGSSGKEDKSLAALSPSPRPAAKAAPVRSNSRASSSRKEDSVPVRRAGNTAHGPAQIFSFPGVGCCHQKFQKRLPGGKTGLWSCGLRTYGKWGGHCWET

SEQ ID NO: 13620 - DNA, 621 bp, Zea mays
  misc_feature: Ceres CLONE 1374383-F
  misc_feature (478)..(478): n is a, c, t, g, unknown, or other
  misc_feature (510)..(510): n is a, c, t, g, unknown, or other
ggagctccccgcggtggcggccgctctagaactagtggatcccccgggctgcaggaattcgcacgagaccattacctagaatatcctaatcaaaaaactggtaatccttgtcaagtgtcaacccaaccgtccacggtccgccctcctccttcgttcacgtcttcctcctcgcgttcctctcgtcagtacggcgacgccgcaaggctcgcaccgctgacagtcccccttcccggatcgagcctctcttttcccagatcggattctaattgggctatcgccgccgccgtgccaggtgccgagtccttagccgatcttcgccggcgaggagcgcccaccaggagttacagactgaatgacaagaatgttctctatatcatcctcagtatgtgtgaagaaatagtctgtaactacacatacctttcattgcaattaccaagaactggaaatggacgatgataatgggcttgagcttagtttnggcctatctttgggcgggtcatcagggaaggncaggctagagatgcacctctagaaccaaaagcagaaccccagtggaagaaagcagtagcaaaggtggttacaaactcctgatgctccttctgggaaaatttatcaaagagg

SEQ ID NO: 13621 - DNA, 680 bp, Zea mays
  misc_feature: Ceres CLONE 1374386-F
  misc_feature: Pfam Name: DUF1644 Pfam Description: Protein of unknown function (DUF1644)
  misc_feature (249)..(249): n is a, c, t, g, unknown, or other
  misc_feature (278)..(278): n is a, c, t, g, unknown, or other
  misc_feature (387)..(387): n is a, c, t, g, unknown, or other
  misc_feature (391)..(391): n is a, c, t, g, unknown, or other
  misc_feature (405)..(405): n is a, c, t, g, unknown, or other
tggagctccccgcggtggcggccgctctagaactagtggatcccccgggctgcaggaattcgcacgagaccattacctagaacatcctaatcaaaaaggtagctttcgctgccgtcctacggcaggtgcccaagtcttcttcgggcccttcaacgacgacgagcactaccagtttgttgaagatggaaaataaagagttgttcaagatgggaagtgcagatacagatactgctgcactgcacaaggagntgggatgatgttctctgtccgatatgcantggaccatccgcacaatgctgtccttctgttgtgcagctcccatggacaaggatgccgattcctatatatgtgatacaagctataggcattcaaattgcctagataggntcangaaaatgaaagtgnattgatgaggacagtccttcaaaggccagctcggcatggcctaaggggtacaggaaaaccaaaagggtgtccaaaaattccgtttttggccccctaaagagagggccccggtaacaattaaaatttttggtcccccagggaaattcccatcttaaaggtgccccccaagaacgggtggccattttgggaaaacgggaaaaaatctctcggtgagggccccttttttttttgaaaaccccgggggggggaacagggtctcttgggaaaaggaggtg

SEQ ID NO: 13622 - DNA, 735 bp, Zea mays
  misc_feature: Ceres CLONE 1374394-F
  misc_feature: Encodes the peptide sequence at SEQ ID NO. 13623
  misc_feature (577)..(577): n is a, c, t, g, unknown, or other
  misc_feature (689)..(689): n is a, c, t, g, unknown, or other
  misc_feature (701)..(701): n is a, c, t, g, unknown, or other
  misc_feature (713)..(713): n is a, c, t, g, unknown, or other
aagctggagctccccgcggtggcggccgctctagaactagtggatcccccgggctgcaggaattcgcacgagaccattacctagaacatcctaatcgaaaaagatcagaccacactcgtagagagaaggaaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcgggaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccangtcgtcaaggggcatggacgtcgtcaaggccatcgagaaggtgggcacccgcaacggtccaccctcaaggggtggccaaggtcgctgactgcggacgctctctagactcctnggaaatcggggnctgttcgggcgncctccctccgtcatcgcgatcc

SEQ ID NO: 13623 - protein, 172 aa, Zea mays
  misc_feature: Ceres CLONE 1374394-F
  misc_feature (5)..(162): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
  misc_feature (138)..(138): Xaa is any aa, unknown, or other
MANPRVFFDMTVGGAPAGRIVMELYANEVPKTAENFRALCTGEKGVGKSGKPLHYKGSTFHRVIPEFMCQGGDFTRGNGTGGESIYGEKFPDEKFVRKHTAPGVLSMANAGPNTNGSQFFICTVATPWLDGKHVVFGXVVKGHGRRQGHREGGHPQRSTLKGWPRSLTADAL

SEQ ID NO: 13624 - DNA, 655 bp, Zea mays
  misc_feature: Ceres CLONE 1374401-F
  misc_feature: Encodes the peptide sequence at SEQ ID NO. 13625
ggagctccccgcggtggcggccgctctagaactagtggatcccccgggctgcaggaattcgcacgagaccattacctagaacatcctaatcgaaaaatatctcctcaaggcacgttcaccacagtcctctctttccccggcaccaccaccacccaggctaaccggactggaccgagtgttgaacaacactgagggcgaggcagatagagcgacggcaggcatggtgagccgtgaaaatttgcacctggtgctggacccggcgtctctgggcgcgccgtgggccgacccgtccgccgcagagatcccgccgcagctcctcgccgcgctgggagagtacctctcctccacccgcgccgaggccgggacgtcccacggagcggacgacaagtcttgatgaccagttcaggtgcgcgtgccccccgcccgaaccccactggcggggggccctaccgccccggggaggccccgggggggggacccccccgcggggctaaagggggaggcgggcccgaattcccgggccccccgggggggtggcccccggtccccccgggggaccctctccccccccgggaaggaaacttaaagggggggggtccccccgaggggtttagagaaaaacccttttggagggggagggggttctcccccccca

SEQ ID NO: 13625 - protein, 57 aa, Zea mays
  misc_feature: Ceres CLONE 1374401-F
MVSRENLHLVLDPASLGAPWADPSAAEIPPQLLAALGEYLSSTRAEAGTSHGADDKS

SEQ ID NO: 13626 - DNA, 644 bp, Zea mays
  misc_feature: Ceres CLONE 1374416-F
  misc_feature: Encodes the peptide sequence at SEQ ID NO. 13627
  misc_feature (447)..(447): n is a, c, t, g, unknown, or other
  misc_feature (578)..(578): n is a, c, t, g, unknown, or other
  misc_feature (607)..(607): n is a, c, t, g, unknown, or other
  misc_feature (608)..(608): n is a, c, t, g, unknown, or other
  misc_feature (616)..(616): n is a, c, t, g, unknown, or other
  misc_feature (637)..(637): n is a, c, t, g, unknown, or other
aagctggagctccccgcggtggcggccgctctagaactagtggatcccccgggctgcaggaattcgcacgagaccattacctagaacatcctaatcgaaaagaaccaagcagtaacattaatcacccactctactactcgaagttactaccagcagcttgcttcaacagtagaagagagcgagagtggggctctttcatcggtgatgaagaagccaggggaagcgccgctggattgggcaacgcgacttaggatcgccgtgggggcagcaagggggcttgcgtggctgcaccatgggttccaggttccgcagattcaccagaatttgagctcgagtgcagtgcttctcgacgaggattatgatgctcggatcacggatgttgggctcacaaggttggtccggatggcgcctggcgagggtggtgataccagtcctttcctgaacggngactttggggagtttggctatgttgctccagagtatgctagcaatccagttggtacgatgaaaggcgatgcgtatgcatttggggtgatattgtttgagcttgttagcgggcaggaggctgctgctgtggntactgacgtgacgggtgaaggattcaggnngacattgntggactggggtaacagctcanggcttcg

SEQ ID NO: 13627 - protein, 146 aa, Zea mays
  misc_feature: Ceres CLONE 1374416-F
  misc_feature: SWISSPROT Homolog: EC 2.7.11.1 Non-specific serine/threonine protein kinase
  misc_feature (125)..(125): Xaa is any aa, unknown, or other
  misc_feature (135)..(135): Xaa is any aa, unknown, or other
  misc_feature (138)..(138): Xaa is any aa, unknown, or other
  misc_feature (145)..(145): Xaa is any aa, unknown, or other
MKKPGEAPLDWATRLRIAVGAARGLAWLHHGFQVPQIHQNLSSSAVLLDEDYDARITDVGLTRLVRMAPGEGGDTSPFLNGDFGEFGYVAPEYASNPVGTMKGDAYAFGVILFELVSGQEAAAVXTDVTGEGFRXTLXDWGNSSXL

SEQ ID NO: 13628 - DNA, 696 bp, Zea mays
  misc_feature: Ceres CLONE 1374418-F
  misc_feature: Encodes the peptide sequence at SEQ ID NO. 13629
  misc_feature (17)..(17): n is a, c, t, g, unknown, or other
  misc_feature (21)..(21): n is a, c, t, g, unknown, or other
  misc_feature (22)..(22): n is a, c, t, g, unknown, or other
  misc_feature (30)..(30): n is a, c, t, g, unknown, or other
  misc_feature (403)..(403): n is a, c, t, g, unknown, or other
  misc_feature (404)..(404): n is a, c, t, g, unknown, or other
  misc_feature (483)..(483): n is a, c, t, g, unknown, or other
gaaggctccccgcggtngggnncgctctanaaaattggagctccccgcggtggcggccgctctagaactagtggatcccccgggctgcaggaattcgcacgagaccattacctagaacatcctaatcaaaaaaaaaaagtcttcacttccattccaccggctccgatcccaactggcatggcgctctccatctacacgcccacctcctcctccctcgtcccgccctccattcaggaggtcaggctgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtggccgacaccgtcnntgtcgatgatttcgagaaggtcgcacccacgacgggcacagggagctcgtcgctgctgcttgggatcactgggctccangaaactaaggtcaagagtggcatagatactgcactggcaaatggggagggcacccacctggaaaaagctgaggacgggatgtcctggtacctcaccaagctctttgaaaaggttggggctgaacctgggtcacaagggccctggggaaagttccaccggaaaaaaggccccggtaactttaagaaaccccggggataatcccccgggggacta

SEQ ID NO: 13629 - protein, 167 aa, Zea mays
  misc_feature: Ceres CLONE 1374418-F
  misc_feature (76)..(76): Xaa is any aa, unknown, or other
  misc_feature (102)..(102): Xaa is any aa, unknown, or other
MALSIYTPTSSSLVPPSIQEVRLTSRPPKPATFSLRRPHLAARAAAGNAPTSPVREVVTELDAVAGFSEIVADTVXVDDFEKVAPTTGTGSSSLLLGITGLXETKVKSGIDTALANGEGTHLEKAEDGMSWYLTKLFEKVGAEPGSQGPWGKFHRKKGPGNFKKPRG

SEQ ID NO: 13630 - DNA, 734 bp, Zea mays
  misc_feature: Ceres CLONE 1374431-F
  misc_feature: Encodes the peptide sequence at SEQ ID NO. 13631
aagctggagctccccgcggtggcggccgctctagaactagtggatcccccgggctgcaggaattcgcacgagaccattacctagaacatcctaatcgaaaaatcactcatattattaagaccaactagcaacatagaaagcacaatagtgtaccaacaatggcaaccaaaatattttgcttccttatgctccttggtctttctgcaagtgctgctaccgcgaccattttcccgcaatgctcacaagctcctatagcttcccttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcagggcacaacaactacaacaacttgtgctagcaaaccttgctgcctactctcagcaacagccgtttcttccattcaaccaactggctgcattgaactctgctgcttatttgcaacaacaactaccattcagccaactagctgttgtctacccccagcaatttcttccattcaaccaactagcaacattgaactctgctgcttatttacaacagcaacagctaccaccattcaaccagctagctgatgtgagccctgctgccttcttgacacagcaatagttgttgtcgttctac

SEQ ID NO: 13631 - protein, 186 aa, Zea mays
  misc_feature: Ceres CLONE 1374431-F
  misc_feature (1)..(187): Pfam Name: Zein Pfam Description: Zein seed storage protein
MATKIFCFLMLLGLSASAATATIFPQCSQAPIASLLPPYLSPAVSSVCENPILQPYRIQQAIAAGILPLSPLFLQQPSALLQQLPLVHLLAQNIRAQQLQQLVLANLAAYSQQQPFLPFNQLAALNSAAYLQQQLPFSQLAVVYPQQFLPFNQLATLNSAAYLQQQQLPPFNQLADVSPAAFLTQQ

SEQ ID NO: 13632 - DNA, 739 bp, Zea mays
  misc_feature: Ceres CLONE 1374436-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (118)..(118): n is a, c, t, g, unknown, or other
  misc_feature (119)..(119): n is a, c, t, g, unknown, or other
  misc_feature (137)..(137): n is a, c, t, g, unknown, or other
  misc_feature (309)..(309): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaannccaagctggggctcaccncggtggcggccgctctagaatagtggatcccccgggctgcaggattcgcacgagacattacctagaacatcctaatcgaaaaaaaacccccctgccccagacgtcgcgcgcatgaaatgaaaccctagtgagtagtgaccctgtccggatcactgcgttggcgcgccatggnaccctccgctttggcctccctccgggggccgttccggtcactggggttcagaaagaaacagggggggttaatggtccccggttcgggggttggggttattttaaggtttttcgcttttgggggggggcttttttccgggccccccggtaaagggttttggtccccccggtttttccccccctttttttttttttggggggggggggggtttttttctccaaaagaaaagggttttttagggggttttggaaaaagggtgtttttctccccaaaaggggggccccccccctcgggggggggggtttttggggaaaaaatcttcccccccccccccctaattaaaaaaaaccccccgcttttttttccccccccccttctcccgcggggggtcttttttttcgtgtgtggaaaaaaaaaagggggggggggc

SEQ ID NO: 13633 - DNA, 673 bp, Zea mays
  misc_feature: Ceres CLONE 1374437-F
  misc_feature: Encodes the peptide sequence at SEQ ID NO. 13634
  misc_feature (541)..(541): n is a, c, t, g, unknown, or other
  misc_feature (548)..(548): n is a, c, t, g, unknown, or other
tccccgcggtggcggccgctctagaactagtggatcccccgggctgcaggaattcgcacgagaccattacctagaacatcctaatcgaaaaaaggatccaccacaacagcgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagggtccgcgagtacgatgggcggcacggcggccgggactacgctgtgcccagcctgttctcagatatttttccgtgatccgcttagtgcgccgcacagcattggccgcctgctggacccttgtggacgacttggcggggggcggcgcccaggtccggcgggggggcccggggctgnaacgcgnagggaggacgaggggggggctggcccctggaggggggacatggccgggcctgggggaagggagcacgggcgggggggggggcggaagcaagaaaaagcctggggaccaaagggggaggggcgaag

SEQ ID NO: 13634 - protein, 87 aa, Zea mays
  misc_feature: Ceres CLONE 1374437-F
MASIVASRRAVPLVRALEKLIAASSAPGTGSALRPVAVAGGLRGYNTGAPLRRYEGAESEDDRVREYDGRHGGRDYAVPSLFSDIFP

SEQ ID NO: 13635 - DNA, 666 bp, Zea mays
  misc_feature: Ceres CLONE 1374438-F
  misc_feature: Encodes the peptide sequence at SEQ ID NO. 13636
  misc_feature (151)..(151): n is a, c, t, g, unknown, or other
  misc_feature (485)..(485): n is a, c, t, g, unknown, or other
  misc_feature (493)..(493): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
ccccgcggtggcggccgctctagaactagtggtcccccgggctgcaggaattcgcacgagaccattacctagaacatcctaatcgaaaagagaactccatttcgatctcatttgaaatcaacccatcctcgtttcctccgtctagcagccntctcaccctcatggccaagatcaagatcgggatcaatgggtttggcaggatcggaaggctggtggcaggtggcctgcagagcgacgacgtcgagctcgtcgcgtgacgacccttcatcagacgatacatgacctacatggttcagtatgaccccccttgggggggccccgcggggaaaaaaacaaggggggggggggggggaaaaaaagggcccccccccccctttggggagggggtcccaaagggggttggggaaaaagggagaaattttccccccaaaagaaaaacccccccccttttttttcccccccccctttttttggggggggggggngggggggnggggnnnnnaaaaaaaaaaaagagggggggggggggggggggggtggttttttggggggcccccccctctttgggggggggggggggggttgttttttttttttgtgttgtggtggcctcttttggctggcgccccccccgggggaaaaaaaaaaaaaacaaccccacccccc

SEQ ID NO: 13636 - protein, 31 aa, Zea mays
  misc_feature: Ceres CLONE 1374438-F
  misc_feature (1)..(31): SWISSPROT Homolog: EC 1.2.1.12 Glyceraldehyde-3-phosphate dehydrogenase (phosphorylating)
  misc_feature (4)..(30): SWISSPROT Homolog: EC 1.2.1.59 Glyceraldehyde-3-phosphate dehydrogenase (NAD(P)(+)) (phosphorylating)
MAKIKIGINGFGRIGRLVAGGLQSDDVELVA

SEQ ID NO: 13637 - DNA, 647 bp, Zea mays
  misc_feature: Ceres CLONE 1374442-F
  misc_feature: Translation starting site: 289
  misc_feature: SWISSPROT Homolog: EC 2.1.1.41 Sterol 24-C-methyltransferase
  misc_feature (413)..(413): n is a, c, t, g, unknown, or other
  misc_feature (573)..(573): n is a, c, t, g, unknown, or other
  misc_feature (599)..(599): n is a, c, t, g, unknown, or other
tggagctccccgcggtggcggccgctctagaactagtggatcccccgggctgcaggaattcgcacgagaccattacctagaacatcctaatcgaaaaagattaccaccacctccacctcgtcgtctcccaccaccgccgagcgcgagccctagcccgatctagccggcggcaggcaccagatcccgccgcccgcggcgtcccgggacgcgccccgccgaatccgccgctcctcgcactgcaacacgcccggaccacggtgcatttgatccgtcccggccgcctacacgatgtccaagtcgggagcgctggatcttgcttctggcctcggagggaagatcaacaaggtggaagtcaagtcggccgtcgatgagtatgagaaatatcatggatactatggagggaaggaggaagncaggaaagtccactatactgatatggttaataaatactatgatcttgccactagcttctatgagtatggggtggggtgaatcccttcactttgctcacagatggaatggagaatcctttacgtgaaagcatcaagcgacatgagcattttcttggcctgncacttggtttgaaaccaggaatgaangttttagatgggggctgtggaataggggaacactggaaaaaattgcaa

SEQ ID NO: 13638 - DNA, 689 bp, Zea mays
  misc_feature: Ceres CLONE 1374451-F
  misc_feature: Translation starting site: 181
tccccgcggtggcggccgctctagaactagtggatcccccgggctgcaggaattcgcacgagaccattacctagaacatcctaatcgaaaaactatcctaccaggcaccactcgcatcgtgtgctcagtcagatccccgtcccgcatttcctaaggccaggttagttggcattgaagacgatgactgcttctgcagctgctgggtgtgcagatggtggctgcacgcccttgcatttcggcctcgccaggaattcttaccgcacgggtagcagtttctaggactgattgcatgctcagtaccactgctacattccccaaatcagctgctcctgggctctaaggtttaagcgcaatgatggttgtgggaggaggatatccgaagagtgtggccccgcaggggctttcctttgatctcagagggaaaagggcaatcatttgctggaggttcgtgaatgataaggggctagggaagggccaatttccaagggccttggcttggggctgggggttgaaattttttggggggaaccggggggggccccccttaaaaatttttggaaaaagtctgggggggggggaaaagttttgggaaccccggagcgggcccaaggggccttctttaggggtaatgttggagggcgtcccgcccctgggggggcgcccggccgccccggcggggagggggcccg

SEQ ID NO: 13639 - DNA, 734 bp, Zea mays
  misc_feature: Ceres CLONE 1374462-F
  misc_feature: Translation starting site: 573
  misc_feature: SWISSPROT Homolog: EC 1.10.2.2 Ubiquinol--cytochrome-c reductase
  misc_feature (670)..(670): n is a, c, t, g, unknown, or other
aagctggagctccccgcggtggcggccgctctagaactagtggatcccccgggctgcaggaattcgcacgagaccattacctagaacatcctaatcgaaaaatatacctcctcaaggaacgctcatcacagtactctctttccccgagacgaccaccaccacccaggataacaggactggatcgagtgataaacaactctgtgctgactgattccaggtatgccgagacgagtaaatttgcacctggtgctggacccagagtctctgatatcggcttgtctcgacccgtccgccgcatagatcccgacgcatttcctcggcgtgttgtcacatgacctcacctccggccgcgagaaagtctatacttaggaagaccaagacatcgtgatgcatgacttcacggcgaggtcgagcactcgcgaccataaccacgactgtgacggggtgcccttatgcggaccctagggagggcgcgtgcgattactacgccttgcgcgtggcctaggttgtctacgcctgtgttctcttcctgctacgcctgaaactcattgtcagcatgtccgcgagtaaagatgtccttgcacttgcatccctctaggacgagctcgtcagcatcgagccgtaaactaccgttacagtgcaagtggggtgcaaagtcactgctcattangagaataatagaagacgacatcaagctgctcaacagcgtggatcttgcatctctgaaggacccc

SEQ ID NO: 13640 - DNA, 645 bp, Zea mays
  misc_feature: Ceres CLONE 1374464-F
  misc_feature (557)..(557): n is a, c, t, g, unknown, or other
  misc_feature (558)..(558): n is a, c, t, g, unknown, or other
  misc_feature (624)..(624): n is a, c, t, g, unknown, or other
  misc_feature (625)..(625): n is a, c, t, g, unknown, or other
aaagctggagctccccgcggtggcggccgctctagaactagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcaaccctgccgcgtccgtattatgcacgccaggtcctggacgcgccctccctgcaggacgacttctatctcaacctcgtcgactggtcctcgcagaacgtgctcgctgtcggcctcggcacctgcgtctacctctggtccgcgtccaatagcaaggtcaccaagctctgcgatttgnngcctagggacagcgtatgcgcagtgcattggtcacgggaaggctcttatctttccattggcaccgnncctggagatgtcagattggg

SEQ ID NO: 13641 - DNA, 671 bp, Zea mays
  misc_feature: Ceres CLONE 1374467-F
  misc_feature: Translation starting site: 213
  misc_feature (150)..(150): n is a, c, t, g, unknown, or other
  misc_feature (363)..(363): n is a, c, t, g, unknown, or other
  misc_feature (383)..(383): n is a, c, t, g, unknown, or other
  misc_feature (384)..(384): n is a, c, t, g, unknown, or other
  misc_feature (387)..(387): n is a, c, t, g, unknown, or other
  misc_feature (391)..(391): n is a, c, t, g, unknown, or other
  misc_feature (392)..(392): n is a, c, t, g, unknown, or other
  misc_feature (395)..(395): n is a, c, t, g, unknown, or other
tccccgcggtggcggccgctctagaactagtggatcccccgggctgcaggaattcgcacgagaccattacctagaacatcctaatcgaaaaatggtcacgctagctgtagctttttgcagagcgtcgtctgtaaatacgtagcccttcancaagcgaggcaaggggggagagagtatcgtcagctagcagagagagtgcgtagcaactagcaatggcggagaaccctgctccgagttccccgctagtgacttctcccgacgccgctgcgccgcctctgccagcggagttcaccaagctcaccttccgtagcctgtacatccgtcggacaggtccaggcagccgggagatgactgtgcgacggnaggccgtctgaccagcttgnnacnacgnntcntgagcgactttcccatatacgatggccgtggctccggcgcccacctcgtcgctcgcttgcagggagtcactgtccaaatcggcagctcgcaccagctagtcagcatcgtcttcgagggcgagggggttaggggctccacgctgctccccaacggagggataacggatgggtcagacgagggggccatctacggggggcaccgggttgttcgccatgggcccccggggtcataccaaaaacgggttcttcgccgggggccgcaaccacaaacggggg

SEQ ID NO: 13642 - DNA, 637 bp, Zea mays
  misc_feature: Ceres CLONE 1374473-F
  misc_feature: Encodes the peptide sequence at SEQ ID NO. 13643
aagctggagctccccgcggtggcggccgctctattctagtggatcccccgggctgcaggaattcgcacgagaccattacctagaacatcctaatcgaaaagctgtttcgctgtctttcgttaacgtcctttaccacatctgaatctcatccatccactgccggggctcccggcaaaggatgactccggggatgggggtgaagcggtctgagggtgctgcggagggggttccactgctggcactagcaacgcagctcggctctgtgtctgtgccgaccgtgcggtaagcgtggcgggccgcctcgatgtatgtcgatgtctctgtctcgctcgctagggtcccggagacggaggcagcgccgggggagatcgctaggggcggaggggtgtgcctggaggaggtcgacgtcaggcggtggatctacgtggacgacgccgccggcgccgcggtcaaggtcaagggaagggcgtccgtcggcgcctccttcaaggacggcccgctccagtgcccgctgccgcccgtcgaggaaataatgtcctttataagatcatatgatgtgcccgaagggtttcaagatagcgtcacatcttcatatgttccatacatgacatggagagcattgaagcatttctttggg

SEQ ID NO: 13643 - protein, 111 aa, Zea mays
  misc_feature: Ceres CLONE 1374473-F
MYVDVSVSLARVPETEAAPGEIARGGGVCLEEVDVRRWIYVDDAAGAAVKVKGRASVGASFKDGPLQCPLPPVEEIMSFIRSYDVPEGFQDSVTSSYVPYMTWRALKHFFG

SEQ ID NO: 13644 - DNA, 766 bp, Zea mays
  misc_feature: Ceres CLONE 1374473-R
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (52)..(52): n is a, c, t, g, unknown, or other
  misc_feature (55)..(55): n is a, c, t, g, unknown, or other
tttttgtttttcctcccgccgccccaaattaaacagnnnnnnnnnnnnnggnggnccctcaaattgggtaccgggccccccctcgaggtcgacggtatcgataagcttttttttttttttttttagcatacaaacaggccctgagcaatataaaaattaatgtgcatacaaacacagctattctttttttatacgaaaactagcatgtacagcccctcagattagggaaatgagaaccacgataccgcaaggttagcagagaaagtgttgtcagatagtcaaaataaatcagcagacgaccccagtccggtcacactaggaacgatagcccatctccattatataatactccaatgaatatacaaaaaaaaagtttgttagctggtcttccgcaactagtttagagccccttcaccggtccttcagacagagcccccctccccagcatgtttatcatgatggctgttgtaatccccaccccccaggttcaagtactgttccttctgggctcatgacgaagttggagcattttcatgtacttgaactgattgttgactaaagttagtttcgctaactcacataggggctggactccaaatgtatggaaaaaaaactcatcatcctccatcctgaaaaaaaacacaaaaaggccttggaatatttggtgggcggctacctcccacaccaatctttggccccggcccctgcggtttgaaaaaaagtgaatttccaaaaaatggatcccccacccccctggtctccccct

SEQ ID NO: 13645 - DNA, 681 bp, Zea mays
  misc_feature: Ceres CLONE 1374480-F
  misc_feature (323)..(323): n is a, c, t, g, unknown, or other
  misc_feature (532)..(532): n is a, c, t, g, unknown, or other
tccccgcggtggcggccgctctagaactagtggatcccccgggctgcaggaattcgcacgagaccattacctagaacatcctaatcgaaaacacctctcccacccaacaacaaaacaagcctaatggcttcctctccatctcacgccactgcgttgcctacttgccctagaaccctcgccgccgcccctctttaggattcccatgtccctggtcgccccctgacacgcccgccccggatcctgcaccggaattccgcgtggaattccgggccgaaccgcctctctgcgtgcgcctccgaccaccaaactctctcacacgcgcngcgcgcgcacgtctgaggcggttggattctcccggtgggggtccctttggtctcgatttgctgctggatggggggtgccaaagcagcgctggacgccgggaggaagaggccgcgctccaaggccggcgtcgccaaggcacgggccccgggcaagtggcgcaccatcctcccgggactcgggactttcagcgcgctcctgcgctccgggntccaatgttgacctccaaggacaatgggcgcaacttgaccggcccccggagggggggttacggggtctagagagaaggcaggggatgggcgtgaaaaaagggcaggcggcgggggtgcctaagcttactggtggggccagggggtgggg

SEQ ID NO: 13646 - DNA, 611 bp, Zea mays
  misc_feature: Ceres CLONE 1374484-F
  misc_feature: Translation starting site: 186
  misc_feature (223)..(223): n is a, c, t, g, unknown, or other
  misc_feature (229)..(229): n is a, c, t, g, unknown, or other
  misc_feature (232)..(232): n is a, c, t, g, unknown, or other
  misc_feature (238)..(238): n is a, c, t, g, unknown, or other
aaagctggagctccccgcggtggcggccgctctagaactagtggatcccccgggctgcaggaattcgcacgagaccattacctagaacatcctaatcgaaaaatcacttatcatccccatccgcacctctctccatctccctgctcctccgccttcttcttgatccagccaagccagggatcgccatgtcggactcggaggagcaccacttcgaatcgaaagncgacgncgnagcgtncaagacctacccgcagcaggctggcaccgtcccgtagaaacgcttcatcgtcatcaagaccggcccctgcaaggtgtggagggttctacctccaagactgggaaacatggtcatggccaatggcactttgttgccctagatatatttcacggggaaaaagctccaagataatggttcctcctcacaccactgggatattccccatgggggacccgactgaggatcccctggattggtaaatcgaagatggggttgtggagcctcttaactctcgaggggacaccaaaggatgggccttaaatccccactggggaagaccctcgtgggcccaatacaaggaagggttttgaaaagggaaaggacccccccgcac

SEQ ID NO: 13647 - DNA, 677 bp, Zea mays
  misc_feature: Ceres CLONE 1374492-F
  misc_feature: Translation starting site: 213
  misc_feature (391)..(391): n is a, c, t, g, unknown, or other
  misc_feature (392)..(392): n is a, c, t, g, unknown, or other
  misc_feature (401)..(401): n is a, c, t, g, unknown, or other
  misc_feature (407)..(407): n is a, c, t, g, unknown, or other
  misc_feature (444)..(444): n is a, c, t, g, unknown, or other
  misc_feature (555)..(555): n is a, c, t, g, unknown, or other
tggagctccccgcggtggcggccgctctagaactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagacccattgggggagggtgatgatgctttcaacaccttcttcagtgaggactggtgctgnnaagcacggnccccgnggctggtttttgttgaccttgaacccactgtcatcgnatgagggtgaggactggcacctaccgccagctcttccaccctgagcagctcatcagtgggaaaggaggatgcagccaacaacttttgcccgtggtcactacaccattggcnaaggagattgttgacctatgcctttgatcggatcaggaaagttgccgaccactgcactggtctccagggcttctcgtctttcaggttgttgggggaggaccggctctgggcttggtccctct

SEQ ID NO: 13648 - DNA, 540 bp, Zea mays
  misc_feature: Ceres CLONE 1374509-F
  misc_feature: Encodes the peptide sequence at SEQ ID NO. 13649
  misc_feature (85)..(85): n is a, c, t, g, unknown, or other
  misc_feature (272)..(272): n is a, c, t, g, unknown, or other
  misc_feature (366)..(366): n is a, c, t, g, unknown, or other
  misc_feature (452)..(452): n is a, c, t, g, unknown, or other
  misc_feature (469)..(469): n is a, c, t, g, unknown, or other
  misc_feature (471)..(471): n is a, c, t, g, unknown, or other
  misc_feature (472)..(472): n is a, c, t, g, unknown, or other
tccccgcggtggcggccgctctagaatagtggatcccccgggctgcaggaattcgcacgagaccattacctagaacatcctaatncgaaaagaattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtggggtgccnggaattgctatcggtggcgcggtcggcggagccgtcggtaaccttcgtccctaaacccctaaacactaggcttgcagcatcaatccggtccgtngcgaagccgcttcacccggtcgtgtttttttttttggtggaaagaggatagtgtgcgatttcaggaatcttctcgagctagctagnagctacatccctggttngnngtggtagctagcggcagatgtaataactaggtggcttttggtaagaggtactaggggctagggaccac

SEQ ID NO: 13649 - protein, 61 aa, Zea mays
  misc_feature: Ceres CLONE 1374509-F
  misc_feature (14)..(14): Xaa is any aa, unknown, or other
MARSDSCLARVGCXELLSVARSAEPSVTFVPKPLNTRLAASIRSVAKPLHPVVFFFLVERG

SEQ ID NO: 13650 - DNA, 670 bp, Zea mays
  misc_feature: Ceres CLONE 1374509-R
cgaattgggtaccgggccccccctcgaggtcgacggtatcgataagcttttttttttttttttttgcagatgaacgttgattctatttccatccacaccaaaactaggacataacttgattgttcttttccaaccctgagctattagctgttacatgaaacaggcattgaatagttttcactgaagcccatcgacaaaggtgtgttcagacttcagaaaaaaaaaagggaaacaaactagtaggattttccacagtgaatcaagctcccagcccccaagaaaagcccaaaaatcgcagcgctgccaacggtggtttgcccaatgtatctgatctttagcaatccagggatcttgtatctgaacgcctcaaaagttccatagcaagcacctgcagaggaaggaggaaaaacatgccaattagggggtgtttgaatgcagtggagataacagttagcggctaaaattagttggagacatccaaacaccctagctaatagttcagctattagctatttttagtaaattagttaatagttagctagctatttgttagttagctaattccactagcaaatttttagccaactaactattagtcctagtgcattcaaacacccccttagtaacttggtactcatgctatggcgtcagaaagaaggaaaaaatacca

SEQ ID NO: 13651 - DNA, 673 bp, Zea mays
  misc_feature: Ceres CLONE 1374517-F
  misc_feature: Encodes the peptide sequence at SEQ ID NO. 13652
  misc_feature (454)..(454): n is a, c, t, g, unknown, or other
  misc_feature (472)..(472): n is a, c, t, g, unknown, or other
tccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatcttttggtgcagtcattggtacaaaccatcagggcacagcagctgcagcaactcgtngctacctgtgatcaaccnagtagctctggcaaacctttctccctactctcagcaacaacaatttcttccattcaaccaactgtctacattggaccgtggctgcttatttgcagcaacaactattaccattcagccagctagctactgcctactctcagcaacaacaacttcttcattttaaccaattggccgactggaacccccgctgcttatttgcag

SEQ ID NO: 13652 - protein, 101 aa, Zea mays
  misc_feature: Ceres CLONE 1374517-F
  misc_feature (99)..(99): Xaa is any aa, unknown, or other
MATKIFSLLMLLALSACVANATIFPQCSQAPIASLLPPYLPSMIASVCENPALQPYRLQQAIAASNIPLSPLFQQSPALSFGAVIGTNHQGTAAAATRXYL

SEQ ID NO: 13653 - DNA, 604 bp, Zea mays
  misc_feature: Ceres CLONE 1374523-F
  misc_feature (239)..(239): n is a, c, t, g, unknown, or other
  misc_feature (318)..(318): n is a, c, t, g, unknown, or other
tccccgcggtggcggccgctctagaactagtggatcccccgggctgcaggaattcgcacgagaccattacctagaacatcctaatcgaaaaggtgcggaggaaccagtctaagccaccacccaggcccagctcacctctttcctctcttctcatgcccacgcgctcgcctatctcatagtccttccccattccgcctctctagctggcctgtcgaggaccctcgccatcctccccaggngcaccacccaacggtcccaacccccagcggcggcgctaggatttgagtctcagggcgccgggaccgccaccgccaccgncggtgatggcagggcaggagcgtaagacaatccgatctggaggagggatggccgtttatgcaaaaggttttcccaagggtgaagaaattcctcgagggcagcccgaccctcattcagtccgggggactacttgaggtcctacccaccaattaaaattggggccccaaaacccccccccaaaaaacccgaaaaattttaacaaaaaaatcggggggccttccaaggaaaataccccccccggggaaacccctcccttagggggaaaaattgtgggttttttgtgggg

SEQ ID NO: 13654 - DNA, 675 bp, Zea mays
  misc_feature: Ceres CLONE 1374527-F
  misc_feature: Encodes the peptide sequence at SEQ ID NO. 13655
  misc_feature (374)..(374): n is a, c, t, g, unknown, or other
  misc_feature (437)..(437): n is a, c, t, g, unknown, or other
  misc_feature (438)..(438): n is a, c, t, g, unknown, or other
  misc_feature (443)..(443): n is a, c, t, g, unknown, or other
  misc_feature (468)..(468): n is a, c, t, g, unknown, or other
  misc_feature (516)..(516): n is a, c, t, g, unknown, or other
  misc_feature (585)..(585): n is a, c, t, g, unknown, or other
tccccgcggtggcggccgctctagaactagtggatcccccgggctgcaggaattcgcacgagaccattacctagaacatcctaatcgaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatgaccacggactacatgacctacatgttcaagtacgacaccgtccacggccactggaagcacagcgacatcacactcaaggactccaagacccnttctcttcggtgacaagccggtcaccgtctttggcatcaggaaccctgaggaaatcccgtggnngtganggctggcgctgagtatgtcgtgagntccaccggcgtcttcactgacaaggacaaggctgctgcacatccttcnagggggtgccccaaggaaggttgttatctctgccccaagcaagatgcaccccatggttttgtttgtttntggccaaatgaggacagtacccccctcggattgttaacattggtttccaatgctagctgcaccacaaactgccttgctcccccttgctaa

SEQ ID NO: 13655 - protein, 72 aa, Zea mays
  misc_feature: Ceres CLONE 1374527-F
  misc_feature (4)..(70): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (69)..(69): Xaa is any aa, unknown, or other
MGKIKIGINGFGRIGRLVARVALQSEDVELVAVNDPFMTTDYMTYMFKYDTVHGHWKHSDITLKDSKTXSLR

SEQ ID NO: 13656 - DNA, 660 bp, Zea mays
  misc_feature: Ceres CLONE 1374529-F
  misc_feature: Encodes the peptide sequence at SEQ ID NO. 13657
  misc_feature (11)..(11): n is a, c, t, g, unknown, or other
  misc_feature (47)..(47): n is a, c, t, g, unknown, or other
  misc_feature (487)..(487): n is a, c, t, g, unknown, or other
gaaggaattcngacgagaccattacctaaaacatcctaatcgaaaantccgctgccctcctcgcctccctcgattcaggattcagcgaattcggacagaacccggcgtgtccgagaagaccgacccctccccctgcgagtctgcgacgagtctcctgccgctcttcccggccgggcgaaatggacggtgtcgttgtcaggagggtcattccttcggataacagttgcctcttcaacgctgtgggctacgtgatggagcacaaccgaaataaggcttctgagctcagagaggtcatagcagcaacagtcgctggtgatcctgagaaattcaatggaggtgtttctttgggaaacccaaatgaagcggaatggggcttggggtctttcggaccctgggaaagggggggggaggagggcagtggcggctcgtttatgtggcagatgggaagaccgaagggggggcgcaaaagctccggagggataggganattgtggggagcgagcggcgctgtgagtccgtcggtgggcgggggggggcgagcctcaacggggcggctggggggcggccggtcacttcaggggcggggggggggggacgcgggaggggcagcgcggacgagccgcgcccgcggtggtggggggggggcgcccgggtaccgac

SEQ ID NO: 13657 - protein, 160 aa, Zea mays
  misc_feature: Ceres CLONE 1374529-F
  misc_feature (103)..(103): Xaa is any aa, unknown, or other
MDGVVVRRVIPSDNSCLFNAVGYVMEHNRNKASELREVIAATVAGDPEKFNGGVSLGNPNEAEWGLGSFGPWERGGEEGSGGSFMWQMGRPKGGRKSSGGIGXLWGASGAVSPSVGGGGRASTGRLGGGRSLQGRGGGDAGGAARTSRARGGGGGAPGYR

SEQ ID NO: 13658 - DNA, 691 bp, Zea mays
  misc_feature: Ceres CLONE 1374535-F
  misc_feature: Encodes the peptide sequence at SEQ ID NO. 13659
  misc_feature (252)..(252): n is a, c, t, g, unknown, or other
  misc_feature (348)..(348): n is a, c, t, g, unknown, or other
  misc_feature (388)..(388): n is a, c, t, g, unknown, or other
  misc_feature (488)..(488): n is a, c, t, g, unknown, or other
cgcggtggcggccgctctagaactagtggatcccccgggctgcaggaattcgcacgagaccattacctagaacatcctaatcgaaaaattgattgatcggacggacgcgcgtctccggtcccgtccgtaataacactgatccgatccacgccggccggcgatggagctcatcaagtccagggcgaccgtgtgcgcgctcctcctggcgctgctcctgctctcacactacgacggcgggacgacgacgacgantggtggcggagggcccggggtgtgcatgggcaagagccagcaccactcgttcccctgcatctccgaccgcctctgcagcaacgagtgcgtcaaggnaggaaacggcgggtgggagcggcccggctactgccacctnccgctactgcagggtgcccaggaaggcggtgctaaggcaaagctcttgaaacaaccctttggcttggcagaaactgaaaactgtggggtaagtactaagnaaacacctttgtgggtaggtgtggcacaacctacgtaccgtgcatggcatggtaaaggtgggggccattggaacggggaccggccataaattatttattaccattatcaacacggggtgtgaaaccttttgcatggtttctagcaaaaaaaaaaaaaaaaaaggttatccgatccgtccggacccctcgggggggggggcccg

SEQ ID NO: 13659 - protein, 138 aa, Zea mays
  misc_feature: Ceres CLONE 1374535-F
  misc_feature (31)..(31): Xaa is any aa, unknown, or other
  misc_feature (63)..(63): Xaa is any aa, unknown, or other
  misc_feature (110)..(110): Xaa is any aa, unknown, or other
MELIKSRATVCALLLALLLLSHYDGGTTTTXGGGGPGVCMGKSQHHSFPCISDRLCSNECVKXGNGGWERPGYCHLPLLQGAQEGGAKAKLLKQPFGLAETENCGVSTKXTPLWVGVAQPTYRAWHGKGGGHWNGDRP

SEQ ID NO: 13660 - DNA, 679 bp, Zea mays
  misc_feature: Ceres CLONE 1374537-F
  misc_feature (412)..(412): n is a, c, t, g, unknown, or other
  misc_feature (546)..(546): n is a, c, t, g, unknown, or other
  misc_feature (619)..(619): n is a, c, t, g, unknown, or other
  misc_feature (679)..(679): n is a, c, t, g, unknown, or other
tccccgcggtggcggccgctctagaactagtggatcccccgggctgcaggaattcgcacgagaccattacctagaacatcctaatcgaaaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagntgcgtcgagttcctgaggcaccagtgcagccccggcggcgacgccctacggctcgccacagtgccaggcgctgcagcagcagtgctgccaccagatcagggcagggtggagccgctgcaccggtacagcgacantaaacggtgtgggtccctgcagtcccttcctgcagcagcagccgcagggcgagcttcgcgcggctgatggcgnccccagtagcgcagcagttggacgggggaatgggcgggcctgcagctgcagcagccaggn

SEQ ID NO: 13661 - DNA, 856 bp, Zea mays
  misc_feature: Ceres CLONE 1374538-F
  misc_feature: Encodes the peptide sequence at SEQ ID NO. 13662
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (31)..(31): n is a, c, t, g, unknown, or other
  misc_feature (32)..(32): n is a, c, t, g, unknown, or other
  misc_feature (37)..(37): n is a, c, t, g, unknown, or other
  misc_feature (38)..(38): n is a, c, t, g, unknown, or other
  misc_feature (47)..(47): n is a, c, t, g, unknown, or other
  misc_feature (49)..(49): n is a, c, t, g, unknown, or other
naaaaaccccnnnnnccnnccataaccaaannaaccnngcccccccntncttccaaaactggagctccccgcggtggcggccgctctagaactagtggatcccccgggctgcaggaattcgcacgagaccattacctagaacatcctaatcgaaaaagatctcccaccggggaaccctacccgagcatcagccatggcgatcgcggcgcgcgtcctgcgccgcctcccgctccacctctacccctcgctcgctcgctctttctgcgcagtttccccggccgccgcctcggccgccccggcgtccgcctcggccgccccggcgtccgccaaggtcgccgatcgcatcgtgcgcgtcctcgccatccgatctcgagggggcgccgccgcgaggtcgtcggccctctccggggagaacactccctcccgcgcggttgggcaaaggcggaagcttcattgaagcccgggcctccccccccgctctccgaggataatccgagggcgggtgtccgcccggaagtggggagggggccaatttccgggccggcggggggggcgccccaaaaaaggtgtgcccgccccccggcccaaaagagaggtgagcggggtaagcggggctctcaagcggggggggggcccggggaagcaccccggggcgcccacaaacaggaacccccgctccacgggggcctccatgcgagaggtccccactcacccccggccgcaagcgccagctccggtcggggccggggcgcgcccaaaaccacgcgcccgcgccgcgcatccgccacacagcggcgcgggcctgcccgcacgccgcggcgcgcgccccgcccgccctccacgcgcagagaccccc

SEQ ID NO: 13662 - protein, 87 aa, Zea mays
  misc_feature: Ceres CLONE 1374538-F
MAIAARVLRRLPLHLYPSLARSFCAVSPAAASAAPASASAAPASAKVADRIVRVLAIRSRGGAAARSSALSGENTPSRAVGQRRKLH

SEQ ID NO: 13663 - DNA, 674 bp, Zea mays
  misc_feature: Ceres CLONE 1374541-F
  misc_feature: Encodes the peptide sequence at SEQ ID NO. 13664
  misc_feature (403)..(403): n is a, c, t, g, unknown, or other
  misc_feature (449)..(449): n is a, c, t, g, unknown, or other
  misc_feature (462)..(462): n is a, c, t, g, unknown, or other
  misc_feature (492)..(492): n is a, c, t, g, unknown, or other
  misc_feature (493)..(493): n is a, c, t, g, unknown, or other
tccccgcggtggcggccgctctagaactagtggatcccccgggctgcaggaattcgcacgagaccattacctagaacatcctaatcgaaaaccatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcaggcctgcctcgccgggaggaggctcaccgcgctggtgcaggagccggccataaccatgaggtaccacaagagcgcgctcctgtcgggccccatcgccgtcaacttcatctggtacggcgacttctcggcgccgcagncgggcggcgatcaccgacttcgtctcgtcgtggaaaggggggcggnccccggccgcggngcagccggaagccgccgggggccacggggnntcagagggcggcggagtacaaccccgtgtcccagggggcggtcccggggatgcagctcagctccagggggaacagcggtatgtggccccctcagtaggtacccggaggagaagcccggcggcctacctccaacgaggaggaaggcctgagatctagcctcgttcccggggggcacaggccc

SEQ ID NO: 13664 - protein, 145 aa, Zea mays
  misc_feature: Ceres CLONE 1374541-F
  misc_feature (67)..(67): Xaa is any aa, unknown, or other
  misc_feature (82)..(82): Xaa is any aa, unknown, or other
  misc_feature (97)..(97): Xaa is any aa, unknown, or other
MACYNTASLAATLLAFALTFQACLAGRRLTALVQEPAITMRYHKSALLSGPIAVNFIWYGDFSAPQXGGDHRLRLVVERGAXPGRGAAGSRRGPRGXRGRRSTTPCPRGRSRGCSSAPGGTAVCGPLSRYPEEKPGGLPPTRRKA

SEQ ID NO: 13665 - DNA, 845 bp, Zea mays
  misc_feature: Ceres CLONE 1374547-F
  misc_feature: Encodes the peptide sequence at SEQ ID NO. 13666
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (29)..(29): n is a, c, t, g, unknown, or other
  misc_feature (50)..(50): n is a, c, t, g, unknown, or other
  misc_feature (53)..(53): n is a, c, t, g, unknown, or other
nnnnnnnnnnnnnccccnnnnntccctanccactgcgcgagggcctcttnttntcaaagctggagctccccgcggtggcggccgctctagaactagtggatcccccgggctgcaggaattcgcacgagaccattacctagaacatcctaatcaaaaaacgcttcacactctctcggtggccagtggcctggtccgttcggctccgatttcccgattcgattccaaccatccctctcccggcgtcctgccgtcctgcgggagggaggtgcaagcggaaccagcccggcaatggcagctgcgcggcggccgggggcgaaacccaggggcggcggcggcgcggggaagaggagcgcgtggttgccggcggacggcagcaagcgctgggggggaggccttctccctgttctacacgtctcttctggctcacgggctggggtggggggtcccccgatcccattccaggtcctaacaaaagggttcacgcaggctggggggagccagagtcctgggggcttgggcgcccaccccccccccggggggcccgccaccgtggccgcctgacgttgttactgataagctcacgccaggaaggacggccgatgcggttgtactggcgtcgggggacggcggggtgctgatgaggccttcacttgacggggcggtccagtggggtccttgagcgcaacgcattaatgatagcacttctcgtcgaaggggatacgcgtgacccgccgtggaagggtgtagttgggggggcgagacccaaaggaggggttcgccggtcagacagactccgtgagtggggccgccggatatgcatccagagcacacaaccgcctcacacc

SEQ ID NO: 13666 - protein, 90 aa, Zea mays
  misc_feature: Ceres CLONE 1374547-F
MAAARRPGAKPRGGGGAGKRSAWLPADGSKRWGGGLLPVLHVSSGSRAGVGGPPIPFQVLTKGFTQAGGSQSPGGLGAHPPPGGPATVAA

SEQ ID NO: 13667 - DNA, 674 bp, Zea mays
  misc_feature: Ceres CLONE 1374549-F
  misc_feature: Pfam Name: OTCace_N Pfam Description: Aspartate/ornithine carbamoyltransferase, carbamoyl-P binding domain
  misc_feature: SWISSPROT Homolog: EC 2.1.3.3 Ornithine carbamoyltransferase
  misc_feature (240)..(240): n is a, c, t, g, unknown, or other
tacccgcggtggcggccgctctagaactagtggatcccccgggctgcaggaattcgcacgagaccattacctagaacatcctaatccaaaaaggccctagcaacaaatccgtatcccgagtccggcgacggcagtatccgagctcgcactcgcgcacccgtccatcgcatcgcatctgtcctcccatcccctcagcgccaccgcaccgcaatcacacgcgcgccacccgcgatgacgccnggcggcggcgatctccggctccagcagccacgtcgtcgtctcctccgcccgcctcaggcagccgttcacgctccctccgcgcaccgcttgcccaatcgccgccgccgcctcgcccgtgacccgccggggggtcgcggtcgccgccgtgtcgagccccgttgtgtccgccgccgcggggaaggatgccaaacaggctcctaaggatttccttcaaatcattgattttgacaaggatacaataaggaagattcttagtcgagccatcggaggttaaggaattgataaagtcctggaggaaaaagcttccaaccgttcaaagggaaaaccatgcgcaatgatttttggcaagccatcaaggaggaccccgcgttccatttgggcacggaattttcttctaactgggggggcatgctaatctagtcggcgccccgcac

SEQ ID NO: 13668 - DNA, 650 bp, Zea mays
  misc_feature: Ceres CLONE 1374551-F
  misc_feature: Encodes the peptide sequence at SEQ ID NO. 13669
  misc_feature (323)..(323): n is a, c, t, g, unknown, or other
  misc_feature (344)..(344): n is a, c, t, g, unknown, or other
tccccgcggtggcggccgctctagaactagtggatcccccgggctgcaggaattcgcacgagaccattacctagaacatcctaatcgaaaagttccgcaccccacggcaggcgcttgagagtacttgactactaccctcccacctgcgagactgcaacgccgttgcttcaactcgactccagcatccctcgtccccgcatcaccgcgccgccgacactccgctcgctttcgctcgcgagacccgtgcctgccgagcctgcgtcatggacgaggagtacgacgtgatcgttctgggcacggggctcaaggagtgcatcctcagncgtctcctctctgtcgacggnctccagggtctacacatggatagaaatggttactaccgaggagaatcccacttccttaaaccggaccagctctgggaaaagtttaggggggaaagaaaagccacccgtacattttgggggaaagaaagattacaatggtgaaatggggtcccaaaagttaggagggcaacgggggattttgtttccccccccccctccccccggggggggacaaaaattttgggcattcccaggggggggggggggaaacccttccctctcccccagggggggagttctcccggggccccccccgcccgctttttg

SEQ ID NO: 13669 - protein, 73 aa, Zea mays
  misc_feature: Ceres CLONE 1374551-F
  misc_feature (20)..(20): Xaa is any aa, unknown, or other
MDEEYDVIVLGTGLKECILXRLLSVDGLQGLHMDRNGYYRGESHFLKPDQLWEKFRGERKATRTFWGKERLQW

SEQ ID NO: 13670 - DNA, 671 bp, Zea mays
  misc_feature: Ceres CLONE 1374553-F
  misc_feature: Translation starting site: 249
  misc_feature (413)..(413): n is a, c, t, g, unknown, or other
  misc_feature (474)..(474): n is a, c, t, g, unknown, or other
  misc_feature (538)..(538): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
tccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatctctaattccccataccgtccaccggtcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccanaactggtggctgggaagcacgttccccgtgcaaatcttcgttgatctagaacccactgtgnatcgatgaggtgcgcactggcacgtaccgccagctcttccaccctgagcagctcatcagggggnaagggaggatgccgctaacaatttcgcccgtggcactacacaattggcaagggagatttgttgatctgtggctttgaccggatccgcaaggttgctgacaactgcaccggcctcgcggggnnnnnnnnnnnnn

SEQ ID NO: 13671 - DNA, 698 bp, Zea mays
  misc_feature: Ceres CLONE 1374558-F
  misc_feature: Encodes the peptide sequence at SEQ ID NO. 13672
ggagctccccgcggtggcggccgctctagaactagtggatcccccgggctgcaggaattcgcacgagaccattacctagaacatcctaatcgaaaaaaacgcaaaccccaatctcggcgtcaccgccccaaatctagcaaacggaaatcccatctcgccgccgccgcgatgtctcgccgctatgacagtcgcacgacgatcttctcgccggaggggcgtctctaccaggtggagtacgcgatggaggcgatcggcaacgccgggtcagccctcgggatcctggcggccgacggcgtagtcctggtcggcgagaagaaggtgacctccaagctcctccagacctcccgctccgccgagaagatgtacaagatcgactcccacctggcgtgcgctgtggcagggatcatgtccgacgccaacatcctcatcaacaccgcccgcctccacgcccagcgctacgcgctctcctaccaggagcccatccccgtcgagcagctcgtccagtccctctgcgacaccaagcagggttacacccagtttggtgggcctcgccccctttggggtctccttccaattcgccggttgggaaaggcaccacggtttccagctctacatgagcgacccatctggcactacgggggggttggaaagcccgccgctggtggggccacagccagggccgcgcagtcattgctcag

SEQ ID NO: 13672 - protein, 176 aa, Zea mays
  misc_feature: Ceres CLONE 1374558-F
  misc_feature (28)..(172): Pfam Name: Proteasome Pfam Description: Proteasome A-type and B-type
  misc_feature: SWISSPROT Homolog: EC 3.4.25.1 Proteasome endopeptidase complex
MSRRYDSRTTIFSPEGRLYQVEYAMEAIGNAGSALGILAADGVVLVGEKKVTSKLLQTSRSAEKMYKIDSHLACAVAGIMSDANILINTARLHAQRYALSYQEPIPVEQLVQSLCDTKQGYTQFGGPRPLWGLLPIRRLGKAPRFPALHERPIWHYGGVGKPAAGGATARAAQSLL

SEQ ID NO: 13673 - DNA, 740 bp, Zea mays
  misc_feature: Ceres CLONE 1374559-F
  misc_feature: Encodes the peptide sequence at SEQ ID NO. 13674
  misc_feature (610)..(610): n is a, c, t, g, unknown, or other
  misc_feature (653)..(653): n is a, c, t, g, unknown, or other
  misc_feature (690)..(690): n is a, c, t, g, unknown, or other
  misc_feature (699)..(699): n is a, c, t, g, unknown, or other
  misc_feature (728)..(728): n is a, c, t, g, unknown, or other
aagctggagctccccgcggtggcggccgctctagaactagtggatcccccgggctgcaggaattcgcacgagaccattacctagaacatcctaatcgaaaaatatcacggcggcggtggcggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaagttcagctttgcagggttagggtctgttcagtttgggcagaagggcatcccttatctgancacgtatgacggccgcaccatccgctaccctgaccccctcatncaggccacgacaccatcaagatcgatctgagaccaancagattggnacttcttccaagttgatggttgcacgtcntcatgtggactg

SEQ ID NO: 13674 - protein, 163 aa, Zea mays
  misc_feature: Ceres CLONE 1374559-F
  misc_feature (3)..(40): Pfam Name: RS4NT Pfam Description: RS4NT (NUC023) domain
  misc_feature (94)..(164): Pfam Name: Ribosomal_S4e Pfam Description: Ribosomal family S4e
  misc_feature (42)..(90): Pfam Name: S4 Pfam Description: S4 domain
  misc_feature (140)..(140): Xaa is any aa, unknown, or other
  misc_feature (154)..(154): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFSFAGLGSVQFGQKGIPYLXTYDGRTIRYPDPLXQATTPSRSI

SEQ ID NO: 13675 - DNA, 713 bp, Zea mays
  misc_feature: Ceres CLONE 1374562-F
  misc_feature: Encodes the peptide sequence at SEQ ID NO. 13676
  misc_feature (288)..(288): n is a, c, t, g, unknown, or other
  misc_feature (300)..(300): n is a, c, t, g, unknown, or other
  misc_feature (416)..(416): n is a, c, t, g, unknown, or other
tccccgcggtggcggccgctctagaactagtggatcccccgggctgcaggaattcgcacgagaccattacctagaacatcctaatcgaaaaacacggtccacacagcccaacaaaggagcgcggcggcccctccttccttcctcccacttctctcgcgcggcgctcgcttacctcgcctcgcattccgttcgagcaggggagcggcagtgagaagggagggaattaaggcaagatgttcatcgagagcttccgcgtcgagagcccccacgtgcggtacgccccgacgnagatcgagtcgnagtaccggtacgacacgacggagctggtgcacgagggcaaggacggcgcctcccgctgggtcgtcccgccccaagtgcgtcaagtacacttccggaccaggaaccgcggtcccaangcttcgggtcatgcttgtggggttggggaaggcaccacggggccacgctggacgggtgggggtcattgccacagggggaggggttctcctggggcgaccaagggcaaggggggaaaaaggccaataattacgggtcctttcaccaggcttcaccctcagagtaggcgctacacgggggaggagaaattatgggccggttcaagagccctcctacccatggtgaaccaaccaacccttgggggtgggggggggggggaaacacccacaatgaaacccgggaaattgcctgacccgggg

SEQ ID NO: 13676 - protein, 160 aa, Zea mays
  misc_feature: Ceres CLONE 1374562-F
  misc_feature: SWISSPROT Homolog: EC 5.5.1.4 Inositol-3-phosphate synthase
  misc_feature (19)..(19): Xaa is any aa, unknown, or other
  misc_feature (23)..(23): Xaa is any aa, unknown, or other
  misc_feature (61)..(61): Xaa is any aa, unknown, or other
MFIESFRVESPHVRYAPTXIESXYRYDTTELVHEGKDGASRWVVPPQVRQVHFRTRNRGPXASGHACGVGEGTTGPRWTGGGHCHRGRGSPGATKGKGGKRPIITGPFTRLHPQSRRYTGEEKLWAGSRALLPMVNQPTLGGGGGGETPTMKPGKLPDPG

SEQ ID NO: 13677 - DNA, 722 bp, Zea mays
  misc_feature: Ceres CLONE 1374565-F
  misc_feature: Encodes the peptide sequence at SEQ ID NO. 13678
  misc_feature (554)..(554): n is a, c, t, g, unknown, or other
ggagctccccgcggtggcggccgctctagaactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgcccgactgctagcagtgtgctagccaagccaagccaagcaggaaggcccccggcattgctagctgtacngtgtctgtgtgtgcatctgcagcagggtgcaggcaggggcccgtacgtacgtgtctctttctctctctcatcttggcaccgacctatctagggtgggtgtgttcggactaataaaaatgttcttggcgtcgccgtctgtgcatgcatggcccctggcctcctgcatgg

SEQ ID NO: 13678 - protein, 115 aa, Zea mays
  misc_feature: Ceres CLONE 1374565-F
  misc_feature (41)..(115): Pfam Name: Tryp_alpha_amyl Pfam Description: Protease inhibitor/seed storage/LTP family
MAATSSKSSSSSSSAQRAAAALLVAAAVAVSVLVVGAAAVCDMSNEQFMSCQPAAAKTTDPPAAPSQACCDALAGADLKCLCGYKNSPWMGVYNIDPKRAMELPAKCGLATPPDC

SEQ ID NO: 13679 - DNA, 751 bp, Zea mays
  misc_feature: Ceres CLONE 1374566-F
  misc_feature: Encodes the peptide sequence at SEQ ID NO. 13680
  misc_feature (402)..(402): n is a, c, t, g, unknown, or other
  misc_feature (403)..(403): n is a, c, t, g, unknown, or other
  misc_feature (405)..(405): n is a, c, t, g, unknown, or other
  misc_feature (419)..(419): n is a, c, t, g, unknown, or other
  misc_feature (491)..(491): n is a, c, t, g, unknown, or other
  misc_feature (521)..(521): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (576)..(576): n is a, c, t, g, unknown, or other
  misc_feature (595)..(595): n is a, c, t, g, unknown, or other
  misc_feature (636)..(636): n is a, c, t, g, unknown, or other
  misc_feature (695)..(695): n is a, c, t, g, unknown, or other
  misc_feature (744)..(744): n is a, c, t, g, unknown, or other
aagctggagctccccgcggtggcggccgctctagaactagtggatcccccgggctgcaggaattcgcacgagaccattacctagaacatcctaatcgaaaaatttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtcaggcggccatgcgctcgcgcttgcgcttgggccccctcgcagcgaccgcagcaaggggcactcgtcagcctcaagccttgcgcctcactggcaccacaagctcctctgtggcgcgcggagtcggatggccgcgnngnggtggtgccggccnccggcgatgtcatgggcctcctcctccgggagcgcatagtcttccccggcaccgagaatcgaggacctcctncgcggggacgccgtcgtcagccagcttctncctccttgacgccatcgacccggactctgacatcccgcctcttcgcactnnnnanccaggggggatcccttagncgcacatgccccatcctatgatggtaatgcagcttgtgaangggcagacgtgccccccctattggaattggggccatagctggatcacagctctataaancccccttgggggggggcacgaaggggcaagcgatttgccatgcccacancccagat

SEQ ID NO: 13680 - protein, 139 aa, Zea mays
  misc_feature: Ceres CLONE 1374566-F
  misc_feature (69)..(69): Xaa is any aa, unknown, or other
  misc_feature (70)..(70): Xaa is any aa, unknown, or other
  misc_feature (75)..(75): Xaa is any aa, unknown, or other
  misc_feature (99)..(99): Xaa is any aa, unknown, or other
  misc_feature (109)..(109): Xaa is any aa, unknown, or other
  misc_feature (126)..(126): Xaa is any aa, unknown, or other
  misc_feature (127)..(127): Xaa is any aa, unknown, or other
  misc_feature (133)..(133): Xaa is any aa, unknown, or other
MATGSASAIASFSVAAAAAAALRVRRPCARACAWAPSQRPQQGALVSLKPCASLAPQAPLWRAESDGRXXVVPAXGDVMGLLLRERIVFPGTENRGPPXRGRRRQPASXSLTPSTRTLTSRLFALXXQGGSLXRTCPIL

SEQ ID NO: 13681 - DNA, 726 bp, Zea mays
  misc_feature: Ceres CLONE 1374569-F
tctgaactaggtggatcccccgggctgcaggaattcgcacgagaccattacctagaacatcctaatcgaaaaactgatggatcactcctgcagctgcagctgcagtgcgtcgccgctactccatcgtctattaattcctcgtgtagctccagcgctcggcttagacaagcctctccaacatgaagctcctgggttggatgcaccggaagttacgacaggaacaggaatgatgtggtcaaagagttcaacaacgctggaggtgggacgtgcaactgcatcaccggggctggcccgggtcggacccggccactttcctcggcaccggccacgaatacttcggcgccgacaacgacttgcccacaatcatccatcggtcgcggccccccacctcttcaccttttgtggcgggggcctcctccccgttggcacgcttaggcatcgccgccctggcggtgccttgcagatgctgatggaagtgattaggacggcgaggccgatggtgacctccaattttgggagaaagacgaacccggccgggggtagacgaaaagagaggtggaacgggcgcggccggtcccctggtccgttattgggcgcgcccgtcgcgggagagggaggcgcccggggggggggaagagggcgctccgcgcgggggcgcttcgagggtgtgtttccattaggggtgcgtggcccccgcccgcgggggtggcacctgcgactccgtat

SEQ ID NO: 13682 - DNA, 714 bp, Zea mays
  misc_feature: Ceres CLONE 1374570-F
  misc_feature: Translation starting site: 158
  misc_feature: Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
  misc_feature (454)..(454): n is a, c, t, g, unknown, or other
ggagctccccgcggtggcggccgctctagaactagtggatcccccgggctgcaggaattcgcacgagaccattacctagaacatcataatcgaaaaagatcagatcacactcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcancaccgcccccggtgtgctctccatggccaacgccgggcccaacaccaacggctcccagttcttcatctgcaccgtcgcgaccccttggctcgacggcaagcacgtcgtcttcgggcgggtcgtcagggggcaatggacgtcgtcaaggcatccaagaaggtgggcacccgcaacgctcaccctcccaaggtggccaagggcgctgactgcgacggctctctagactccccggaaaactggggccggtccggcgcccctcc

SEQ ID NO: 13683 - DNA, 717 bp, Zea mays
  misc_feature: Ceres CLONE 1374572-F
  misc_feature: Encodes the peptide sequence at SEQ ID NO. 13684
  misc_feature (280)..(280): n is a, c, t, g, unknown, or other
  misc_feature (288)..(288): n is a, c, t, g, unknown, or other
  misc_feature (289)..(289): n is a, c, t, g, unknown, or other
  misc_feature (291)..(291): n is a, c, t, g, unknown, or other
  misc_feature (292)..(292): n is a, c, t, g, unknown, or other
  misc_feature (296)..(296): n is a, c, t, g, unknown, or other
  misc_feature (297)..(297): n is a, c, t, g, unknown, or other
  misc_feature (301)..(301): n is a, c, t, g, unknown, or other
  misc_feature (302)..(302): n is a, c, t, g, unknown, or other
  misc_feature (306)..(306): n is a, c, t, g, unknown, or other
  misc_feature (354)..(354): n is a, c, t, g, unknown, or other
  misc_feature (392)..(392): n is a, c, t, g, unknown, or other
  misc_feature (395)..(395): n is a, c, t, g, unknown, or other
  misc_feature (396)..(396): n is a, c, t, g, unknown, or other
  misc_feature (578)..(578): n is a, c, t, g, unknown, or other
tccccgcggtggcggccgctctagaactagtggatcccccgggctgcaggaattcgcacgagaccattacctagaacatcctaatcgaaaaagcgtgtctcgtgctccccccaggctcctcttcctcgctttccctccaccccgggcgcaaaccctaaccctaccgtcgctcgccccgcggcgtctgccaatggcgcgccccgtgtgagtgtgcgcgagagaggggtagaccttgaggccgctacccggggaggagagcgagagatgtataacacagggngggagcgnngnngagnnctgnnctgnaccggaagcggatcaacgacgcgctggatagcatctcgagaaggcgtncgcgtcggcgtccacgtcgaggggggtcggcgggcggnggnngccaacacacccgcctcgtcggggccgtcctccgggtcgcccatcccaagggccgctggtccggaaggggagcctgattctggaaaggaaacaatcgatggtaccggctcggaggaaaaaacccccccgggtttcctgggtttgccccttagaggggaagtgcccctttcgggggatcgccnaggattaatttcagagcagttcacccttgggggccctaaagcccaggcccttatttatgatatgcgcgccccgtccctttgtggaggcgggggccctttggggggtagcggcccctggaccaaataagtcgcccctaaa

SEQ ID NO: 13684 - protein, 146 aa, Zea mays
  misc_feature: Ceres CLONE 1374572-F
  misc_feature (6)..(6): Xaa is any aa, unknown, or other
  misc_feature (9)..(9): Xaa is any aa, unknown, or other
  misc_feature (10)..(10): Xaa is any aa, unknown, or other
  misc_feature (11)..(11): Xaa is any aa, unknown, or other
  misc_feature (13)..(13): Xaa is any aa, unknown, or other
  misc_feature (14)..(14): Xaa is any aa, unknown, or other
  misc_feature (43)..(43): Xaa is any aa, unknown, or other
  misc_feature (44)..(44): Xaa is any aa, unknown, or other
  misc_feature (105)..(105): Xaa is any aa, unknown, or other
MYNTGXERXXXLXXTGSGSTTRWIASREGVRVGVHVEGGRRAXXANTPASSGPSSGSPIPRAAGPEGEPDSGKETIDGTGSEEKTPPGFLGLPLRGEVPLSGDRXGLISEQFTLGGPKAQALIYDMRAPSLCGGGGPLGGSGPWTK

SEQ ID NO: 13685 - DNA, 726 bp, Zea mays
  misc_feature: Ceres CLONE 1374573-F
  misc_feature: Encodes the peptide sequence at SEQ ID NO. 13686
  misc_feature (379)..(379): n is a, c, t, g, unknown, or other
ggagctccccgcggtggcggccgctctagaactagtggatcccccgggctgcaggaattcgcacgagaccattacctagaacatcctaatcgaaaaaaaccgcgtctcgcgcgaagaatccgcatttccccttccccgcaccgcaccgcacccaacccccgtcggagagagagatggcatcggtggcggagatgcagcccctcgcgccggcggggtaccgccgcgcgccggagatgaaggagaaggtggaggcgtcggtggtggacctggaggccgggaccggggagacgctgtacccggggatctcgcgcggggagagcgccctccgatggggcttcgtccgcaaggtctacggcatcctcgctgcgcagctgctccncaccaccgccgtctccgccctcaccgttctccaccccaccctcaacgccacgctctccgactccccgggcctcgcgtccggtgctcgccgtcctgcctttcaatcctgatgatcccattgtatcattatcagcacaagcaccacacccatttcgtttttccccgggggccgggtcccggttgtgcttgagctcccgcatccggggggggcttgtgctaacacccaagggaaaatccgttctgggaggctttagtggtgcgggttgggcctgggcggttttctccgactgggaaatgggtttctggggcggcaaagaaaggaaagggaatccgggtaactgggggccc

SEQ ID NO: 13686 - protein, 104 aa, Zea mays
  misc_feature: Ceres CLONE 1374573-F
  misc_feature (69)..(69): Xaa is any aa, unknown, or other
MASVAEMQPLAPAGYRRAPEMKEKVEASVVDLEAGTGETLYPGISRGESALRWGFVRKVYGILAAQLLXTTAVSALTVLHPTLNATLSDSPGLASGARRPAFQS

SEQ ID NO: 13687 - DNA, 713 bp, Zea mays
  misc_feature: Ceres CLONE 1374575-F
  misc_feature: Pfam Name: Ribosomal_L5 Pfam Description: Ribosomal protein L5
tggagctccccgcggtggcggccgctctagaactagtggatcccccgggctgcaggaattcgcacgagaccattacctagaacatcctaatcgaaaaaagcatagtacgatattacggtttccttaccttacgagttttttcttccgccgacgtatcatacctcggcccgagttgttgtaatctctcacctccttcgtcgttgtctaccagatcatcgcatggcgctcgacaagaagtactccacacccgatggggtagatgaatgaccagaagatcgtgctcaatatctccgacggagagagcggtgatcgcctcacccgcgccgccaaggaaatggagcagctaatcgattagttgacgctattcttcaaggtaaggacactgtgcaggctccctcgccatccggcgcaatgagaatatccgaatgctatgtgatgcggcgcccctgcagaaggtaatgcatctactgtatagtattcttgaatcggaaggaacacgatctggtgaagataaactgcagtgaaaatggcagctttgggatttgggatccatcagcacatagatgttgtgagtcagaatgatctctcgactggtataacgtgtgaaaaatcaacgttctccttaaatggtgttatcgacaggatccgctgcgcagcagagctagaccgtgggagggaggcgacacggtacgtacagaaccttctgatggagc

SEQ ID NO: 13688 - DNA, 691 bp, Zea mays
  misc_feature: Ceres CLONE 1374575-R
caaattgggtaccgggccccccctcgaggtcgacggtatcgataagcttttttttttttttttttgaaccataatagcccatactgctagtcgaggtttaacagtattaacatcaatgtattctacacacacgaaaacatggatcccactaactccaatacgaccagttcaggcacacaaatgataatgcatcaggttttcttctaatacaaatcccactgccaaatatactcggaatactccattaactccaaacggtttaatagaccaagagggtctaatatcttatggtaacgcttacgcttacgaggggttggcatgcgccttgttgaggcatcgcaccctcatacttgacctggaaccacttcaaggcgccctccttacgtgaccctgccgctggatcccaaccccggacttgcacctgccgcaaccggccattccgaacccagcacgctccaggacgacctagaattccatgccctagatacctgtagatggatcatacttgatgccgagatctatgtgctcttggatacctgatccaaatcaacacgtgccactgaagttccacctagacagatcctactcctacgactacgatccactcttcagacagctacaatgtcttctaaccccacaccgtcacataacatgcgatcttctcattgcgccggatacccaacgacctcaa

SEQ ID NO: 13689 - DNA, 844 bp, Zea mays
  misc_feature: Ceres CLONE 1374576-F
  misc_feature: Encodes the peptide sequence at SEQ ID NO. 13690
  misc_feature (323)..(323): n is a, c, t, g, unknown, or other
  misc_feature (327)..(327): n is a, c, t, g, unknown, or other
  misc_feature (328)..(328): n is a, c, t, g, unknown, or other
  misc_feature (344)..(344): n is a, c, t, g, unknown, or other
  misc_feature (354)..(354): n is a, c, t, g, unknown, or other
  misc_feature (405)..(405): n is a, c, t, g, unknown, or other
  misc_feature (457)..(457): n is a, c, t, g, unknown, or other
  misc_feature (479)..(479): n is a, c, t, g, unknown, or other
  misc_feature (501)..(501): n is a, c, t, g, unknown, or other
  misc_feature (507)..(507): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
aaagctggagctccccgcggtggcggccgctctaaactagtggatcccccgggctgcaggaattcgcacgagaccattacctagaacatcctaatcgaaaaagttcgtggagtggagtcaccacagaatcaaagaaaagctttcccccgatcctctcgcggacaccagcgatgggttcccgctacgaggtggaggtcaccgtcggctccgcccgggacctcaagaacgtcaactggcgcaacggcgacctcaagccctacgccgtggtgtggatcgactccggcagcaagtgctcgacccgcgtcgacctcgacaacgggagnagcnnccggcgtggggacgangaagctgctncgtcccgctcccgcccacctcccgcctgcggacgacgccgtcctcctaagnttcgaaacgtcgtccacgccaacgcccgccccagggcgtcaagcccggctcnggtcggctccgcgcgcctcccnggctccgcgacggtcctcgaangaacgnccggggggtcgggggggcaaagggcctttcgcgcagcccttccggccttcaaggcgcccccctcgggggccggccccccacgggccggccctgcggacgtccggccgtcggcccgtccaagggagccggtcccagggtacctacgaaccccccaacccccctaacccgggcccccccgcggccctaacgcccaacaccggggcgggcgggcaacccggtgaaccccttaaggggttccgtcccgcttggctggctggcccggcgggcttaactaacggctccccgggagggggaaaaccgggttccggggggggggnnncccctaacgggggggnnn

SEQ ID NO: 13690 - protein, 166 aa, Zea mays
  misc_feature: Ceres CLONE 1374576-F
  misc_feature (51)..(51): Xaa is any aa, unknown, or other
  misc_feature (53)..(53): Xaa is any aa, unknown, or other
  misc_feature (58)..(58): Xaa is any aa, unknown, or other
  misc_feature (62)..(62): Xaa is any aa, unknown, or other
  misc_feature (79)..(79): Xaa is any aa, unknown, or other
  misc_feature (96)..(96): Xaa is any aa, unknown, or other
  misc_feature (111)..(111): Xaa is any aa, unknown, or other
  misc_feature (113)..(113): Xaa is any aa, unknown, or other
MGSRYEVEVTVGSARDLKNVNWRNGDLKPYAVVWIDSGSKCSTRVDLDNGXSXRRGDXEAAXSRSRPPPACGRRRPPKXRNVVHANARPRASSPAXVGSARLPGSATVLEXTXGGSGGQRAFRAALPAFKAPPSGAGPPRAGPADVRPSARPREPVPGYLRTPQPP

SEQ ID NO: 13691 - DNA, 751 bp, Zea mays
  misc_feature: Ceres CLONE 1374586-F
  misc_feature: Encodes the peptide sequence at SEQ ID NO. 13692
  misc_feature (555)..(555): n is a, c, t, g, unknown, or other
  misc_feature (751)..(751): n is a, c, t, g, unknown, or other
agagctggagctccccgcggtggcggccgctctataactagtggatcccccgggctgcaggaattcgcacgagaccattacctagaacatcctaatcgaaaagtccacctcagctcccatatccgctcccctacctctccagcatctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcgccctcaaggactcgaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatcttgaagggtggtgccaaagaaaaggnttgtttaattccttcctggcccccccccaaaaggggggagagaagaagaggggaggttgggtgcggcgggccttgtgccgggggcccgcggggcgcggcgaggcgccgccccgggtgggcccggagggcggccacaagtccggtctgtggccgcgggcacggcgacacggccctcgtcccggcggtggtctcggcn

SEQ ID NO: 13692 - protein, 187 aa, Zea mays
  misc_feature: Ceres CLONE 1374586-F
  misc_feature (4)..(133): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTDKDKAAAHLEGWCQRKGLFNSFLAPPQKGGEKKRGGWVRRALCRGPAGRGEAPPRVGPEGGHKSGLWPRARRHGPRPGGGLG

SEQ ID NO: 13693 - DNA, 750 bp, Zea mays
  misc_feature: Ceres CLONE 1374588-F
tggagctccccgcggtggcggccgctctagaactagtggatcccccggggtgcaggaattctcacgagaccattacctagaacatcctaatcgaaaaaattatccagcccacctctgctctgcgttcgcttcagatgtaagcactattgtcactcttgtggagttccgcgcctcgccgtccgggagcaaggtactcccaactccgccgccccggaaccctcgccgtcaccaccacatgcacagttgcatgccgacccctcacggagccctccatgtacttcgccataggatcgccgagctgcgcgactatccgaagtaccggacctgaaaaccgattctcagaaagtacctctgcccctggaaaggtcagctcagtaagcgccatacgcggaggggcacccacgtgagaaacggagggtctacggggaaaaacccagggggcgaacgaaaaagcgcttaaactcgcgtccgggttttcaaaaaccgtgggggtttttaagggaaaagccccaggggggggaaaagccacaaaaaattttttgtgttcttcccaaccaaaaaaccctttttatactccccagaggggctccccccaagggaaataaaaaagaggggttttttttcttcgggagggggggggagcggaaaaaaattatgggggaaaattcccccccgggggggggcgggtgcgggggaagaaatttttttcccccacaaaactcttttcaaaaaggagaagagggtgggcgt

SEQ ID NO: 13694 - DNA, 737 bp, Zea mays
  misc_feature: Ceres CLONE 1374596-F
  misc_feature: Encodes the peptide sequence at SEQ ID NO. 13695
  misc_feature (589)..(589): n is a, c, t, g, unknown, or other
ggagctccccgcggtggcggccgctctagaactagtggatcccccgggctgcaggaattcgcacgagaccattacctagaacatcctaatcgaaaaatttttcgcccgccgcccccagtcccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtccggcctgctccttatctctgggcctttcaagatcaatggagtaccgatccgccgtgtgaatcagacctatgtcattgctacatcaaccaaagttgacatctctgggtgttgatgtcgccaagtttgatgancagtactttgccagggagaagaagcagaaggtgaggaagaccgagggcgagctttttgagacagaaaggaggcatccaagtcactgcctgacttcaagaggatgaccagagggtgtgaattctgctctgatcaagctatcgagggtgg

SEQ ID NO: 13695 - protein, 137 aa, Zea mays
  misc_feature: Ceres CLONE 1374596-F
  misc_feature (1)..(49): Pfam Name: Ribosomal_L6e_N Pfam Description: Ribosomal protein L6, N-terminal domain
MAPTSKLSTGIKRASRSHAYHRRGLWAIKAKNGGAFPKADKAAAAVEPKFYPADDVKPRVPSTRKPKPTKLRSSITPGTVLILLAGRFMGKRVVFLKQLKSGLLLISGPFKINGVPIRRVNQTYVIATSTKVDISGC

SEQ ID NO: 13696 - DNA, 876 bp, Zea mays
  misc_feature: Ceres CLONE 1374597-R
  misc_feature: SWISSPROT Homolog: EC 3.5.5.1 Nitrilase
gaattgggtaccgggccccccctcgaggtcgacggtatcgataagcttttttttttttttttttgcgttgggaaggcaagagttttttttttagttcaaaggtactactccctactcccatccacgagagccacagcaaacttcaggagctgagcgaccatcaccaagtgttcggcgcagcacaggttcttgacgagtccataagtaagacttagtatcgatatcactcttggcagctagagtcctctcctcggccgacgtgaaagactctgggagctggggttggtcgttcactaccaatctaagggcgttctaggccagaatagtgtgccaccgcttcaagaatgtaacttggctcgaacaatctattgcgggtcaaggtcggctgtaatcggtgcctgtccatgataggtgggacctgcccagacttctcccgagggagaaatgataacgctgcctccgggggaaacaacatggtccgcggatggctcttgcccgaaaccagcgtactcgtactcccgtgggaggaggatagtcctttctacggcaaaatcggctgacgtaacaaacaaagcatccccccatcaaagcaatgagtgtcgtgggcgcttgccaaagggggatgaaatcagcactgggggtggccaatatgtcaataattttggcgtcggccgctgatcctccaagatggcatcttattttccccgccaatggtcgccgccatcttctcccagtgaacgatcatatactgggaatcctggatccagctgctgaatgccccatataattgctatgctaatgccccgaggcgggaggctttccggagccttaccccaggtaacagtccaaaaagggggttaaggaataagcccgggc

SEQ ID NO: 13697 - DNA, 928 bp, Zea mays
  misc_feature: Ceres CLONE 1374597-R2
  misc_feature (873)..(873): n is a, c, t, g, unknown, or other
atggaagaagagtttcctctttagttcaagctactactcccaactcctatccacgatactctacatccaactagaggagtctgagcgaccatcacccagtgttcggcgctgcactgtttcgtgagcagtcaatacagtaagacttagtatcgatgtcactcattggcagctggagtcctatcatcggcggacgagaaagactctaggagctgctggttggtcgttcactaccaatcttaggggttctagtccagaatagtggcccagctcctcggaatgcaaacttgcgctggaacaatctactgcgggtcaaggtcggctgtaatgacgtcgctcgtgctccattcatagttgggacctgctcaagacttctccagatggaggaaatgataacgctgcctcgagggcaaacaactgggtgggcggatggctgtgctcgtaaaccaggtaactcatactccggtggggcaggatagtcccttctacgccgagagtcgctgtagtgaacaaaccaggcctccccgctcgccagcgctgatgggtgatgggcggcttgcccgggctgaatatagccagccaggggggtggccctcttttgtgcaatattctttgggtgtgggccggggatcgcgccagagaggtggcttttgttttggcccccggctaatgggggcggcgcccgattttttgcccattgggggggggttccttgttaaaaggggggggaaaattggtgggttctgctactacgcgcgaaatgaccccccaacaaaataaattttggtctgccatattgatttgttctatggggcggtttgaaagtgctttttcttgtagggatgcttactattcttcacctgagggttggcgtgntggtgtgcgagatgtgttgggtggaggcgggcggggaggttataatggtgagatg

SEQ ID NO: 13698 - DNA, 675 bp, Zea mays
  misc_feature: Ceres CLONE 1374634-F
  misc_feature: Encodes the peptide sequence at SEQ ID NO. 13699
  misc_feature (428)..(428): n is a, c, t, g, unknown, or other
  misc_feature (447)..(447): n is a, c, t, g, unknown, or other
  misc_feature (460)..(460): n is a, c, t, g, unknown, or other
  misc_feature (473)..(473): n is a, c, t, g, unknown, or other
  misc_feature (634)..(634): n is a, c, t, g, unknown, or other
ggagctccccgcggtggcggccgctctagaactagtggatcccccgggctgcaggaattcgcacgagaccattacctagaacatcctaatcgaaaacccgactccctcggctgcctcccgcagccgcccgctgctccggtccttccgaacgctggcctgttcttccctgcctttggcccattcgtcaggcggcccctccgcaggcgacgcaggcgcggtcacgacggcgcgtggccccgactacgtagacagctaaccggtctccgcctccggcccttctcctgtcgcccgattgagtcgctgctgcaactgccaacttcacccccggcgagctcaccacagtcttccggaaaggtgctatcaatttggaagatggcagatgagggagcaggcccccaagctctagggaaaagggttgcaggtactcnaattcacaagggatatccngaacctgatgatngaggaacagaacnagagatgggtacatttaagaaagctactgaagaaagtatggccacacggagggattgtaaaggttcggggccagcagacgtcatcagcttcttctaaccctttctctgcaatcagatttgccccactggatctagtgctcaaccagtgcttctgtcccagnagtccaccttcagatgtcaaaagtgacgaggaaaagcatgg

SEQ ID NO: 13699 - protein, 65 aa, Zea mays
  misc_feature: Ceres CLONE 1374634-F
  misc_feature (19)..(19): Xaa is any aa, unknown, or other
  misc_feature (30)..(30): Xaa is any aa, unknown, or other
  misc_feature (34)..(34): Xaa is any aa, unknown, or other
MADEGAGPQALGKRVAGTXIHKGYPEPDDXGTEXEMGTFKKATEESMATRRDCKGSGPADVISFF

SEQ ID NO: 13700 - DNA, 629 bp, Zea mays
  misc_feature: Ceres CLONE 1374637-F
  misc_feature: Encodes the peptide sequence at SEQ ID NO. 13701
  misc_feature (157)..(157): n is a, c, t, g, unknown, or other
  misc_feature (174)..(174): n is a, c, t, g, unknown, or other
  misc_feature (490)..(490): n is a, c, t, g, unknown, or other
  misc_feature (491)..(491): n is a, c, t, g, unknown, or other
tggagctccccgcggtggcggccgctctagaactagtggatcccccgggctgcaggaattcgcacgagaccattacctagaacatcctaatcgaaaaacaatatccattccaccttggtccatcagcagcgagcgaacaggcaaaaaggaaaggccngagaagcgctttatccnggccgtacgtagcgataagagtggtgcacccgtagcggcacggcatggcggccacggcgtactccgtggcgctcctcggcggcgcacgcctgccggccgccttcctccctcgacgcagcagcgtgtgccaccaccagcttcgcctccaagacgcaccgaggctgatctccctgcaccgtgccagggccgcttccgaggacacgtcggcctcccggcggcgacgagctcatcgaagaccctcagggcaagtgggacggcggtgaggaccagcccaccgtcctcctgtacggcggcggcgccgtcgtcgcgctatggnntgacgtcggtgtcgtcggcgccatcaacggcgtgccgctgctccccaggatctgggagtccgtgggcttcggtacaccggttgggtcggctacggtacctcctcttaaggaaagcaggaaagaactggtcaacgaatt

SEQ ID NO: 13701 - protein, 72 aa, Zea mays
  misc_feature: Ceres CLONE 1374637-F
MAATAYSVALLGGARLPAAFLPRRSSVCHHQLRLQDAPRLISLHRARAASEDTSASRRRRAHRRPSGQVGRR

SEQ ID NO: 13702 - DNA, 712 bp, Zea mays
  misc_feature: Ceres CLONE 1374639-F
  misc_feature (673)..(673): n is a, c, t, g, unknown, or other
  misc_feature (674)..(674): n is a, c, t, g, unknown, or other
tccccgcggtggcggccgctctagaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacaaatcaaaataataaaaaaaataataaaaactagtactacgcaatccagctttctccttataaagaaatcaatggataaatttaaaaaaagcagagcatcaaaccaagaagaaaaactgatgtcacgaacttgacagttgacttttcgcgcaaacaaacaaacaaacactacgtactgtgctctgcttatggatacatacatgcatactagtagctcatatatgcgtacaaggccgccccgcagggccaccttcgtgggcatctggaagaagcgtgcggtggagcagtactcgcccgatcccgtacgtggcgacgctgctgaactgcnnatgatgtgggtgctgtacgggctgccgctggtgcaccc

SEQ ID NO: 13703 - DNA, 677 bp, Zea mays
  misc_feature: Ceres CLONE 1374643-F
aagctggagctccccgcggtggcggccgctctagaactagtggatcccccgggctgcaggaattcgcacgagaccattacctagaacatcctaatcgaaaaaccagtactagcagtggcgcaaaaacttttttattacaacttcccggcaggacccgtttcgttcggtccaagtctccaacccctagcagcccacccacatacaattccgtttgcccgggtcctctcctcgcccgcgaccgccgtttgactcccggacccgacccactcccaccaatcggaggcaaagatcgcgtgaaatcccgggtctcgcgcgcccatttcagccggacgctgaccaagacaaccccggcgatccccacacccgcacacacaaagacgcagaccacacaacggctcggcaagcggcagcaagcccagaccagagcgaaaacccaccgttccagcacccgattttgaaccaccgcgacactcccaagtcccaaccaaatctacgacccctccgaccgaaacgagatctccgcctcccctcacggaaaggaaagaaacgctctccccccggggcaaagggaaccgtcgccgcgtcgcggaaaactgaagcggggcacaggaggaggagaggccgaggcagggagagggttccggcggcgatggagcgatacaacccctccgaggtgg

SEQ ID NO: 13704 - DNA, 676 bp, Zea mays
  misc_feature: Ceres CLONE 1374645-F
  misc_feature: Encodes the peptide sequence at SEQ ID NO. 13705
  misc_feature (543)..(543): n is a, c, t, g, unknown, or other
  misc_feature (608)..(608): n is a, c, t, g, unknown, or other
  misc_feature (609)..(609): n is a, c, t, g, unknown, or other
tggagctccccgcggtggcggccgctctagaactagtggatcccccgggctgcaggaattcgcacgagaccattacctagaacatcctaatcgaaaaaccgcagccgcagcacaatcgcctcgccttcccttccccaccagcccgtctctctcttctctctgtctctcttctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcccccggcggcgcgcccgccaacgtcgcctgcgccatcgccaagctcggcggatcctccgccttcgtcggcaagttcggcgacgacgagttcgggcacatgttggtgaacatcctgaagcagaacaacgtgaacgcggaggggtgcctgttcgacaagcacgcgcggacggcgctggccttcgtgacccntcagcacgacggggagcgcgagttcatggtctacaggaacccgagcgcggacatgctgctgacgnnagcggagcttgacctggggctggttgcgcggcgcagggtggtccactacgggtccatctcgctcatc

SEQ ID NO: 13705 - protein, 154 aa, Zea mays
  misc_feature: Ceres CLONE 1374645-F
  misc_feature: SWISSPROT Homolog: EC 2.7.1.4 Fructokinase
  misc_feature (110)..(110): Xaa is any aa, unknown, or other
  misc_feature (132)..(132): Xaa is any aa, unknown, or other
MAPLGDGGAAAAAASNNLVVSFGEMLIDFVPDVAGLSLAESGGFVKAPGGAPANVACAIAKLGGSSAFVGKFGDDEFGHMLVNILKQNNVNAEGCLFDKHARTALAFVTXQHDGEREFMVYRNPSADMLLTXAELDLGLVARRRVVHYGSISLI

SEQ ID NO: 13706 - DNA, 675 bp, Zea mays
  misc_feature: Ceres CLONE 1374646-F
  misc_feature: Encodes the peptide sequence at SEQ ID NO. 13707
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (46)..(46): n is a, c, t, g, unknown, or other
  misc_feature (47)..(47): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
aaaaataaaaaaaannannaaacacgggcccccaaaggcgcggggnntttttnnnncaaagctggagctccccgcggtggcggccgctctagaactagtggatcccccgggctgcaggaattcgcacgagaccattacctagaacatcctaatcgaaaatcctccgcgcaggcaagagcagccagccgcttcgggatcgggacgcggagaggggaaaggcgagtcgtcgactcgtcgtccgggcagcttccctccctctcctctccgcccccgcttacctaggccggccccgcctacgcccccctcccgccgccgcacgatgagcacttctcccgccgccgccgacgtttcgcctttgccgcctactgctgccgccgacgaggccgcgcgggcgacagagacggtggtggtcgatgagagggtcgcctcacacgtggacccgttcctcgtcgagacgctcgacaaccctcgccaccgtctcatggttctacggatgggaactggatatacaaaactttatggagaaccctcagctggcagaggttgaattcccagacttttccgacttcttaccctccgctggggctggtcatccgggttggccaaacattatgggcttaaaagacatatggtagccagatagggttaaaaaaaaaggggtccaggttaggcgga

SEQ ID NO: 13707 - protein, 75 aa, Zea mays
  misc_feature: Ceres CLONE 1374646-F
MSTSPAAADVSPLPPTAAADEAARATETVVVDERVASHVDPFLVETLDNPRHRLMVLRMGTGYTKLYGEPSAGRG

SEQ ID NO: 13708 - DNA, 882 bp, Zea mays
  misc_feature: Ceres CLONE 1374651-F
  misc_feature (7)..(7): n is a, c, t, g, unknown, or other
  misc_feature (8)..(8): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (29)..(29): n is a, c, t, g, unknown, or other
  misc_feature (35)..(35): n is a, c, t, g, unknown, or other
  misc_feature (50)..(50): n is a, c, t, g, unknown, or other
  misc_feature (51)..(51): n is a, c, t, g, unknown, or other
  misc_feature (782)..(782): n is a, c, t, g, unknown, or other
  misc_feature (784)..(784): n is a, c, t, g, unknown, or other
aaaaaannaannnnnnnnnccctggcccnccctcncacccaccccccacnngggtttctcctggagctccccgcggtggcggccgctctagactagtggatcccccgggctgcaggattcgcacgagaccattacctagaacatcctaatcgaaaaaatctctctcttctcctcgcctcgccttggtgttcacgccgtcgctagcggctgccgcggggaagcttctggcctccccggggccaggctcgggtcgtcgtcgggcaggcagttgctaaccggggaaacgggcacacccagaacggaggaccaccggcgaggggaaggggaaactcgggaaaaaaaaaggcccgcccccgggagaaacccctaacggcggggggggggggtaaccgggggaaatttgggcccccctgggggccccccctttcccctaaaacaaaaggggggcccccgccccggggcggaaaaacccccccccccccctttttttggaaaaaagagggggacacccttttttggcggccgcctgggggggggatttttctccccgccaaaataacaaagggggcggaacaaacggtgggggggggcccggccccccgtctttaattaaataagggcacaccaccccggcccctcctccctcacacaacgggcgggggggaaaccctctctggcgaggaaaacccccccgccgcggcggggggcggggcgagaaaaaaggagggggggggagaagtattttccccaccaccctgaacacgacccgccctacacacggnanataaataggggaaggcggggggggggcccgccccgcgcgggacctcccttcacaaatactagcctacgtcccagcatagaggggtgccccctcacccg

SEQ ID NO: 13709 - DNA, 697 bp, Zea mays
  misc_feature: Ceres CLONE 1374659-F
  misc_feature: Encodes the peptide sequence at SEQ ID NO. 13710
  misc_feature (396)..(396): n is a, c, t, g, unknown, or other
tggagctccccgcggtggcggccgctctagaactagtggatcccccgggctgcaggaattcgcacgagaccattacctagaacatcctaatcgaaaaagggatcctatccagattcgtggggacacccccgtccagttccagccttccaacttccaaccctctcctctccgcaggctgtagcatttgtcgggttggattgggttgttccgcttgggtagcctggtgggatcgaaatctgtgtgggatccatggcggcggtcgaggggacgacgaagaagaaggtaatcatcgacaccgaccccggaattgacgacgcgatggccatcttcgtggcactgcggtcgccggagctggaggtgctgggcctcaccactacctgtcggcaacgtccacancgcccctcgccacgcggcatgcgctccacctggttggaggctgttggaaggactgacatccccggcccagaggaatcccatgtaacaattcagaaagccacaaagctggagatcgcaagttttggcccacggttctgacggcctgggaaaaccaggatttccctccaccgggtacaaggcctggaaaatcaggcgggtgctggccttcctgggttgagcaaagaaaatctgtacccctggacaaagttaccatgggtccgccctcgggtcaactggacaactttggcttttgggaaggggg

SEQ ID NO: 13710 - protein, 94 aa, Zea mays
  misc_feature: Ceres CLONE 1374659-F
  misc_feature: SWISSPROT Homolog: EC 3.2.2.8 Ribosylpyrimidine nucleosidase
  misc_feature (49)..(49): Xaa is any aa, unknown, or other
MAAVEGTTKKKVIIDTDPGIDDAMAIFVALRSPELEVLGLTTTCRQRPXRPSPRGMRSTWLEAVGRTDIPGPEESHVTIQKATKLEIASFGPRF

SEQ ID NO: 13711 - DNA, 683 bp, Zea mays
  misc_feature: Ceres CLONE 1374660-F
  misc_feature: Encodes the peptide sequence at SEQ ID NO. 13712
  misc_feature (403)..(403): n is a, c, t, g, unknown, or other
  misc_feature (404)..(404): n is a, c, t, g, unknown, or other
  misc_feature (489)..(489): n is a, c, t, g, unknown, or other
  misc_feature (490)..(490): n is a, c, t, g, unknown, or other
  misc_feature (492)..(492): n is a, c, t, g, unknown, or other
  misc_feature (506)..(506): n is a, c, t, g, unknown, or other
  misc_feature (550)..(550): n is a, c, t, g, unknown, or other
  misc_feature (560)..(560): n is a, c, t, g, unknown, or other
  misc_feature (561)..(561): n is a, c, t, g, unknown, or other
  misc_feature (599)..(599): n is a, c, t, g, unknown, or other
  misc_feature (617)..(617): n is a, c, t, g, unknown, or other
aaactggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcnnagagcgagtggcccgagcggcaccagcaagctgacgcgggcgaagacggcgacagcggcgtggacgcctacgtctcccgctccgnnangggcgagtggcggngccagtgcctgcgccgcacgaggggcagccgtgggagacccagnagtgcatganngcgtgcggccgccgcggactggccgtcaactggagccngagtacggtcgcggcacnaaaccgcggcagtgcccggaaagtgccacgccacaccgggggactggtgggaaagcacctgctgga

SEQ ID NO: 13712 - protein, 74 aa, Zea mays
  misc_feature: Ceres CLONE 1374660-F
  misc_feature (64)..(64): Xaa is any aa, unknown, or other
MGKGSVGASWWAFLLLAGVLLVVAATAGAEDGVVERDRKEDLRWCKQACEWQYGKDTPRKRECXERVARAAPAS

SEQ ID NO: 13713 - DNA, 636 bp, Zea mays
  misc_feature: Ceres CLONE 1374668-F
  misc_feature: Encodes the peptide sequence at SEQ ID NO. 13714
  misc_feature (368)..(368): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (437)..(437): n is a, c, t, g, unknown, or other
  misc_feature (478)..(478): n is a, c, t, g, unknown, or other
  misc_feature (536)..(536): n is a, c, t, g, unknown, or other
  misc_feature (598)..(598): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtagagcaggtggaagggcatgctccacgacaaggggccgacggcgtcgcaggcgctggacggtgggcgaacngccttggtttcccccgggcctgggggggcggggggnnnccctttggggcccttgtggcccttggggggntggggcctttgggtccgggggggggcgcctcttggggggcncgcgccctttgtgaaaacccggggggggccccccctttcccccccggttggggggggntttgtggggggggggggggggccccttttgggggggggcccccgccggggggggtggggggnaccccccaacaccgggggccccgcggggggggtggggg

SEQ ID NO: 13714 - protein, 95 aa, Zea mays
  misc_feature: Ceres CLONE 1374668-F
  misc_feature (55)..(55): Xaa is any aa, unknown, or other
  misc_feature (67)..(67): Xaa is any aa, unknown, or other
  misc_feature (68)..(68): Xaa is any aa, unknown, or other
  misc_feature (78)..(78): Xaa is any aa, unknown, or other
  misc_feature (92)..(92): Xaa is any aa, unknown, or other
MADRDRSGIYGGAHATYGQQQQQGGGGRPMGRAGGRACSTTRGRRRRRRWTVGEXPWFPPGLGGRGXXLWGPCGPWGXGAFGSGGGRLLGGXRPL

SEQ ID NO: 13715 - DNA, 672 bp, Zea mays
  misc_feature: Ceres CLONE 1374678-F
  misc_feature: Encodes the peptide sequence at SEQ ID NO. 13716
  misc_feature (426)..(426): n is a, c, t, g, unknown, or other
  misc_feature (454)..(454): n is a, c, t, g, unknown, or other
  misc_feature (459)..(459): n is a, c, t, g, unknown, or other
  misc_feature (514)..(514): n is a, c, t, g, unknown, or other
  misc_feature (547)..(547): n is a, c, t, g, unknown, or other
  misc_feature (565)..(565): n is a, c, t, g, unknown, or other
  misc_feature (570)..(570): n is a, c, t, g, unknown, or other
  misc_feature (571)..(571): n is a, c, t, g, unknown, or other
  misc_feature (591)..(591): n is a, c, t, g, unknown, or other
  misc_feature (650)..(650): n is a, c, t, g, unknown, or other
  misc_feature (651)..(651): n is a, c, t, g, unknown, or other
ggagctccccgcggtggcggccgctctagaactagtggatcccccgggctgcaggaattcgcacgagaccattacctagaacatcctaatcgaaaacttcttcatctgttgttggtctcctccaaggctcagtaagttacagacaagaccatccaacaagcagtggcaatggtatctataatggcggaaacaatggtccagctgccaaggccaactcaacgaactccatgcaatcaaatggaccggcgtcgtttccctcgccagcaccctcagcatcaaacggcaatatgatgcctgctccccagcactctagccaaatgaattcgccgaccatgccatcaagcctacctcctatgcaaacgcctgcaggtcggcctcaagaacccgagccaaacgagcctcaaagctcagtccagaagatactgncagacctgatgatgcagtcccatataancagcngtggggcagtgggaagcatatgaggacagcaaacacggttactcctgggtctaancgtggccactcctttagctggcatcccatgacnaatacccctggaatcatncacgnnatgggattcggggctatggntggcctttggtcgcagatgagaacagcaatgggggccaacgcggtggcgatgaacgaanngaccgcacccatgatcacagc

SEQ ID NO: 13716 - protein, 84 aa, Zea mays
  misc_feature: Ceres CLONE 1374678-F
  misc_feature (67)..(67): Xaa is any aa, unknown, or other
  misc_feature (76)..(76): Xaa is any aa, unknown, or other
  misc_feature (78)..(78): Xaa is any aa, unknown, or other
MQSNGPASFPSPAPSASNGNMMPAPQHSSQMNSPTMPSSLPPMQTPAGRPQEPEPNEPQSSVQKILXDLMMQSHIXSXGAVGSI

SEQ ID NO: 13717 - DNA, 685 bp, Zea mays
  misc_feature: Ceres CLONE 1374679-F
  misc_feature: Encodes the peptide sequence at SEQ ID NO. 13718
  misc_feature (430)..(430): n is a, c, t, g, unknown, or other
  misc_feature (431)..(431): n is a, c, t, g, unknown, or other
  misc_feature (437)..(437): n is a, c, t, g, unknown, or other
  misc_feature (496)..(496): n is a, c, t, g, unknown, or other
  misc_feature (526)..(526): n is a, c, t, g, unknown, or other
  misc_feature (550)..(550): n is a, c, t, g, unknown, or other
  misc_feature (551)..(551): n is a, c, t, g, unknown, or other
  misc_feature (563)..(563): n is a, c, t, g, unknown, or other
  misc_feature (566)..(566): n is a, c, t, g, unknown, or other
  misc_feature (577)..(577): n is a, c, t, g, unknown, or other
  misc_feature (606)..(606): n is a, c, t, g, unknown, or other
  misc_feature (615)..(615): n is a, c, t, g, unknown, or other
  misc_feature (623)..(623): n is a, c, t, g, unknown, or other
tggagctccccgcggtggcggccgctctagaactagtggatcccccgggctgcaggaattcgcacgagaccattacctagaacatcctaatcgaaaactcgccccccttcccctccgttgttatcttgtcaagttgcggttgtctccctcctccggcgctcccttccgcccctcccttcccgcctcctccgcgcagatcgccaggcgaggaaccagaccgcagggcaggatgcagtacaagaacctggggcggtcgggcctccgcatcagccagctctcgtacggcgcgtgggtcaccttcgggaaccagctggacgtgaaggaggccaaggtgctactgcaggcgtgccgggacgctggcgtcaactttcttcgacaacgcccgaggtgtacgccaacggggcgcgcccgaggagatcatggggccagnncatccngggactgggctgggcgcgctccgacgtcgtcatctccaacaaagctcttctggggcggncagggcccccaacgacaggccctctccccnaagcacgtcgtcaaggggctccgnnggttcggtccgncgnctcggcctggnactacgtcgacgtcgtctactggcaccgncccgacgcngttcacgncccgtcgaggaaacgggtgccgcgcatggactggggtcatcgacccaggctggggcttctac

SEQ ID NO: 13718 - protein, 152 aa, Zea mays
  misc_feature: Ceres CLONE 1374679-F
  misc_feature (67)..(67): Xaa is any aa, unknown, or other
  misc_feature (68)..(68): Xaa is any aa, unknown, or other
  misc_feature (70)..(70): Xaa is any aa, unknown, or other
  misc_feature (108)..(108): Xaa is any aa, unknown, or other
  misc_feature (112)..(112): Xaa is any aa, unknown, or other
  misc_feature (113)..(113): Xaa is any aa, unknown, or other
  misc_feature (126)..(126): Xaa is any aa, unknown, or other
  misc_feature (129)..(129): Xaa is any aa, unknown, or other
  misc_feature (132)..(132): Xaa is any aa, unknown, or other
MQYKNLGRSGLRISQLSYGAWVTFGNQLDVKEAKVLLQACRDAGVNFLRQRPRCTPTGRARGDHGAXXSXDWAGRAPTSSSPTKLFWGGQGPQRQALSPKHVVKGLRXFGPXXRPGTTSTSSTGTXPTXFTXRRGNGCRAWTGVIDPGWGFY

SEQ ID NO: 13719 - DNA, 665 bp, Zea mays
  misc_feature: Ceres CLONE 1374680-F
  misc_feature: Encodes the peptide sequence at SEQ ID NO. 13720
gctctagaactagtggatcccccgggctgcaggaattcgcacgagaccattacctagagcatcctaatcgaaaaaacaaaaaaaccctagaactccaaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcggcggcggctgcgcgggccggaaccgactatggaacggacgacagcaagatctcccccgacgagatcctccttgagggctgcgactacaaccactggctcatcaccagggaacttcccggaccccaaaccgtcccgcgaaaaaatgatcgagacatacctcccgaactctccgcaagggccgccggaagttataaggaggccaaaaaaaagaaggaatgtttttaacaccgacgaacttatggtggggttttcaaggttgaaatggagccgaagaaatggccaaaaaaaattttcccgggttttgccccggagaaaaattttccatttttggcccggggatccattaacctcaaaacccccaaa

SEQ ID NO: 13720 - protein, 136 aa, Zea mays
  misc_feature: Ceres CLONE 1374680-F
MALALRLRRVLAAASTAAPLLRPSTSVARPCPLVPLASPVAPLPLPPWRFLPGGGAGFRSTAAAAARAGTDYGTDDSKISPDEILLEGCDYNHWLITRELPGPQTVPRKNDRDIPPELSARAAGSYKEAKKKKECF

SEQ ID NO: 13721 - DNA, 671 bp, Zea mays
  misc_feature: Ceres CLONE 1374684-R
  misc_feature: Translation starting site: 96
  misc_feature: Pfam Name: DUF1423 Pfam Description: Protein of unknown function (DUF1423)
ccgggccccccctcgaggtcgacggtatcgataagcttttttttttttttttttcgtgtctaccgatgtaacttttaacattgtttcaagacactatgatcacctgcgccaacagagttaatacatcagcacgcctagcgagtaccgacagtaacgcgaagggattcgaatttctcacagcaccacacgatttcgttacacctctgctcgaacaagtcagcagatcacacataattaccgaaagtgtcagcagcgaaagctcttactccgactagtgaccctccgactttgctggcatgctgcggacgttcttgagcagatcctgaatcttggatagcatcatcgtcggcgtggagtcccctcccgcaccgctggtgctgcccacgccgaccgttggcctctggttctcctgcagcttgatcttctccaagaggaactgcttctctgcctccgcctcctccaggcgccgctttaggtacatgctggcatagtccctgctcgggctgtcttggaattggtgaagcccaatgttctgcagaacgctccgccctcctgcccgggcctcgtttcggctttcagctgggaaaatctcccgcctttcggcctgctttcaaaccgcacgaaatggttctcccagcttccttccacctggctgggtttctttggggctt

SEQ ID NO: 13722 - DNA, 623 bp, Zea mays
  misc_feature: Ceres CLONE 1374685-F
  misc_feature (20)..(20): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
cccccggttctccccatgtnggggggtgggtgatggaaagcgcnnnntcaaagtgggctcccgcgtggcggccgctctagaatagtggatccccgggctgaggaatcgcacgagaccattacctagaacatcctaatcgaaaaaagaccgatctccctctctctccccaatcctccccgcctccccgcctccccctaccaaatcagcaccacccaggcgcatccgaggcacggccgcgcaatgccgccctctgtcgatgcaatgcccggcccccgggaaacccccccgggcgggggggactggcgcatgattctcctcccaagggggcctcccgtctttcaccgggtccgcccccaagaaacccccggggaactccccatttcccggggggagaggggaaaccaaaggttcaaccccccccggggggcctccccccccccacaccccccggggggggggggggggaaaccacccccccgcccgttttttttcccccacccccccggtggggggggggggcggagaaaccccccccccccgaagggtttttttttctggacccctaaaaaaaaacaaccccgccccccccccccgggggggacgccccaccgcccccttccttc

SEQ ID NO: 13723 - DNA, 664 bp, Zea mays
  misc_feature: Ceres CLONE 1374687-F
  misc_feature: Pfam Name: PAP_fibrillin Pfam Description: PAP_fibrillin
  misc_feature (336)..(336): n is a, c, t, g, unknown, or other
  misc_feature (350)..(350): n is a, c, t, g, unknown, or other
  misc_feature (371)..(371): n is a, c, t, g, unknown, or other
  misc_feature (405)..(405): n is a, c, t, g, unknown, or other
  misc_feature (406)..(406): n is a, c, t, g, unknown, or other
  misc_feature (465)..(465): n is a, c, t, g, unknown, or other
tggagctccccgcggtggcggccgctctagaactagtggatcccccgggctgcaggaattcgcacgagaccattacctagaacatcctaatcgaaaaagcttcggagtttctttcgaataattaaaacgaaaacaatggcgacggttcagttcttcaaccaattcccctgcacaacccgagtccaaagcccaccaaaccctaaacccctctccaagccaacgactctggtgctatgacacgctcactcgccgtccgttgttctcccccggcgaattcgccgtttcccgtgcggatttcagagtcagagtcatcgatgcagagacgagttggatccngagacgagtgaggnaggatctgctctattgatggncggagaagcaatcgaatccgtggaagagacgganngtctcaagagatcgctggtggattcgttgtacggcacagaccgagggttgagcgcatcnagcgaaacgagaagcgaaatcggaaatctatccaaaagctcgagtcaaagaacctacccaggtcccaccggaggttttttcctttcaaaggaaaatggaccccgcggaaacctgccccgggggtttgtcccgtggtttccggagaaacggcctttttttaaagccccacatttcccaaatatttgtcggaaaatttccg

SEQ ID NO: 13724 - DNA, 688 bp, Zea mays
  misc_feature: Ceres CLONE 1374688-F
  misc_feature: Encodes the peptide sequence at SEQ ID NO. 13725
  misc_feature (421)..(421): n is a, c, t, g, unknown, or other
aagctggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccggatcgtcgagcgcctcacaaaactccctcatgatgcacgggncgcaacaacggcaagaaggtcatggctgtccgcatcatcaagcataccctgggagaacattcacctggtccacgaaggccaccccatccagggccggcgtcaacgcgatcattcacagggggacccccgggaagatgccaccccgaattgggtcccccttggggttttgaaagaggaaaggcccggaaaaatccccccccctggagggggggggaaaccaagggccattttacctcccccaaccaccttggggccccagggaaaaaa

SEQ ID NO: 13725 - protein, 72 aa, Zea mays
  misc_feature: Ceres CLONE 1374688-F
MAEVEQQQDTPKLFNRWTFDDVQVNDISLNDYLAVNATKHAMYLPHTAGRYSKKRFRKAQCPDRRAPHKTPS

SEQ ID NO: 13726 - DNA, 849 bp, Zea mays
  misc_feature: Ceres CLONE 1374689-F
  misc_feature: Encodes the peptide sequence at SEQ ID NO. 13727
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
gcaannncccccnnnnnnncccccgcgcgggggtnnnggggccccccccaagctggagctccccgcggtggcggccgctctagaactagtggatcccccgggctgcaggaattcgcacgagaccattacctagaacatcctaatcgaaaaggggagtgtgcagcagtatgttctcggtctcgccatcgcatctcgcagagtagacactcaaatccgattgtcgagggggagaaggtggagatcgttgtaacggctagttgcgtcggcccgatggacccgtcgtaccatggcggcggcgccgccggtggaagcgccgacgaccatggccaaattctttgggattggacagaacagcattggtgaacctaacgattcaagtcatgatgctactaaatttgtgtggggattgcctcaatccaagatgacaatggagctggtggggattgctttggaaaatcaaaacccccattggagatacctggccgggattttcttccgctggacctttggatgattattcacatgccaaaggaagacccccgggcaccctgggagggaaatccttcggggaaatcaaaaaggggggcggggcggcaacatttgggaaggaaccccctttttggaagtccttgatcccagttccaaaaaagtttgggggaattccatggaaaaaccggggttccaccctttttccgtccccccccctgggggggaagcccaaaaaaattttcaatttggctccctgcccccggagaaaaaccccccccggaagctttaaaaattggcggaagggaaatacccccctaacccaacgaaagaaaaggaatatccccttctgggggaaccctt

SEQ ID NO: 13727 - protein, 75 aa, Zea mays
  misc_feature: Ceres CLONE 1374689-F
MAAAPPVEAPTTMAKFFGIGQNSIGEPNDSSHDATKFVWGLPQSKMTMELVGIALENQNPHWRYLAGIFFRWTFG

SEQ ID NO: 13728 - DNA, 897 bp, Zea mays
  misc_feature: Ceres CLONE 1374690-F
  misc_feature (8)..(8): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (21)..(21): n is a, c, t, g, unknown, or other
  misc_feature (45)..(45): n is a, c, t, g, unknown, or other
tttccccncccctctnngntntcgccctcccgccaaaccaccccntacccaaggctggaactccccgcggtggcggccgctctagaactagtggatcccccgggctgcacggattcgcacgagaccattacctagaacatcctaatcgaaaattccccatctccggataaaagataaggagtgtctctcctttgccatcctcctctctttcagataagtccctgccccctctctttttcttacattcaggtagtcgcagctcctctcttttttcttgtttctttcgatctgcgagccgtccaagtccagtactcttctttccctcaagggactcttgcagccggcccctctggtttcctcaaattcctggttccccgggccctccctcctggtccccgcggtagatcccgtccggcccaaagagcacaccggtcccccccccccctggtttaccccacccagtttccccctggacgggcccgcccgtgctacccgaaggaaactttggagcggggccccggaatatccgatgggtttcccaactttcttgtttccggtggcgcctttccctttgaaagggggtttctaaaccgccccttctccattagaaaacggcttttcggcccccccccccccagctgtggtgggaaacccttatggggccggggtttctctccccatccccctccatttttccctccgggaaacacaagtcctctttcgcagaaaccattcttttacagagaggttcccgggtggttttttcccacctaatcattgcccccccgccggccaactccccctctttagagaagaagggggtgccgattccccccaaaacaaacaccactctccccctcggcctctgcccctcccccgccccgagaccctctcact

SEQ ID NO: 13729 - DNA, 652 bp, Zea mays
  misc_feature: Ceres CLONE 1374698-F
  misc_feature: Encodes the peptide sequence at SEQ ID NO. 13730
gctctagaactagtggatcccccgggctgcaggaattcgcacgagaccattacctagaacatcctaatcgaaaaccccatttcgaagcccaccgaattccctgcgattcctctcccctcgcctcctcgtctccccctagggttagcacctcgctgcctccgattcaatcataatatggtctcttctccctttgatctgtagatttggggctttggctccgcctcgcgcgcccgatccgggccgtcctccttttttcccctcttatatttgatcggtttctttgcgtcgttcacgcagggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaagggagatgataacgaagcaggatcaggccaagctggctgcctcctctatcgacagcatcgtgaacggcagcgacgccgtcatgggagccggttgttgctggcagcaacacggtagtagctgttgcccaagttgagttgcaacaatggacggggcagcagccccgctgatgttgcccggacccagcgag

SEQ ID NO: 13730 - protein, 75 aa, Zea mays
  misc_feature: Ceres CLONE 1374698-F
  misc_feature (14)..(38): Pfam Name: zf-A20 Pfam Description: A20-like zinc finger
MEHKEAGCQAPEGPILCINNCGFFGSAATMNMCSKCHKGDDNEAGSGQAGCLLYRQHRERQRRRHGSRLLLAATR

SEQ ID NO: 13731 - DNA, 693 bp, Zea mays
  misc_feature: Ceres CLONE 1374700-F
  misc_feature: Translation starting site: 171
  misc_feature (377)..(377): n is a, c, t, g, unknown, or other
  misc_feature (607)..(607): n is a, c, t, g, unknown, or other
gctctagaactagtggatcccccgggctgcaggaattcgcacgagaccattacctagaacatcctaatcgaaaaacaagaggtggccgccgcagtccgcaccccctccccaatcacgccacccgacaccgcgctccgcagattcgtagtcgccgctaggcttccggcgagatggacgtggtgaaggcggcgcagttgtcggggcggacgctggaacgggtagtggtgcatcccttggtgctgctcagcatcgtcgaccactacaaccgcgtcgcccgcgacacccgcaagcgcgtcgtcggcgtcctcctcggcacctcatcccgcgggtccgtcgatgtcaccaactcctacgccgtgccgtttgaggaggatgancaaggatcctaggatctggttccttgaccacaattaccacgagtcaatgttctccatgttcaagaggattaatgccaaggagcatgttgttggctggtacagcactggcccaaaactaagggagaccggacttggatgtccatgcattattccaacagttatggtcctaatccagtcttgggggaaatattgatgtccaacccaagggagctgggtataccgaccaaagngtactaccggtgtgggggaggagggttaaagagaatgcaactcagaaaagtccagaaagtaattttggccatggttccttcagaaa

SEQ ID NO: 13732 - DNA, 672 bp, Zea mays
  misc_feature: Ceres CLONE 1374701-F
  misc_feature: Encodes the peptide sequence at SEQ ID NO. 13733
  misc_feature (502)..(502): n is a, c, t, g, unknown, or other
aaagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacggtccccgtgcaatcttcgttgatctagaaaccactgtgatcgatgaggtgcgcactggnacgtaccgccagctcttccaccctgagcagctcatcagtgggcagggagatggcgctaacaatttcccccggggccactacccattgggaaggaaattgttgatcttggcccttgacgaatccgcaagttggtggaaaatggccgggcctccagggtttctgggcttcag

SEQ ID NO: 13733 - protein, 137 aa, Zea mays
  misc_feature: Ceres CLONE 1374701-F
MRECISVHIGQAGIQVGNACWELYCLEHGIQPDGQVPGDKTAGHHDDAFSTFFSQTGAGKHGPRAIFVDLETTVIDEVRTGTYRQLFHPEQLISGQGDGANNFPRGHYPLGRKLLILALDESASWWKMAGPPGFLGF

SEQ ID NO: 13734 - DNA, 649 bp, Zea mays
  misc_feature: Ceres CLONE 1374702-F
  misc_feature: Encodes the peptide sequence at SEQ ID NO. 13735
tggagctccaccgcggtggcggccgctctagaactagtggatcccccgggctgcaggaattcgcacgagaccattacctagaacatcctaatcgaaaaagcagtccgatagccaggaagcccgtgcacgtcgaccgacgtacgccaccatgccggggctcaccataggcgacaccgtccccaacctggagctggactccacccacggcaagatccgcatccacgactacgttggcgacggctacgccatcatcttctctcacccagccgacttcacgcccgtgtgcacgacggagatggcgacgatggcggggtacgccaaggagttcgagaagcgtggcgtgaagctgctgggcatctcgtgcgacgacgtggagtcgcacaggcagtggaccaaggacgtggaggcgtacggcgggaaacagcagcagcagcagcatacgacaacgaaggtgacgttcccgatcctggcggacccggcgcgggacgccatcgggcagctgaacatggtggaccccgacaagaaagacgcggcgggggcggagcatgccgtccccgcgggctccaaggtcgtcgggccccaaccaggcccgggaagctgagctttttggacccggcccaccacggggcggaacatgggaacaaggtgg

SEQ ID NO: 13735 - protein, 150 aa, Zea mays
  misc_feature: Ceres CLONE 1374702-F
  misc_feature (6)..(130): Pfam Name: AhpC-TSA Pfam Description: AhpC/TSA family
  misc_feature: SWISSPROT Homolog: EC 1.11.1.15 Peroxiredoxin
MPGLTIGDTVPNLELDSTHGKIRIHDYVGDGYAIIFSHPADFTPVCTTEMATMAGYAKEFEKRGVKLLGISCDDVESHRQWTKDVEAYGGKQQQQQHTTTKVTFPILADPARDAIGQLNMVDPDKKDAAGAEHAVPAGSKVVGPQPGPGS

SEQ ID NO: 13736 - DNA, 696 bp, Zea mays
  misc_feature: Ceres CLONE 1374706-F
  misc_feature (369)..(369): n is a, c, t, g, unknown, or other
  misc_feature (377)..(377): n is a, c, t, g, unknown, or other
gagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgntccctccnacatcatcagccctattacatcaggtacctttggtgcatttattggcacaaaacatcagggcaacacaactacaacaacttgtgctagcaaaactttgctgctactcccagcaaacagaagtttcttccatccaaacaactagctggaatgaaccctgcttcctaatttgaacaaaaaaaaataacattttagccgttacccgggtgcctacccccaggaattttttccattcaaccaatggggaaaattgaacccccccgtggttttttaaggggaaaaaaaaatatcaccttttccccctttttggggggggggccc

SEQ ID NO: 13737 - DNA, 742 bp, Zea mays
  misc_feature: Ceres CLONE 1374708-F
  misc_feature: Encodes the peptide sequence at SEQ ID NO. 13738
  misc_feature (742)..(742): n is a, c, t, g, unknown, or other
cgcggtggcggccgctctagaactagtggatcccccgggctgcaggaattcgcacgagaccattacctagaacatcctaatcgaaaaacgtatacacacggccacacgggcacgtagctagctagcagtcgtagcgtgacgatgagggttctctctgttgcggtcgctctggtcgtggtggtggccgcggcctgcctcgccgcgccgcggggcgcggacggcgcgggcgagtgcgctgcgacgccgccggacacggtggcgctgaggctggcgccgtgcgcgtctaccggggaggaccccggctccgcgccgtgcggctcctgctgcagctcgccgcctgcctatcggaaaacagagccccaggtgcctctgctcccgtcctgctgtccatacacggcctggagaggccgcgatccactcccgaggttggcatcatgtatcacataaacgcttgttaccttccgcgaccggttcctggtggttagtaggcgcgtcgattacatgtccgcccattacagggtgctggacggtctcccaataacgatcttgcctgttttgcatggcactctttaatcctcgacgcttctgtttctgttgctaggcgcttccgggcctgttcctctcccgttctgcctttgtttctcattttttactgcccaacgggggctatactgttatgccctatcctctctcgcctgctcgcctcgcctacgcgatcccctgcgcctagtacactcgcgcn

SEQ ID NO: 13738 - protein, 101 aa, Zea mays
  misc_feature: Ceres CLONE 1374708-F
MRVLSVAVALVVVVAAACLAAPRGADGAGECAATPPDTVALRLAPCASTGEDPGSAPCGSCCSSPPAYRKTEPQVPLLPSCCPYTAWRGRDPLPRLASCIT

SEQ ID NO: 13739 - DNA, 705 bp, Zea mays
  misc_feature: Ceres CLONE 1374710-F
  misc_feature: Encodes the peptide sequence at SEQ ID NO. 13740
  misc_feature (464)..(464): n is a, c, t, g, unknown, or other
  misc_feature (669)..(669): n is a, c, t, g, unknown, or other
tccccgcggtggcggccgctctagaactagtggatcccccgggctgcaggaattcgcacgagaccattacctagaacatcctaatcgaaaaatcctccgcgcaggcaagagcagccagccgcttcgggatcgggacgcggagaggggaaaggcgagtcgtcgactcgtcgtccgggcagcttccctccctctcctctccgcccccgcttacctaggccggccccgcctacgcccccctcccgccgccgcacgatgagcacttctcccgccgccgccgacgtttcgcctttgccgcctactgctgccgccgacgaggccgcgcgggcgacagagacggtggtggtcgatgagagggtcgcctcacacgtggacccgttcctcgtcgagacgctcgacaaccctcgccaccgtctcatggttctacggatggaactggatatacaaaactttatgcagaaccctcngcttgcaggagtttgaattccagaactttccgacttctttacctccgctgtgctggctcatcgtgttgcacaacattatggcttagagactatagtagcagatagttttagtagaaggctcagtttaagcagggattgttgcaagaaaaacggcagaaagcaggtatccctgcatttttttttatcagaagttcctagcaatcangcaaagaaatgatcatggaacagtgggaaaaaagct

SEQ ID NO: 13740 - protein, 75 aa, Zea mays
  misc_feature: Ceres CLONE 1374710-F
  misc_feature (71)..(71): Xaa is any aa, unknown, or other
MSTSPAAADVSPLPPTAAADEAARATETVVVDERVASHVDPFLVETLDNPRHRLMVLRMELDIQNFMQNPXLAGV

SEQ ID NO: 13741 - DNA, 740 bp, Zea mays
  misc_feature: Ceres CLONE 1374711-F
  misc_feature: Translation starting site: 233
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (48)..(48): n is a, c, t, g, unknown, or other
  misc_feature (49)..(49): n is a, c, t, g, unknown, or other
  misc_feature (53)..(53): n is a, c, t, g, unknown, or other
nnnnnnnnnnnnnntttcccccctccccccccgccnnnnggggaactnngggncaaaactggagctccccgcggtggcggccgctctagaactagtggatcccccgggctgcaggaattcgcacgagaccattacctagaacatcctaatcgaaaaatccaacccacacacaggctgaccccaccaacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctgcagaacggtgatccgcgacgccgtcacctacaccgagcacgcgcgccgcaagaccgtcacagccatggacgtcgtctacgcactcaagcgccaggggccgcaccctctacggcttcggcgggctaggctaggccggtccgcggcctcgttgtcgccgctgcgggttctattgtttttggaaattccccaatttgtggctttgggggacaaaaaaatgctgggttaactgggacccccctaaaatccaaggcatggtttgggggcggggtccttgaaaaaaaaaggcccaaaattggtggaactttgggcttgggtttgg

SEQ ID NO: 13742 - DNA, 657 bp, Zea mays
  misc_feature: Ceres CLONE 1374712-F
  misc_feature (16)..(16): n is a, c, t, g, unknown, or other
  misc_feature (222)..(222): n is a, c, t, g, unknown, or other
  misc_feature (252)..(252): n is a, c, t, g, unknown, or other
  misc_feature (253)..(253): n is a, c, t, g, unknown, or other
  misc_feature (265)..(265): n is a, c, t, g, unknown, or other
  misc_feature (266)..(266): n is a, c, t, g, unknown, or other
ggggggggagtacgtntacgacgaacagaccgccctggcgggaaggggggccccgggggggggcgcccaaaatagggacccccgggctggggaatccccgagagattaccagaaatccaagccgaaagagaccgggggccacagacagaaccttagcaccaccatcgtcaagagccccaccccagaacaaaactgaaaactcacctcggggggccggcccgnctcctagtaactagtgggatccccccgggnnctgcaggaaatnntcgcacgaagaccattacctagaacatcctaaatcgaaaaatctcccataataattttcagcattcaaaaacacaccaagcgaagcgcactagcaacgacctaacaccaatggctaccaagatattagccctccttgcgcttcttgcccttttagtgagcgcaaaaatgcgttcatattcacagtgctcactggctcctagggccaggaatcccccaagtccctcccccccagttaacttcaaggggtttcaaaaaatcccacccggggaaagcccaaaagggcaaaaaaaaaaaagccttttgggggaaaacgccccttaaaaaccaaaacaaaaggggggcccggaggttagaaaaaaaaaaaaaacccttttgggggaaacacccccc

SEQ ID NO: 13743 - DNA, 646 bp, Zea mays
  misc_feature: Ceres CLONE 1374712-R
ccgattgggtaccgggccccccctcgaggtcgacggtatcgataagcttttttttttttttttttaaattgtttttgcaggattttagtcatcgcaaaattcaggtgaagtatatgggtccgtaaaagtagatccttgtgtaacagactgatctaaacttcgaatcattttaacaaagcatgacagtttttttcacgactgccttgcttttctatctatgagagctgaaatcaggacagcacagcacagcatccgatcgacccttgctgcctacatgggtcagtagatatcatcatggtgctaacattgcaaacagaatccaggtctaacggaagcgaacgcaatggagaggaactgtgaatttgtccacaatcacaagttcattcctcgatgcccatcgtgctatgcgttcaacacaaaatccagcctttatccgtcagtaaaccagtttgaccatgtactcttgtcacactgcctgcacaaacactccaccgctagagttcttcgtcgaaagtgaggtttctgcactgaaacatgtgagctcaatcgggaatctcgtcagttgcttgggacctccacgatgttggataagaggctccttagctccaccatcacaacatcctgctcgcctttcacctcgatggtg

SEQ ID NO: 13744 - DNA, 722 bp, Zea mays
  misc_feature: Ceres CLONE 1374714-F
  misc_feature: Encodes the peptide sequence at SEQ ID NO. 13745
  misc_feature (292)..(292): n is a, c, t, g, unknown, or other
  misc_feature (347)..(347): n is a, c, t, g, unknown, or other
  misc_feature (359)..(359): n is a, c, t, g, unknown, or other
  misc_feature (584)..(584): n is a, c, t, g, unknown, or other
  misc_feature (599)..(599): n is a, c, t, g, unknown, or other
  misc_feature (600)..(600): n is a, c, t, g, unknown, or other
  misc_feature (606)..(606): n is a, c, t, g, unknown, or other
  misc_feature (615)..(615): n is a, c, t, g, unknown, or other
  misc_feature (651)..(651): n is a, c, t, g, unknown, or other
  misc_feature (661)..(661): n is a, c, t, g, unknown, or other
  misc_feature (679)..(679): n is a, c, t, g, unknown, or other
ggcggccgctctagaactagtggatcccccgggctgcaggaattcgcacgagaccattacctagaacatcctaatcgaaaactctatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcggnctgtacccctacgcggagtacctgaggcagccgcagtgcagcccgctggcggcgncgccctactacngcgggtgtgggcagacgagcgccatgtaccagccgctcccggcacagtgctgccagcagcagatgaggatgatggacgtgcagtccgtcgcgcagcagctgcagatgatgatgcagcttgagcgtgccgctgcccgcagcagcagcctgtacgagccagctctgatgcagcagcagcagcagctgctggcagccccaggtctcaaccccatgcccatgatgatgncgcaaacatgccggnncatggntggactctnacagtaccagtaccagctggcccagtacgcaccaanccccggtggngtctccgctgccattccngcctactatggattcatgaaatttggggaatctcttctatcct

SEQ ID NO: 13745 - protein, 191 aa, Zea mays
  misc_feature: Ceres CLONE 1374714-F
  misc_feature (67)..(67): Xaa is any aa, unknown, or other
  misc_feature (71)..(71): Xaa is any aa, unknown, or other
  misc_feature (146)..(146): Xaa is any aa, unknown, or other
  misc_feature (151)..(151): Xaa is any aa, unknown, or other
  misc_feature (153)..(153): Xaa is any aa, unknown, or other
  misc_feature (156)..(156): Xaa is any aa, unknown, or other
  misc_feature (168)..(168): Xaa is any aa, unknown, or other
MKMVIVLVVCLALSAASASAMQMPCPCAGLQGLYGAGAGLTTMMGAGGLYPYAEYLRQPQCSPLAAXPYYXGCGQTSAMYQPLPAQCCQQQMRMMDVQSVAQQLQMMMQLERAAARSSSLYEPALMQQQQQLLAAPGLNPMPMMMXQTCRXMXGLXQYQYQLAQYAPXPGGVSAAIPAYYGFMKFGESLLS

SEQ ID NO: 13746 - DNA, 723 bp, Zea mays
  misc_feature: Ceres CLONE 1374715-F
  misc_feature: Encodes the peptide sequence at SEQ ID NO. 13747
  misc_feature (546)..(546): n is a, c, t, g, unknown, or other
  misc_feature (597)..(597): n is a, c, t, g, unknown, or other
  misc_feature (604)..(604): n is a, c, t, g, unknown, or other
  misc_feature (646)..(646): n is a, c, t, g, unknown, or other
tccccgcggtggcggccgctctagaactagtggatcccccgggctgcaggaattcgcacgagaccattacctagaacatcctaatcgaaaaacggccaatgcaattgcagttgcagttgcaattgcacggcacccatttccagagccgtcctcaattagctagtcaaatctcgctatcctttccccaccatccagatcttccctttcatggacgccgccgtctccaccctcaccgctctcgccatcttcgcgagcaccgtcgagcacgccgcctacaggagcgtgcaggggtatagggtggtcgggaggaaaggcggcgggtgggtccgttgggagaggtgggtggagcggcagttcgtcctctccctctccttcccacggtgcgtcgaggttgccctgcccgccgccgcgccgcggatactgccagcggggtggcgcagccggccggtgttccgcgagggacagaccgtcgacacttggcgttgcattgtggcattcgactccgtcgccgccgtcgctccgtcctccccgccgccgcccgtgctnctccccttcgtgaaccacagctgcagtatctgtctaatctgacaagacttnctgaatngggggtttcggtttcgagaaagagaaacggtcccacaactcngtattcaagcaacccattccgttggtggtgaacaggggaaacttcttggattggggggaggcatcggagtccgatct

SEQ ID NO: 13747 - protein, 126 aa, Zea mays
  misc_feature: Ceres CLONE 1374715-F
MDAAVSTLTALAIFASTVEHAAYRSVQGYRVVGRKGGGWVRWERWVERQFVLSLSFPRCVEVALPAAAPRILPAGWRSRPVFREGQTVDTWRCIVAFDSVAAVAPSSPPPPVLLPFVNHSCSICLI

SEQ ID NO: 13748 - DNA, 677 bp, Zea mays
  misc_feature: Ceres CLONE 1374718-F
  misc_feature: Encodes the peptide sequence at SEQ ID NO. 13749
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (552)..(552): n is a, c, t, g, unknown, or other
  misc_feature (572)..(572): n is a, c, t, g, unknown, or other
  misc_feature (582)..(582): n is a, c, t, g, unknown, or other
  misc_feature (677)..(677): n is a, c, t, g, unknown, or other
aaagctggagctccccgcggtggcggccgctctagaactagtggatcccccgggctgcaggaattcgcacgagaccattacctagaacatcctaatcgaaaaattgattttttttccgcgcagccgatttcttttcgtctctctcgctctcgccttctcggcgcagcgcagtactacgagctagcagcaccaggaacctcttcccacacttccgcgctcctccctctgtctcgagactcgagaatggttgtgtannngcgggcgcaggagggagggaggcgagagggggagctagggtttttcgccgccgccttctgttatcctcaggctctgaaccccctcctgtccggtgcgcggcggattagactccgatgcggaagtctccggcgaagtggatcaagtccgtgctcttcgggaagaagtcgtcgtccaggtccggctccaccaagggcaaagatttatcgaaaggtgcgagtaacaaaggagctgctgctgcggggaaggagccccgtgtctctgagagctccccagtgatctcggagcctgtacttngtagcgcccacaacaatganaccgtgcggnaggtggcgaagggtgaaaattccagcgtgcaagaagtgcagtgaccgatgtcagtcaagtcttggagaagcagggcagtgtggggtctgatacgn

SEQ ID NO: 13749 - protein, 84 aa, Zea mays
  misc_feature: Ceres CLONE 1374718-F
  misc_feature (61)..(61): Xaa is any aa, unknown, or other
  misc_feature (67)..(67): Xaa is any aa, unknown, or other
  misc_feature (71)..(71): Xaa is any aa, unknown, or other
MRKSPAKWIKSVLFGKKSSSRSGSTKGKDLSKGASNKGAAAAGKEPRVSESSPVISEPVLXSAHNNXTVRXVAKGENSSVQEVQ

SEQ ID NO: 13750 - DNA, 625 bp, Zea mays
  misc_feature: Ceres CLONE 1374720-F
  misc_feature: Translation starting site: 169
tggagctccccgcggtggcggccgctctagaactagtggatcccccgggctgcaggaattcgcacgagaccattacctagaacatcctaatcgaaaacgatccaacgacgacgttcgctggccgtagccaagaaggtatctcgcccaaacaaaggccgtcaagccaccatggccgtgtccggcgagaagccgccaccgccaccgccacctccaccggccacggcgtccggcggaacggcaaggaagctcatcctagcgctgcttacatgtctgtcgtcggcgctgctgtacaggcagattcagccgctaccgcccaagatccccggcacgccgggcggcccgccggtgacggcgaccaggacgaggctcagcgacggcaggtacctggcctatctgggaaccggcgtcccgagggagaaggccagcacaggctcgtcttttgtcatggggtcgactcctgcagacacgacgcgcttccgatctccacggagcttgcgcaagagctgggcgtttacatgttgtccttcgatcgccccccggtacgcgagagcgacccgcacccggccaggaccgaggagaggatcgccctcgacatcgccgaggtcggcgacaacctgcagctggg

SEQ ID NO: 13751 - DNA, 711 bp, Zea mays
  misc_feature: Ceres CLONE 1374722-F
  misc_feature: Encodes the peptide sequence at SEQ ID NO. 13752
  misc_feature (593)..(593): n is a, c, t, g, unknown, or other
  misc_feature (633)..(633): n is a, c, t, g, unknown, or other
cgcggtggcggccgctctagaactagtggatcccccgggctgcaggaattcgcacgagaccattacctagaacatcctaatcgaaaaaaaaaaaactccaaaaacgcaacacatcgcgtcgcgattcgcgagggctccccccaaccccatcaagtctggccaggtctctcccatatcgggttctcccttcctcttcctgtttccgcgcgcgagatcgccgccccgggtgggctctagatcccgatggcctcgcgccgccgcaccctgctcaaggtcatcatcctcggcgacagcggggttgggaagacgtctttgatgaaccaatatgtgaacaagaagttcagcaaccagtacaaggctacgattggggcggatttcctcaccaaggaggtgcagttcgaggacaggctcttcactctgcaaatatgggacactgctggtcaggaaaggtttcagagtcttggcgttgcattctaccggggagcagattgttgtgtcctagtctatgatgttaattctatgaaatcgtttgataatcttcacaactgggcgtgaagagtttctaattcaggcgagcccatcagatcctgaanttttccctttttgttctggtgggtaacaaagttgatgtanatggtggaaacagccggtggtggtggtcggagaaaaagcaaaaggcatggtgcgcctctaaggggaacatccgtaact

SEQ ID NO: 13752 - protein, 103 aa, Zea mays
  misc_feature: Ceres CLONE 1374722-F
  misc_feature (10)..(104): Pfam Name: Ras Pfam Description: Ras family
  misc_feature: SWISSPROT Homolog: EC 2.7.11.1 Non-specific serine/threonine protein kinase
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLHNWA

SEQ ID NO: 13753 - DNA, 663 bp, Zea mays
  misc_feature: Ceres CLONE 1374726-F
  misc_feature: Translation starting site: 196
  misc_feature (489)..(489): n is a, c, t, g, unknown, or other
  misc_feature (573)..(573): n is a, c, t, g, unknown, or other
tggagctcaccgcggtggcggccgctctagaactagtggatcccccgggctgcaggaattcgcacgagaccattacctagaacatcctaatcgaaaattcttcgatcgtggttgcgccatccctcactctcctccgaagccatcgtccacgtcccagcctccccggactctaggggcagaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaaactccggcgtcgtccgcgccaagtttaggtccaacctggcgccggaatnccatgggcgtaaggtcagggtgttcatgtaccccagcagcatctaaagataatctggatgtgtggaggaccccttttctctagnatttatcttcagctgtcccttgtaaggggttgtgttcaggttgagaagtagcaggttgagccttgctatctgagaaccatttaaggtctc

SEQ ID NO: 13754 - DNA, 704 bp, Zea mays
  misc_feature: Ceres CLONE 1374727-F
  misc_feature (513)..(513): n is a, c, t, g, unknown, or other
  misc_feature (648)..(648): n is a, c, t, g, unknown, or other
  misc_feature (670)..(670): n is a, c, t, g, unknown, or other
  misc_feature (682)..(682): n is a, c, t, g, unknown, or other
  misc_feature (696)..(696): n is a, c, t, g, unknown, or other
  misc_feature (704)..(704): n is a, c, t, g, unknown, or other
tccccgcggtggcggccgctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacgcagcggcgccagcctgcaggaagccagcccctattcgagacaaggtcgatctttgctgccttggcgagcttcagccgaatcaaggtcgagcatggcggcaggccagtaaatagagcaacacaaaacccttcaaattaatggagacctctgcagcaaccnccgacccggccgccacaccaggcggccacttccccatcgcatcggccctccgtcgtcggctgaagggctggtggaggcccagcggcgcagcgcaacatgcggcaatcagtggtcccatctgagcgcgcccaaggnaagcagtgggctggccgcccgntgggctgacggnccgtgcccacgccntcgggggn

SEQ ID NO: 13755 - DNA, 740 bp, Zea mays
  misc_feature: Ceres CLONE 1374735-F
  misc_feature (740)..(740): n is a, c, t, g, unknown, or other
aagctggagctccccgcggtggcggccgctctagaactagtggatcccccgggctgcaggaattcgcacgagaccattacctagaacatcctaatcgaaaagaacaaacatgatccgtttccttatccccttggagcagaggaggagcagcatagcataacccgggagctcgctctcgctcccacctccccctccctccccttttgaccctccctcaccagctgcaaaaccgcgggccgcatcccgcccgcgccgcccaccggcggccacagccgcctacataaaccactaatcgaccactcgccgaaccaaaccacccacccacccaaacccaatggcgtccaacctcctctccgccgcgttccgaaccctagctgcggtcgccggggccggcccccgcgggcctccgcgggcgggtgccggagcgcggcgcacctcccgcgcgggggccccgggcctgccccgccgcggagcagccgcgagctcccgaggggtcccagcggggggcgaaccaccaaggagaacccgtaaaagcgaagccccacccccaaagctcctccacgaaaaacccgaccacggcactcagggagtcggcgcgagcagcggtgccccgggggccctcaatcctcgccggcgtgccaacaccctctggtcccgaccaccgcaatcatgaggagggaagcgcgtaaacggggtggccgcctgagagcggcttatccgcccgcaaaggggaactttcn

SEQ ID NO: 13756 - DNA, 712 bp, Zea mays
  misc_feature: Ceres CLONE 1374736-F
  misc_feature: Encodes the peptide sequence at SEQ ID NO. 13757
  misc_feature (609)..(609): n is a, c, t, g, unknown, or other
tccccgcggtggcggccgctctagaactagtggatcccccgggctgcaggaattcgcacgagaccattacctagaacatcctaatcgaaaaaattcgccttcacctcgccgcttcctccttgaccgccaccgttgacgtcgtcttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctgcctgttcgccatggcgatccgcatcaccgtctcctactccggctacgtggcgcagaacctcgccgcgtcgctcggccaccgcttctcctccgcctccgcctcgggcagccgcctcctccatgacggcgcctggcgccccttctgcatcttcacctccacccgccagcccgagcagcaccgcggcagcggcagcgaccgccatgacggaggcgactacaaccacccgaagccccaggccatcgccgccggagctcactcgttgctgctcacgcgtgcgtgcttatcgtccaagncgccgccgcgtcttcttggccgtgggggctgctctcgggcttgcggcagaggacgggaccgacgctggaaccacccgggatcggcggttctctctcgggttcg

SEQ ID NO: 13757 - protein, 128 aa, Zea mays
  misc_feature: Ceres CLONE 1374736-F
  misc_feature (95)..(95): Xaa is any aa, unknown, or other
MAIRITVSYSGYVAQNLAASLGHRFSSASASGSRLLHDGAWRPFCIFTSTRQPEQHRGSGSDRHDGGDYNHPKPQAIAAGAHSLLLTRACLSSKXPPRLLGRGGCSRACGRGRDRRWNHPGSAVLSRV

SEQ ID NO: 13758 - DNA, 722 bp, Zea mays
  misc_feature: Ceres CLONE 1374738-F
  misc_feature (481)..(481): n is a, c, t, g, unknown, or other
ggagctccccgcggtggcggccgctctagaactagtggatcccccgggctgcaggaattcgcacgagaccattacctagaacatcctaatcgaaaaccgcagttcccacccaccaaaccaaactctcctccacaaccacaacctcccccgccgcccctcctcttctcggcttctcccctgccttgttcggccccaaaacggcaagagccgacgccagcaaaccctcgggttcgggagggaaggaaggcacgagcagtgcggctgcctacccgcagctaaccccaaacagcaacgtcgtagccgacgagagcctccgccacctacccaccaactcccgcccgtcgtcgcctccgcttgggttctcgtcgagcagttggtgggcacctaccgcatccagccacagagagagagtgagccactgagccagggcggcaagggggagatgaagaagctgtaccagggcgaaaggggggcggcgggntgcacccggcgccggctgacgcatcggcagccgtggcgctgccggccgccgtgctggccctggcgtccgcgctgacggccgaggagcaggaggtgctggcctacctcctggtcctgcggcggtggccggcaccaccacggccacgggcgccgccggggaggccaccccccggaaatgggctggacctggctgcgactgttacaaaagcttctgggcaggctgggagcctcgccccaacgca

SEQ ID NO: 13759 - DNA, 703 bp, Zea mays
  misc_feature: Ceres CLONE 1374743-F
cgctctagaactagtggatcccccgggctgcaggaattcgcacgagaccattacctagaacatcctaatcgaaaagatctaggccgaggcctctcctactggatctccctcgctctcgtcgcctcggtcggttcgccttcgcccggcccggcccgaggagagggcagccctattcggagctgggagggcggacccgaaacagcagcagcagcagcagcaggaggagccccggaagggggagagggaaacccccgggggggggaaaaaagtgcaagcccttttttaaagggggggggcccctgggaaggtcccggaccgggggttttcccacccatttaaaaggggcaaagggggggggaaccccgggggggagggggtctttcttggggggggcccaaaaagaaaataagttttttaaaagaagggggggggccccctctttttttaaaaaggggggggtttccccccccccttttttgtttggggaggaaggagcgtggaaaagaaacgggggggggcgcggggggggccctttttggggggggaacccaaaaaaaaacacgtgggaaaaaaaaagggggggggggggtttttgtctccttttttttaaaaaaagagttttttgtggtgggggggccgcggggccgaaaaaaaaggggttgggtgttgctaaaccccccccgctggttgggggggggtggaa

SEQ ID NO: 13760 - DNA, 694 bp, Zea mays
  misc_feature: Ceres CLONE 1374745-F
  misc_feature: Encodes the peptide sequence at SEQ ID NO. 13761
  misc_feature (521)..(521): n is a, c, t, g, unknown, or other
  misc_feature (601)..(601): n is a, c, t, g, unknown, or other
gctctagaactagtggatcccccgggctgcaggaattcgcacgagaccattacctagaacatcctaatagaaaaatcggcctcagtcgcacatatctactatactatactctaggaagcaaggacaccaccgccatggcagccaagatgcttgcattgttcgctctcttagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttncacccaatggccatgacgattccacccatgttcttacagcaaccctttgttggtgctgcattctagatagaaatatttgntgtgtaccgaaataatgagtgacatgccatcgcgtgtgactcattattaacataaaacagtttcccctctatatctttttatatctcaaaaaa

SEQ ID NO: 13761 - protein, 150 aa, Zea mays
  misc_feature: Ceres CLONE 1374745-F
  misc_feature (129)..(129): Xaa is any aa, unknown, or other
MAAKMLALFALLALCASATSATHIPGHLPPVMPLGTMNPCMQYCMMQQGLASLMACPSLMLQQLLALPLQTMPVMMPQMMTPNMMSPLMMPSMMSPMVLPSMMSQMMMPQCHCDAVSQIMLQQQLPFMXHPMAMTIPPMFLQQPFVGAAF

SEQ ID NO: 13762 - DNA, 769 bp, Zea mays
  misc_feature: Ceres CLONE 1374746-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
nnnnnnnnnnnnnnnnnnnncccaccccaanntanccgagcttcctttacaaagctggagctccccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggccaccgactcctcctcctcctcctcctcctcgccggggggggcgccgctgtcctccatcggccgctccatccgctcgctccgccgggaccaggaaccagatccactccttcccgccgccgccagacgccacagaccgccttccagcgccggggccgggccaactccttggccgacctcccggaagccggacgacgtccttctcccctcgccctgggacgggcccgcctccctcgaattcctttcctccttctgcctaggagggagttcccggggccctggctcttcgggctcccggggactccgccccggcttggtcgggcccccggcttcgaaccgcctttggtcgcccgaaattcttccgaaccggggcccggtaaaagggggttccgaacctccttggaaacggcctggcccggcgagacgggcctttcc

SEQ ID NO: 13763 - DNA, 635 bp, Zea mays
  misc_feature: Ceres CLONE 1374748-F
  misc_feature: Encodes the peptide sequence at SEQ ID NO. 13764
  misc_feature (371)..(371): n is a, c, t, g, unknown, or other
  misc_feature (372)..(372): n is a, c, t, g, unknown, or other
  misc_feature (425)..(425): n is a, c, t, g, unknown, or other
  misc_feature (530)..(530): n is a, c, t, g, unknown, or other
  misc_feature (537)..(537): n is a, c, t, g, unknown, or other
tccccgcggtggcggccgctctagaactagtggatcccccgggctgcaggaattcgccgagaccattacctagaacatcctaatcgaaaaccaagggccaaggcagggcactgcactgcacgcatgcactgacctgacgacgacgcgcgccacagtccacagctccacactcagacatggcgatgggcgccgcttccatcctactgatgatggtttcgctggaggccctgcttctcgccgccgccgccggcgccggcgggaccatccgtctgcccagcgatgtcggaggcgttgctgcagaccttgtcacggcgatggcgagggcgagggcaagggcaaagcatcagcttcgcgacgaggagaggccgtgnngggaatgctgcgacttggccgtatgcgtcaagacgtacccgctaacttgctcngtgctcgatcggggtgagcgctgctccgacgccttaaaggagtgcgtggaaaacgagactcgcgccacgtctgcgtcaacgggaacggggcgaccccgggccagntggccanaacgaagacggaaaggaaggggggaccggttaaaaaaaactttgggggaaacgcacccccacggggggggtgggaaaaaaaaaaaaaggggggggggc

SEQ ID NO: 13764 - protein, 153 aa, Zea mays
  misc_feature: Ceres CLONE 1374748-F
  misc_feature (65)..(65): Xaa is any aa, unknown, or other
  misc_feature (66)..(66): Xaa is any aa, unknown, or other
  misc_feature (118)..(118): Xaa is any aa, unknown, or other
  misc_feature (121)..(121): Xaa is any aa, unknown, or other
MAMGAASILLMMVSLEALLLAAAAGAGGTIRLPSDVGGVAADLVTAMARARARAKHQLRDEERPXXECCDLAVCVKTYPLTCSVLDRGERCSDALKECVENETRATSASTGTGRPRAXWPXRRRKGRGDRLKKTLGETHPHGGGGKKKKRGGG

SEQ ID NO: 13765 - DNA, 737 bp, Zea mays
  misc_feature: Ceres CLONE 1374758-F
  misc_feature: Encodes the peptide sequence at SEQ ID NO. 13766
  misc_feature (671)..(671): n is a, c, t, g, unknown, or other
  misc_feature (695)..(695): n is a, c, t, g, unknown, or other
tccccgcggtggcggccgctctagaactagtggatcccccgggctgcaggaattcgcacgagaccattacctagaacatcctaatcgaaaaatcacaattcacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagaagacgcgcatcgtcccgcgacacttgctcctggcgattcgtaacgacgttgagctcggcaagctgctgtctggcgtcaccatcgcgcacggcggtgtcctccccaacatcaacccggttctcctgcccaagaaggtggaaggagaggcgtccagcggcggcagcaaggagagcaagtcccctaagaaggccgccaagtcccccaagaaggcagcaagtcccccgaagaaggctagaaantagtcacttcctagcgctctgcgnaagcatggttcctgtttagatctggggaaaacttatgtgtcc

SEQ ID NO: 13766 - protein, 165 aa, Zea mays
  misc_feature: Ceres CLONE 1374758-F
  misc_feature (29)..(102): Pfam Name: Histone Pfam Description: Core histone H2A/H2B/H3/H4
MDASGAGSKAKKGAAGRKAGGPRKKSVSRSVKAGLQFPVGRIGRYLKKGRYAQRVGTGAPVYLAAVLEYLAAEVLELAGNAAKDNKKTRIVPRHLLLAIRNDVELGKLLSGVTIAHGGVLPNINPVLLPKKVEGEASSGGSKESKSPKKAAKSPKKAASPPKKAR

SEQ ID NO: 13767 - DNA, 703 bp, Zea mays
  misc_feature: Ceres CLONE 1374764-F
  misc_feature: Encodes the peptide sequence at SEQ ID NO. 13768
  misc_feature (650)..(650): n is a, c, t, g, unknown, or other
tccccgcggtggcggccgctctagaactagtggatcccccgggctgcaggaattcgcacgagaccattacctagaacatcctaatcgaaaaatcgtcgtctttttttcggccctacttctgtctgactgtctccacggctgccgacgagccgcgcaaccgaactcattgcacgaggactcgcacagatcggtgagcgagcaagcgagagatggctgggaggctaaccgcggcagggtcccgcatcctgggcggcggcggcgcacgcgccgcggcttccgccctccgacaccgcgccggcatgggcctccccgtcggccgccacatcgtccccgacaagcccctccccgtgaacgacgagttggtatgggataacggcacgcccttcccggaaccctgcatcgaccgccttgccccgcacatcggcaagtacgaggcgttggcgtggctgtgcggagggctagggttcttcgctgccctcggtatggctgctgttgtgaacgacaaggcctccaatataccatatactcccaaagtctacccgtacgacaacttgagagctgagcttggtgaagaccataggaaaggttttttgtctgtttgacaggcactttgatgaatatgatctgagatctatatctcctttcatcanagaggagcagggggaactattttacccatgggttttttttgtgactggcctgt

SEQ ID NO: 13768 - protein, 130 aa, Zea mays
  misc_feature: Ceres CLONE 1374764-F
MAGRLTAAGSRILGGGGARAAASALRHRAGMGLPVGRHIVPDKPLPVNDELVWDNGTPFPEPCIDRLAPHIGKYEALAWLCGGLGFFAALGMAAVVNDKASNIPYTPKVYPYDNLRAELGEDHRKGFLSV

SEQ ID NO: 13769 - DNA, 747 bp, Zea mays
  misc_feature: Ceres CLONE 1374766-F
  misc_feature: Encodes the peptide sequence at SEQ ID NO. 13770
  misc_feature (387)..(387): n is a, c, t, g, unknown, or other
  misc_feature (392)..(392): n is a, c, t, g, unknown, or other
  misc_feature (434)..(434): n is a, c, t, g, unknown, or other
  misc_feature (502)..(502): n is a, c, t, g, unknown, or other
  misc_feature (506)..(506): n is a, c, t, g, unknown, or other
  misc_feature (526)..(526): n is a, c, t, g, unknown, or other
tccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgttgntcggngcttggcgctgacggcctccgtggggtggggctggccgtggnccacgcccggtgttcctgatctttcagccccgtggctggtccccgccgcgctggctcatcgggacggnccgntcatgggggtccctcacgtncgggcgcgctggggggctcggggggcctgtccctcgctcacgtgcctcgccaacacgggcgcggcaggcgttccagcgcaccccggactaccgtggaggaggcgcaccgccaggatggcggaggccgcggcgcacgcggcccacaagaccgcgcaggcagggcagccatccagggcaaggcgccaggaggcggccccccggggaggggcaggggcccgccc

SEQ ID NO: 13770 - protein, 69 aa, Zea mays
  misc_feature: Ceres CLONE 1374766-F
  misc_feature (65)..(65): Xaa is any aa, unknown, or other
MADRDRSGIYGGAHATYGQQQQQGGGGRPMGEQVKGMLHDKGPTASQALTVATLFPLGGLLLVLXGAWR

SEQ ID NO: 13771 - DNA, 672 bp, Zea mays
  misc_feature: Ceres CLONE 1374767-F
ccccgcggtggcggccgctctagaactagtggatcccccgggctgcaggaattcgcacgagaccattacctagaacatcctaatcgaaaaatcaaccatattattgagaccatcaagcaacatagaacgtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctagctctgatcaaccaagtagctctggcaaacctttctccctactctcagcaacaacaatttcttccattgcaacggactgtctacactggaaccctggctgctttatttccaggcaaccacttatttacccttttagcccggttgggtttgtgggcgaacaccctcgaaaaaaaaaaaaaattttttttttttttaaaaaaaaacaggggggggg

SEQ ID NO: 13772 - DNA, 741 bp, Zea mays
  misc_feature: Ceres CLONE 1374770-F
  misc_feature: Encodes the peptide sequence at SEQ ID NO. 13773
  misc_feature (590)..(590): n is a, c, t, g, unknown, or other
  misc_feature (591)..(591): n is a, c, t, g, unknown, or other
acccgcggtggcggccgctctagaactagtggatcccccgggctgcaggaattcgcacgagaccattacctagaacatcctaatcgaaaaaaaaaaaaaagttgtgcggagcttcaggctaggtttcgtctttttccgttcacaggcggccgacggtgttcggtgcccctctcctgccaaacgatcccgagcagtgccaccggtgcgggcgtgcataggaagcggccggtgcacagtagaggatgcggtggttgacacgcgctgctaaacgcgcaggtgagatggcgttcaacgccggtggtggagccgtcaactggttcccggtacacatggccgcggcctcccgcgccatccgcgatcgtctcatgctcgccgacctcatcatcgaggtccgcgacgcccgcattccattatcctcagcaaatgaagaccttcaaccagtgctctcagcatagaggcgaattcttgctctaaacaagaaggatctagcaaaccccaacataatgaataggtggctgaatcattctgaatcatgcaagcaggattgcatctcaataatgcacatcagctccagatctgataccagcttnncttggttttgctgatctgcaactacaagaagtactctcataggagccaaccctgctgattatggctcgctgctgatcctaatggtcgcaagtcacgactcataaactccattcatgcagtagctactgctcgattctcagcgaaagataa

SEQ ID NO: 13773 - protein, 70 aa, Zea mays
  misc_feature: Ceres CLONE 1374770-F
MRWLTRAAKRAGEMAFNAGGGAVNWFPVHMAAASRAIRDRLMLADLIIEVRDARIPLSSANEDLQPVLSA

SEQ ID NO: 13774 - DNA, 729 bp, Zea mays
  misc_feature: Ceres CLONE 1374771-F
  misc_feature: Encodes the peptide sequence at SEQ ID NO. 13775
  misc_feature (415)..(415): n is a, c, t, g, unknown, or other
  misc_feature (480)..(480): n is a, c, t, g, unknown, or other
  misc_feature (511)..(511): n is a, c, t, g, unknown, or other
  misc_feature (520)..(520): n is a, c, t, g, unknown, or other
  misc_feature (543)..(543): n is a, c, t, g, unknown, or other
  misc_feature (544)..(544): n is a, c, t, g, unknown, or other
gctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctgggcgtgccggccgcggtgtgggcgggcggcgccaacgcgcccatgtcagcggccgacctcctcccgccgggccaccgggacccgtccgtccttggagcggctgctccgcctgctngcgtccccgcggcgttttctccgagtccaccgagtccacgcccaccaacgcggcggcggctattncgcgctcaccgcggtgggccgcacccctggntgccggggncccgcctcgggcgcgtcctacgnncgactacgtgctgcagcaccaccaagacgcgctggttgggcggcgtgtccccgcctggcacgaggcgtgctttgaccccggcggggcccgagccgttcgggcgcgacaaacgccggggtcaccgcctacgcctacttagggaaggaccagtacgccaaacgggtcatgctcggcgccattgcggt

SEQ ID NO: 13775 - protein, 191 aa, Zea mays
  misc_feature: Ceres CLONE 1374771-F
  misc_feature (87)..(87): Xaa is any aa, unknown, or other
  misc_feature (108)..(108): Xaa is any aa, unknown, or other
  misc_feature (119)..(119): Xaa is any aa, unknown, or other
  misc_feature (122)..(122): Xaa is any aa, unknown, or other
  misc_feature (130)..(130): Xaa is any aa, unknown, or other
MPPPSANGATAAAAAARDDMSPAEARLAMMELANMVSVPMALAAVIRLGVPAAVWAGGANAPMSAADLLPPGHRDPSVLGAAAPPAXVPAAFSPSPPSPRPPTRRRLXRAHRGGPHPWXPGXRLGRVLRXTTCCSTTKTRWLGGVSPPGTRRALTPAGPEPFGRDKRRGHRLRLLREGPVRQTGHARRHCG

SEQ ID NO: 13776 - DNA, 667 bp, Zea mays
  misc_feature: Ceres CLONE 1374774-F
  misc_feature (451)..(451): n is a, c, t, g, unknown, or other
  misc_feature (480)..(480): n is a, c, t, g, unknown, or other
  misc_feature (513)..(513): n is a, c, t, g, unknown, or other
  misc_feature (667)..(667): n is a, c, t, g, unknown, or other
gctctagaactagtggatcccccgggctgcaggaattcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctgaaacctgaaccacttcatcaacgggcagaccaactaccccggcgtggnccgcaacggcgcgacgttctacttcctgntgttcgccatcctggccggcggtgtgggcgcgncgcccaagctggcgggcgtgcaccacgtgcgcgccctggcgccacgacagcctggccaccaacgccgcgtcgtcgctcatcgcctgggccatcacgggcgctcgcctttcgggctggccttgcaagggaaatccacatcgggcggacaccgcgn

SEQ ID NO: 13777 - DNA, 472 bp, Zea mays
  misc_feature: Ceres CLONE 1374779-F
  misc_feature (250)..(250): n is a, c, t, g, unknown, or other
gctcagaactagtggatcccccgggctgaggaattccacgagacattacctagaacatcctaatcgaaaaaaaacaagaccaccgcaccatggaatcgctgacgcttcgcgcttcgacggccgcctcgccgctgcagcgacggccggctgcttccccgggagggcaggggggggaggtaactgccgggccacgggcttccgggcgggggaagccggggacctttctcccctggggggcgggaaaaggggnttttgaaatggcccaacccgtttgggatggggtggggggcaccgggaaaaaaataaaccggtatgaaaagcgcccttcagaaagggggggggggggcccttcttcccaaaaaagggggctttggggggctaaaaaaaaatttttacgggtttccccctcttattaaaaaattttttgagaaaaaaaaaaaaggggggtcccacggggggggcatttttttgg

SEQ ID NO: 13778 - DNA, 670 bp, Zea mays
  misc_feature: Ceres CLONE 1374780-F
  misc_feature: Translation starting site: 338
  misc_feature (194)..(194): n is a, c, t, g, unknown, or other
ggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattacntgcagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccgaaatgggcaggaccatggtggcgccgctcctggtgctcaacctcatcatgtacatcatcgtcatcgggctcgcgagctggaacctgaccacttcatcaacgggcagaccacctaccccggcgtgcccggaaacggcgcgaccgtctacttcctggggttccgcatcctgcccggcgtgttgggccccgcttccaagttgggggggggtgcacacgtggccggcctggggccacaacagcttgggcaccaacgccgggtcgtcccttattccctgggccatcacggggctcccctttcggttggcctgaagggagacccacatccgg

SEQ ID NO: 13779 - DNA, 648 bp, Zea mays
  misc_feature: Ceres CLONE 1374788-F
  misc_feature: Encodes the peptide sequence at SEQ ID NO. 13780
tgagggaattcgcacgagaccattacctagaacatcctaatcgaaaaatacgaggcctggcctaccacctgcgacaaaccagtcaccgcctaccaccgttttataatccacccctcccactccccctgttttttcttcttccgctgttctactccggcgtgttggtcgacggcggcgcagatgacgaccctcgatctgatgggagggtacgggcgggtggacgagcaggtggccatccaggaggccgccacgccggggctgcgcggaatggaacgtctcatcttgcaactctcccaggctggcacccggggagccgtctttgcccccaccggggttacaggcgcaacgccagcagcagaaacagcttgaacacatccagcaagaaggttgactgccggggagctcacggaaaatgacgggggcccaagttcaagaagggggatcctccttcctgaaaccggacgggggcaacgccgggttcccgccggggccccccgggcgggggcggtcccaattcccagagccgagggaacctggcctccccccgagccccgggaaatcgggggcgcgtctcccgcgcgcggaggcccccctgaaccttggactttccccaaggccgggggtccgggtaacagaagggaactcccg

SEQ ID NO: 13780 - protein, 62 aa, Zea mays
  misc_feature: Ceres CLONE 1374788-F
MTTLDLMGGYGRVDEQVAIQEAATPGLRGMERLILQLSQAGTRGAVFAPTGVTGATPAAETA

SEQ ID NO: 13781 - DNA, 688 bp, Zea mays
  misc_feature: Ceres CLONE 1374791-F
  misc_feature (223)..(223): n is a, c, t, g, unknown, or other
  misc_feature (279)..(279): n is a, c, t, g, unknown, or other
  misc_feature (348)..(348): n is a, c, t, g, unknown, or other
  misc_feature (523)..(523): n is a, c, t, g, unknown, or other
  misc_feature (525)..(525): n is a, c, t, g, unknown, or other
ggagctccccgcggtggcggccgctctagaatagtggatcccccgggctgcaggaattcgcacgagaccattacctagaacatcctaatcgaaaatcgatcgtcaatgcaagtttgtccattcgcattggtctgaatactgtagctactagcgcgagtgccactgtgccgcagctgcctgctcgccattactgcaagctgtgttcaatcaaaagctaaattangctccctctacatctgatccagctaagtagctagccagcactacagagggccgtgncaagaatcaggagagagatagcaggggggctagctagctgagctcgtgcgacaaagaatggccgaattngcaggaacatggtggcgccgctctggtgctcacctcatcatgtaatcatcgtcatcggcttcgcgagcttgaaccctgaaacacttcatcaacggcagaccactaccccggggtgccggaacggggcgacgtctacttcctggtggtcccatcctggccggggtggtgggcccgncntccaaacttggggggcgtgcaccacgtggcgcggctgggcgccacgaaagcctgggccaaccaacgccggggtgtccgttcaatcggctggggcacatcacgggggcttcccttttcgggttgggcctggaaaggaaaaatccacattcggggggaacaccgg

SEQ ID NO: 13782 - DNA, 678 bp, Zea mays
  misc_feature: Ceres CLONE 1374796-F
  misc_feature: Encodes the peptide sequence at SEQ ID NO. 13783
  misc_feature (308)..(308): n is a, c, t, g, unknown, or other
  misc_feature (320)..(320): n is a, c, t, g, unknown, or other
  misc_feature (372)..(372): n is a, c, t, g, unknown, or other
aaagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctcccgtcacatcgggcaggccggcatccaagtcngcaacgcgtgcntgggactttactgcctcgagcacggcatccagcctgatggccaagtgcctgnagataggacgcgggacatcacgatgaatgcttcagcaccttcttcagccaaattgtggctggaagcacctttcccggggaatttttcgttgatctaaaacccattggaaccatggagggggcactggaactaccccccggtcttcccccccggagaggttttccagggggaagggggaggcccctaaaaaatttcccccggggcccaacaacaaatttggaaaggaaattggttatttggggcccttaacccaaaccccaaaattttgttgagaaaattggccccggcctctccgggggtttctgg

SEQ ID NO: 13783 - protein, 69 aa, Zea mays
  misc_feature: Ceres CLONE 1374796-F
  misc_feature (17)..(17): Xaa is any aa, unknown, or other
  misc_feature (21)..(21): Xaa is any aa, unknown, or other
  misc_feature (38)..(38): Xaa is any aa, unknown, or other
MRECISRHIGQAGIQVXNACXGLYCLEHGIQPDGQVPXDRTRDITMNASAPSSAKLWLEAPFPGNFSLI

SEQ ID NO: 13784 - DNA, 691 bp, Zea mays
  misc_feature: Ceres CLONE 1374797-F
  misc_feature (329)..(329): n is a, c, t, g, unknown, or other
aagctggagctccccgcggtggcggccgctctagaactagtggatcccccgggctgcaggaattcgcacgagaccattacctagaacatcctaatcgaaaaaattaacctctctccttcctcgccccttcccctccacgactccactaccaccaccttcaccttgtctcccacaaccgccgcgcgcaagccctagcccgatctcgccggcgacagacaccagatctcgccgcccgttgcgcgccgatacgcgccccgccggattcaccgctcctcgcgctgcagcacgcccgggcctgggttactgcgtgacatgtagtattgtataanttggaggttgtcaccatcaccacaaagcatatgttgtgatttgtcgatggcgaggagatgaaacaggtgtaggggcggagcagcaaggacatgacagccatgccgcatccgcgccaccgaggcgctgctaagaagcccatgtggatcatagtgctattgtcttttggtttgtgttgcacttatgggggcctatgtctacccaccacggcgctactccgcatgctacttctttggcttccagtgtctgtactccgttcaagggatggctacctgctgttgctcgggagcggactgatgaagagaagttttcatcggtggggtaatagggatcttctttccatccctatggctatgtcaaggaa

SEQ ID NO: 13785 - DNA, 731 bp, Zea mays
  misc_feature: Ceres CLONE 1374802-F
  misc_feature: Encodes the peptide sequence at SEQ ID NO. 13786
  misc_feature (485)..(485): n is a, c, t, g, unknown, or other
ggagctccccgcggtggcggccgctctagaactagtggatcccccgggctgcaggaattcgcacgagaccattacctagaacatcctaatcgaaaaactctattcccattccaagcccccgctctcggattcccgacgacgagctcagagctcctcctctcctcccctgctcggtgttcgacgcaacagctgccgccatgtctgccgccaaccagctcgccgccctcttcagcaacatgtacgccacgggtttgcttgacgatcagttccagcagctccagatgctccagaacgccagtactcctgacttcgtctccgaggtcgtcacgctcttctgccaggacggcgagcggatcatcggagagctggccaaactgctggagaagcccaacgtggattttgacagggttgacgcctttgtgcatcagctcaaaggaagcagtgcaagtattggtgctcagaaggttaagaacacttgcattcangtccgcgaatcctgtcagcagaagagcaaaagatggtgcctcaagacactggagacagtgaagattaacttctatgacctgcgtgacaagtttcagaacatgcttcagctgcagcgtcaggtcaatggctgtccccccagcaagtgaaacagatgtggagtggagcttcatgttgggatgatgcgtgcatctttcaagtccagaacattctgaatagctccctcatggcttctagaaagctgtata

SEQ ID NO: 13786 - protein, 144 aa, Zea mays
  misc_feature: Ceres CLONE 1374802-F
  misc_feature (41)..(126): Pfam Name: Hpt Pfam Description: Hpt domain
  misc_feature (96)..(96): Xaa is any aa, unknown, or other
MSAANQLAALFSNMYATGLLDDQFQQLQMLQNASTPDFVSEVVTLFCQDGERIIGELAKLLEKPNVDFDRVDAFVHQLKGSSASIGAQKVKNTCIXVRESCQQKSKRWCLKTLETVKINFYDLRDKFQNMLQLQRQVNGCPPSK

SEQ ID NO: 13787 - DNA, 652 bp, Zea mays
  misc_feature: Ceres CLONE 1374803-F
  misc_feature: Encodes the peptide sequence at SEQ ID NO. 13788
  misc_feature (343)..(343): n is a, c, t, g, unknown, or other
gctctagaactagtggatcccccgggctgcaggaattcgcacgagaccattacctagaacatcctaatcgaaaaaagcaggcggggcgagcgagcccagcaggcgtctctcctctcgtccatccgtttcctcctccccctgcttcccggctcgcctccctcccctccctgtgcgcctcttttcatgcgcgaggagggaccgtggggaccaccaccaccagcaccaccacctccatccgtgcgcctctcgctctcgctggtggtgctcctcctcctcctcctgctcccggggcgggcggcctccttttccacctcctgctggtgccagggccgggagggcgtcncggaggtggcgcgcatggggctcgccggggacgggtcggcggacaccgcccacctcagtaataatgaaaaatggggcggttcatttatggaagttgggagtttctcctggtaaaagagcatcgatgggaggacttctatgagggaaagaataaacgacgttgatggagagaaaatgggaatgtttggggtatatgatgggcatggaaggaatccgagcagttggatatgttaagcagcaccttttcagaattttatcaaaacccccaaagtcatcactgataccaagggttggtattccccaaacttaa

SEQ ID NO: 13788 - protein, 90 aa, Zea mays
  misc_feature: Ceres CLONE 1374803-F
  misc_feature (54)..(54): Xaa is any aa, unknown, or other
MREEGPWGPPPPAPPPPSVRLSLSLVVLLLLLLLPGRAASFSTSCWCQGREGVXEVARMGLAGDGSADTAHLSNNEKWGGSFMEVGSFSW

SEQ ID NO: 13789 - DNA, 700 bp, Zea mays
  misc_feature: Ceres CLONE 1374805-F
  misc_feature: Encodes the peptide sequence at SEQ ID NO. 13790
  misc_feature (550)..(550): n is a, c, t, g, unknown, or other
  misc_feature (554)..(554): n is a, c, t, g, unknown, or other
  misc_feature (619)..(619): n is a, c, t, g, unknown, or other
  misc_feature (653)..(653): n is a, c, t, g, unknown, or other
tacccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagaccccagagtgcatgangcgntgccgccgccgcggactggccgtcgacatggagcaagagtacggtcgcggcagcgagagcgcggncagtgccccggagagtgcgagcgcacaccgccgngactggtggagagcacctgcgggtaaaaaaaagaaagggggggggga

SEQ ID NO: 13790 - protein, 165 aa, Zea mays
  misc_feature: Ceres CLONE 1374805-F
  misc_feature (116)..(116): Xaa is any aa, unknown, or other
  misc_feature (139)..(139): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETPECMXRCRRRGLAVDMEQEYGRGSESAXSAPESASAHRRDWWRAPAGKKKKGGG

SEQ ID NO: 13791 - DNA, 744 bp, Zea mays
  misc_feature: Ceres CLONE 1374817-R
  misc_feature (1)..(1): n is a, c, t, g, unknown, or other
  misc_feature (507)..(507): n is a, c, t, g, unknown, or other
  misc_feature (569)..(569): n is a, c, t, g, unknown, or other
ncgattgggtaccgggccccccctcgaggtcgacggtatcgataagcttttttttttttttttttggcagcaaaaaaaaaaaaaatcacactaaaaaactttatagcatagagttgatagttgcaagcaacagaatcaagaatcttcaaagtctcccctctggttttgagatgaagaaactacacaaacccgagaagtaaaaaactggagcttagtagatatactccatggtgttatctatttctgcagctgtattctcttatccctgataggcagatcaagtggcttctgtgcctcgtgaggatggtctgggcctttgtacaccttcaggtgattgaacagagctctcccaagccgtccctttgggagcattccacgaacagcatgctcaatgattctctcagggattctctgctgcaactgatcaaagggtttcactgtcatgccgccaggtcgtcctgaatgcctcctgtacagcttttggttcctttttctttcagacacagncactttctcagcattcaccacaatgaccaaggctcccatgtcgacacttggaagtgtagaanggcaaggttcttcccacgaatgtggattagcaatggtttgatgctaaaccttcccagattcttggccggttgcatcgaaccaatacccagggcttgttcctgggtccccatggtctgaagcctttgggaaccaggtttgggttccaagaggtacggggccttttgctttctcttt

SEQ ID NO: 13792 - DNA, 731 bp, Zea mays
  misc_feature: Ceres CLONE 1374818-F
  misc_feature: Encodes the peptide sequence at SEQ ID NO. 13793
  misc_feature (671)..(671): n is a, c, t, g, unknown, or other
  misc_feature (697)..(697): n is a, c, t, g, unknown, or other
  misc_feature (698)..(698): n is a, c, t, g, unknown, or other
  misc_feature (702)..(702): n is a, c, t, g, unknown, or other
aaagctggagctccccgcggtggcggccgctctagaactagtggatcccccgggctgcaggaattcgcacgagaccattacctagaacatcctaatcgaaaaacgaagagcagcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatagggttgctaccgtgcagtgcctatcgggtactggttctttaagagtcggaggtgaatttcttggcaggcactatcacgagcgcactatctacatcccacaaccaacctggggaaatcacccaaaagtcttcaccctatctgggcttgaacgttaggagctaccgctattatgatccctgcacatgcagccttcacttcgaagactctggnaagaccctcggtctgctcctcccagnntcantgtactgctgcatgctgtgctccacccta

SEQ ID NO: 13793 - protein, 152 aa, Zea mays
  misc_feature: Ceres CLONE 1374818-F
  misc_feature: SWISSPROT Homolog: EC 2.6.1.1 Aspartate transaminase
MASQGSSVFAALEQAPEDPILGVTVAYNKDPSPVKVNLGVGAYRTEEGKPLVLNVVRRAEQMLINNPSRVKEYLPITGLAEFNKLSAKLIFGADSPAIQENRVATVQCLSGTGSLRVGGEFLGRHYHERTIYIPQPTWGNHPKVFTLSGLER

SEQ ID NO: 13794 - DNA, 650 bp, Zea mays
  misc_feature: Ceres CLONE 1374822-F
  misc_feature: Translation starting site: 190
  misc_feature (274)..(274): n is a, c, t, g, unknown, or other
  misc_feature (288)..(288): n is a, c, t, g, unknown, or other
  misc_feature (357)..(357): n is a, c, t, g, unknown, or other
  misc_feature (650)..(650): n is a, c, t, g, unknown, or other
tggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgnctgaacgactaccntcgctgtgaacgcgacgaagcacgcgatgtacctgccgcacaccgcggggcgttactcccagaagcggntccgcaaggcgcagtgcccgatcgtcaagcgcctcacaaactccctcatgatgcacgggcgcaacaacggcaagaaggtcatgggctggccggcatcatcaaagcataccccgggagaacattccccctggctcccggatggccaaccccatcccggggcggcggcgaaccgaattatcaacagggggaacccgggggggaggcccccccgattggttccccctggggggtttttagaggagaagaaacaccccctgggataaacccccccccccgtggaggggggggggaan

SEQ ID NO: 13795 - DNA, 698 bp, Zea mays
  misc_feature: Ceres CLONE 1374824-F
  misc_feature: Encodes the peptide sequence at SEQ ID NO. 13796
  misc_feature (610)..(610): n is a, c, t, g, unknown, or other
tccccgcggtggcggccgctctagaactagtggatcccccgggctgcaggaattcgcacgagaccattacctagaacatcctaatcgaaaaatggtcacgctagctgtagctttttgcagagcgtcgtctgtaaatacgtagcccttccacaagcgaggcaaggggggagagagtatcgtcagctagcagagagagtgcgtagcaactagcaatggcggagaaccctgctccgagttccccgctagtgacttctcccgacgccgctgcgccgcctctgccagcggagttcaccaagctcaccttccgtagcctgtacatccgtcggacaggtccaggcagccgggagatgactgtggacgggaggccgtctgaccagctgggacgacggttcgtgagcgactttcccatatacgatggccgtggctccggcgcccacctcgtcgctcgcttgcagggagtcactgtccaaatcggcagctcgcaccagctagtcagcatcgtcttcgaggccgagaggcttaagggctccacgctgctcaccaacggagtgataacggatgggtcagacgagtgggccatctacggtggcaccggggtggttcgcatggncaccggtgtcatacgaagaaggttctcggcggtagcacgacgggactctgatgactacccagcatcgaagtttctgggccggcgtttg

SEQ ID NO: 13796 - protein, 162 aa, Zea mays
  misc_feature: Ceres CLONE 1374824-F
  misc_feature (133)..(133): Xaa is any aa, unknown, or other
MAENPAPSSPLVTSPDAAAPPLPAEFTKLTFRSLYIRRTGPGSREMTVDGRPSDQLGRRFVSDFPIYDGRGSGAHLVARLQGVTVQIGSSHQLVSIVFEAERLKGSTLLTNGVITDGSDEWAIYGGTGVVRMXTGVIRRRFSAVARRDSDDYPASKFLGRRL

SEQ ID NO: 13797 - DNA, 699 bp, Zea mays
  misc_feature: Ceres CLONE 1374825-F
  misc_feature: Encodes the peptide sequence at SEQ ID NO. 13798
  misc_feature (543)..(543): n is a, c, t, g, unknown, or other
  misc_feature (569)..(569): n is a, c, t, g, unknown, or other
  misc_feature (699)..(699): n is a, c, t, g, unknown, or other
tggcggccgctctagaactagtggatcccccgggctgcaggaattcgcacgagaccattacctagaacatcctaatcgaaaacgaacacaccagaccagctcatcatcacattcgcatacatctcttctagcacgcaaagatcgagctatagctagctctgcaaccagagacaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgagaaggcaagcaagcgtgacgccgagacggcgcccccggcagccaaggcgcccgtggtgggttggccgccgtttgagtcgtaccggaagagctgcttccagcaggccagcagcaagcaggcggcggcggacaaaacagaggcggcgcnggcggcggcgccccccggctgcacgncatcgtcagcagccgccaccaacaccagcagctgcagcagcgccgccgttgtcgtcggctccctcgtcaaaggagcatggacggcgccccgtaattgaggaagtggacctgaggatgacacggggctacn

SEQ ID NO: 13798 - protein, 145 aa, Zea mays
  misc_feature: Ceres CLONE 1374825-F
  misc_feature (7)..(143): Pfam Name: AUX_IAA Pfam Description: AUX/IAA family
  misc_feature (105)..(105): Xaa is any aa, unknown, or other
  misc_feature (114)..(114): Xaa is any aa, unknown, or other
METVVGDLMATELRLGLPGTVDDCSQPQLVKATPPSTPRGKRRATADAVEEAAGAEKASKRDAETAPPAAKAPVVGWPPFESYRKSCFQQASSKQAAADKTEAAXAAAPPGCTXSSAAATNTSSCSSAAVVVGSLVKGAWTAPRN

SEQ ID NO: 13799 - DNA, 761 bp, Zea mays
  misc_feature: Ceres CLONE 1374828-F
  misc_feature: Translation starting site: 116
  misc_feature (356)..(356): n is a, c, t, g, unknown, or other
  misc_feature (675)..(675): n is a, c, t, g, unknown, or other
  misc_feature (761)..(761): n is a, c, t, g, unknown, or other
aagctggagctccccgcggtggcggccgctctataactagtggatcccccgggctgcaggaattcgcacgagaccattacctagaacatcctaatcgaaaagtcgtctcattctcatggaggtggaaacaccggcgcaggcgcagggcaccactcatgtcgccggcactacgaggacactccgcaacccactcctcgtcgtcaacttcgtcctcatggtcgtgggctcagcgggcggcccgctgttcctccgcgcctacttcctccacggcggcgcccgcaagtggctctcggccttgctccagaccgccggcttcccgctcctgctcgtgccgctctgcgtctccttctcccggngccgccgccgccgcccccgccggcccgacgacggcgcgccggcgatggcgccgttccttcctcatgacgccccgcctcctggcggcgtccgcggccatcggcctcatgaccggcctcgacgaactgctctacgcctacggcctggcccacctggcgtggtccacggtctccatcctcctctccacgcagcttggccttcacggccgccttcccgctgctgctcgtgccggaagcggttccacggccttcctcggtgaacgcccgtgggcgttgcttcacggcccggcgcccccatgcctcggaatgaaaccccgcgggngaacccgccccgcggtgggtttcccccgggggaattacaggggccgggtttcacccatgaacccccggggcccgccccggtttttn

SEQ ID NO: 13800 - DNA, 730 bp, Zea mays
  misc_feature: Ceres CLONE 1374830-F
  misc_feature: Encodes the peptide sequence at SEQ ID NO. 13801
  misc_feature (478)..(478): n is a, c, t, g, unknown, or other
tggagctccccgcggtggcggccgctctagaactagtggatcccccgggctgcaggaattcgcacgagaccattacatagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaaggcggcgcccgatgggtgagcaggtgaagggcatgctccacgacaaggggccgacggcgtcgcaggcgctgaacgtggcgacgctgttcccgctgggcgggctgctgctggtgctgtcggggctgccgctgacggcctccgtgggggggctgggcgtggccacgccggggttcctgatcttcagccccgtgctggtccccgncgcgctggtcatcgggaacgccgtcatggggttcctcacgtcgggcgcgctgggggctcgggggccctgtctcgctcacgtgcctcgccaacacggggcgggaggggtcccagcgcaccccggactaagtggaggaagccgcaccccaagattgggggaggcccccgccccacgcgggcccccaaaaccgcgcaagaagggccaggccattcaaggtaagggcccaagaaggccgggccccggggaaggtgc

SEQ ID NO: 13801 - protein, 176 aa, Zea mays
  misc_feature: Ceres CLONE 1374830-F
  misc_feature (44)..(163): Pfam Name: Oleosin Pfam Description: Oleosin
  misc_feature (93)..(93): Xaa is any aa, unknown, or other
MADRDRSGIYGGAHATYGQQQQQGGRRRPMGEQVKGMLHDKGPTASQALNVATLFPLGGLLLVLSGLPLTASVGGLGVATPGFLIFSPVLVPXALVIGNAVMGFLTSGALGARGPCLAHVPRQHGAGGVPAHPGLSGGSRTPRLGEAPAPRGPPKPRKKGQAIQGKGPRRPGPGEG

SEQ ID NO: 13802 - DNA, 699 bp, Zea mays
  misc_feature: Ceres CLONE 1374833-F
  misc_feature: Pfam Name: AhpC-TSA Pfam Description: AhpC/TSA family
  misc_feature: SWISSPROT Homolog: EC 1.11.1.15 Peroxiredoxin
  misc_feature (478)..(478): n is a, c, t, g, unknown, or other
  misc_feature (644)..(644): n is a, c, t, g, unknown, or other
tccccgcggtggcggccgctctagaactagtggatcccccgggctgcaggaattcgcacgagaccattacctagaacatcctaatcgaaaaagcagaccgatagccaggtaagcccgtgcacgtcgaccgacgtacgccaccatggctggtctcaccatagacgacaccgtccccaacctggagttgtactccacccacgctgagatcctgatccacgactacgatgtggacattttacacctatcatcttctctcacccaatcgacttcacttccgtgtgcacaacggatatgccattgatgacgaagctacacctcgggaatgtagaatgacgcttagaacatgatggaggtctcatccaactacccgtaagcgcacaggtaccggaccatggactagggtgcagacggaaaacaagaatgattcaccatcacatacgaagaaccgggttctcgtgaccactcttgaaatgcgcanaacaggtcctactgcatgaggaggacatggggaactccgacaaaaccgttgcaaggttacgggagatgacatcccatttgctccacttccttaccacgaatcagaatgggaattacagatttctgcaactctcaccacatctggataattggacaaagaagatgcngccttccaggctgtgttataggtctgcgagaaagtcataaaggctctcgaacggc

SEQ ID NO: 13803 - DNA, 695 bp, Zea mays
  misc_feature: Ceres CLONE 1374841-F
  misc_feature: Encodes the peptide sequence at SEQ ID NO. 13804
  misc_feature (305)..(305): n is a, c, t, g, unknown, or other
  misc_feature (472)..(472): n is a, c, t, g, unknown, or other
  misc_feature (531)..(531): n is a, c, t, g, unknown, or other
  misc_feature (532)..(532): n is a, c, t, g, unknown, or other
  misc_feature (536)..(536): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (664)..(664): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
tccccgcggtggcggccgctctagaactagtggatcccccgggctgcaggaattcgcacgagaccattacctagaacatcctaatcgaaaaagcagtccgatagccaggaagcccgtgcacgtcgaccgacgtacgccaccatgccggggctcaccataggcgacaccgtccccaacctggagctggactccacccacggcaagatccgcatccacgactacgttggcgacggctacgctatcatcttctctcacccagccgacttcacgcccgtgtgcacgacggagatggcggcgatggcggngtacgccaaggagttcgagaagcgtggcgtgaagctgctgggcatctcgtgcgacgacgtggagtcgcacaggcagtggaccaaggacgtggaggcgtacggcgggaagcagcagcagcagcagcatacgacgacgaaggtgacgttcccaaatcctggcggacccnggcgcgggacgccatccggcagctgaacatggtgggacccgacgagaagggacgcgcgnngcgnagcatgccgtcccgcgcgctccacgtcgtcgggcccgaacaggccgtgaagctgagcttcctgtacccggnnncacacgggcggaacatggacgaggtgctgcgcgccgtcgactcgctgctcacggncgcaagcacgnnngggaagtggccacgccgc

SEQ ID NO: 13804 - protein, 118 aa, Zea mays
  misc_feature: Ceres CLONE 1374841-F
  misc_feature (6)..(114): Pfam Name: AhpC-TSA Pfam Description: AhpC/TSA family
  misc_feature: SWISSPROT Homolog: EC 1.11.1.15 Peroxiredoxin
  misc_feature (55)..(55): Xaa is any aa, unknown, or other
  misc_feature (111)..(111): Xaa is any aa, unknown, or other
MPGLTIGDTVPNLELDSTHGKIRIHDYVGDGYAIIFSHPADFTPVCTTEMAAMAXYAKEFEKRGVKLLGISCDDVESHRQWTKDVEAYGGKQQQQQHTTTKVTFPNPGGPXRGTPSGS

SEQ ID NO: 13805 - DNA, 727 bp, Zea mays
  misc_feature: Ceres CLONE 1374846-F
  misc_feature: Encodes the peptide sequence at SEQ ID NO. 13806
  misc_feature (374)..(374): n is a, c, t, g, unknown, or other
  misc_feature (375)..(375): n is a, c, t, g, unknown, or other
  misc_feature (384)..(384): n is a, c, t, g, unknown, or other
  misc_feature (391)..(391): n is a, c, t, g, unknown, or other
  misc_feature (392)..(392): n is a, c, t, g, unknown, or other
  misc_feature (394)..(394): n is a, c, t, g, unknown, or other
ggagctccccgcggtggcggccgctctagaactagtggatcccccgggctgcaggaattcgcacgagaccattacctagaacatcctaatcgaaaaacccgaagcacatcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaagggtcatccctcgcnncagccaccntgggggnncncgccaaaaggtgtccccccaaaggacggcttgaaagccttctttggtccaggcttggccttgaactccctttggagtttaaagcccgggatggggccaaagggtttgcctttgggggagggaaaaatttaaaaaaatgtgcgttcgcccgtttttcccacaaaggggggggatttctctcccccctaaaaaagggggtttttttctcccaggggggggggagaaaaaaaacaccaaacaccccggggtgtgtttttaaaaaaaaaaaaaaaaaccgtggtggggccgccccttttttttaaaaaaaagaggggtttttttgttactcacccca

SEQ ID NO: 13806 - protein, 112 aa, Zea mays
  misc_feature: Ceres CLONE 1374846-F
  misc_feature: SWISSPROT Homolog: EC 2.7.2.3 Phosphoglycerate kinase
  misc_feature (63)..(63): Xaa is any aa, unknown, or other
  misc_feature (69)..(69): Xaa is any aa, unknown, or other
  misc_feature (70)..(70): Xaa is any aa, unknown, or other
MATKRSVGTLGEADLKGKKVFVRADLNVPLDDAQKITDDTRIRASVPTIKFLLEKGAKGHPSXQPPWGXXPKGVPPKDGLKAFFGPGLALNSLWSLKPGMGPKGLPLGEGKI

SEQ ID NO: 13807 - DNA, 736 bp, Zea mays
  misc_feature: Ceres CLONE 1374847-F
  misc_feature: Encodes the peptide sequence at SEQ ID NO. 13808
  misc_feature (396)..(396): n is a, c, t, g, unknown, or other
  misc_feature (538)..(538): n is a, c, t, g, unknown, or other
  misc_feature (539)..(539): n is a, c, t, g, unknown, or other
  misc_feature (637)..(637): n is a, c, t, g, unknown, or other
tccccgcggtggcggccgctctagaactagtggatcccccgggctgcaggaattcgcacgagaccattacctagaacatcctaatcgaaaaaaaagagactttagggttttagcggcttctatttctgagcgagggtttatccgccaggggcggcgcgacgcggcggcagttgagctgggatttccttcccatcccgttcccttccaggcgaggcgatggacgaggcggcggtcgacgacctcatccggcggctcctcgaggcccgcggcgggcgcaccccgcgcaacgcgcaggtgaccgacgctgagatccggcgcctctgcgccgccgccaaggatgtgttcctctcccagcccaacctcctggagctcgaggcccccatcaagatatgcggngatgtccatggtcagtattcagaccttcttcgattatttgagtatggtggctatccaccagatgcaaattatctgttcctcggtgactatgttgatagggggaaacagagcatagaaacaatatgccttctcttggcatacnnagataagtacccagaaaacttctttcttctcaggggaaaccatgatgcgccctcatcaaccgaatatatgggttttttgatgagtgtagaggagattncatggtcgtatctggaagatatcaccgagtgttttactgcctccagtggctgcgcttatggatgacagatcttttgatggcatggagggtgtctcctga

SEQ ID NO: 13808 - protein, 161 aa, Zea mays
  misc_feature: Ceres CLONE 1374847-F
  misc_feature (54)..(160): Pfam Name: Metallophos Pfam Description: Calcineurin-like phosphoesterase
  misc_feature: SWISSPROT Homolog: EC 3.1.3.16 Phosphoprotein phosphatase
  misc_feature (108)..(108): Xaa is any aa, unknown, or other
  misc_feature (141)..(141): Xaa is any aa, unknown, or other
MDEAAVDDLIRRLLEARGGRTPRNAQVTDAEIRRLCAAAKDVFLSQPNLLELEAPIKICGDVHGQYSDLLRLFEYGGYPPDANYLFLGDYVDRGKQSIETICLLLAYXDKYPENFFLLRGNHDAPSSTEYMGFLMSVEEIXWSYLEDITECFTASSGCAYG

SEQ ID NO: 13809 - DNA, 733 bp, Zea mays
  misc_feature: Ceres CLONE 1374848-F
  misc_feature: Translation starting site: 338
  misc_feature (378)..(378): n is a, c, t, g, unknown, or other
  misc_feature (424)..(424): n is a, c, t, g, unknown, or other
  misc_feature (442)..(442): n is a, c, t, g, unknown, or other
  misc_feature (470)..(470): n is a, c, t, g, unknown, or other
  misc_feature (501)..(501): n is a, c, t, g, unknown, or other
  misc_feature (628)..(628): n is a, c, t, g, unknown, or other
  misc_feature (667)..(667): n is a, c, t, g, unknown, or other
  misc_feature (707)..(707): n is a, c, t, g, unknown, or other
ggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggntgctcacctcatcatgtacatcatcgtcatcggcttcgcgagctgnaacctgaaccacttcatncacgggcagaccaactaccccggcgtgnccggcaacggcgcgacgttctacttcctggntgtcgccatcctggccggcgtggtgggcggcgcgtccaagctggcgggcgtgcaccacgtgcgcgcctggcgcacgacagcctggccaccaacgccgcgtcgtcgctcatcgcctggggcatcacgncgctcgccttcgggctggcctgcaggagatccacatcgncgaacaccgcgctggcgcctgcccgtgctggaagccttcntcatcatcctcggcttcacgcaagtc

SEQ ID NO: 13810 - DNA, 726 bp, Zea mays
  misc_feature: Ceres CLONE 1374851-F
  misc_feature: Translation starting site: 219
  misc_feature: SWISSPROT Homolog: EC 2.7.1.4 Fructokinase
  misc_feature (723)..(723): n is a, c, t, g, unknown, or other
tcaccgcggtggcggccgctctagaactagtggatcccccgggctgcaggaattcgcacgagaccattacctagaacatcctaatcgaaaaaacaccaccgcagccgcagcacaatcgcctcgccttcccttccccaccagcccccgtctctctctctctctctctgtctctctctcgtagccgcgtccatctcgcagcagcaagcaagcgcgaccaaatggcgcctctaggagacggcggagctgttgccgcggcggcgtccaacaacctggtggtgtcgttcggcgagatgctgatcgacttcgtccccgacgtggccggtctgtcgctggccgagtcgggcggcttcgtcaaggcccccggcggcgcgcccgccaacgtcgcctgcgccatcgccaagctcggcggctcctccgccttcgtcggcaagttcggcgacgacgagttcgggcacatgttggtgaacatcctgaagcagaacaacgtgaactcggagggggtgcctgttcgacaagcacgcgcggacggcgctgggcttcgtgacgctcaagcacgacggggagcgcgagttcatggtctacagaaccccgagcgcggacatgctgctgacggaggcggagctggacctgggcctggtgcgccgccgcagggtggtccactacggctccatctcggtcatctccgaggcgtgccgctcggggcaatgggcggcatgcgcgcancaa

SEQ ID NO: 13811 - DNA, 727 bp, Zea mays
  misc_feature: Ceres CLONE 1374853-F
  misc_feature: Encodes the peptide sequence at SEQ ID NO. 13812
  misc_feature (516)..(516): n is a, c, t, g, unknown, or other
  misc_feature (519)..(519): n is a, c, t, g, unknown, or other
  misc_feature (524)..(524): n is a, c, t, g, unknown, or other
  misc_feature (547)..(547): n is a, c, t, g, unknown, or other
  misc_feature (569)..(569): n is a, c, t, g, unknown, or other
  misc_feature (596)..(596): n is a, c, t, g, unknown, or other
  misc_feature (668)..(668): n is a, c, t, g, unknown, or other
aagctggagctccccgcggtggcggccgctctagaatagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcttccttatgctccttggtctttctgcaagtgttgctaccgcgaccattttcccacaatgctcacaagctcctatagcttcccttcttcccccatacctatcaccagcggtgtcttcagtatatgaaaacccaattgttcaaccctacaggatccaacaggcaatcgcaacaggcatcttaccattatcacccttgttcctccaacaaccgtcagccctattacagcagttacctttggtgcatttggtggcacaaaacatcagggcacaacaactacaacaacttgtgctagcaaaccttgctgcatactctcagcaacatcagtttcttccattcanccnactgnctgcattgaactctgctgcttanttgcaacaacaactaccattcnagcagctagctgctgcctacccccagncatttcttccattcaccaactagcagcattgaactctgctgcttatttacagcagcaacactactaccattncagcagctaactgatgtgagccctgctgccttcttgacacacaacagttgttgcccgtt

SEQ ID NO: 13812 - protein, 153 aa, Zea mays
  misc_feature: Ceres CLONE 1374853-F
  misc_feature (120)..(120): Xaa is any aa, unknown, or other
  misc_feature (121)..(121): Xaa is any aa, unknown, or other
  misc_feature (123)..(123): Xaa is any aa, unknown, or other
  misc_feature (130)..(130): Xaa is any aa, unknown, or other
  misc_feature (138)..(138): Xaa is any aa, unknown, or other
  misc_feature (147)..(147): Xaa is any aa, unknown, or other
MAAKIFCFLMLLGLSASVATATIFPQCSQAPIASLLPPYLSPAVSSVYENPIVQPYRIQQAIATGILPLSPLFLQQPSALLQQLPLVHLVAQNIRAQQLQQLVLANLAAYSQQHQFLPFXXLXALNSAAXLQQQLPFXQLAAAYPQXFLPFTN

SEQ ID NO: 13813 - DNA, 662 bp, Zea mays
  misc_feature: Ceres CLONE 1374854-F
  misc_feature: Encodes the peptide sequence at SEQ ID NO. 13814
tggagctccccgcggtggcggccgctctagaactagtggatcccccgggctgcaggaattcgcacgagaccattacctagaacatcctaatcgaaaacttaaagcacgcgcgcgccctgtgctccccctcagtcctcgctagtcctttctccatcacaaacgctattcttttttccctaaagctcggagaccgccggaagcgagcgatggcgtgcaagacgaagagcctgctgttggcgctcagcgtggcggcgctgctcgcggcgcagtcggactcccacgggctgggggacttcacgagcgggagcggcgaggcgacgacgacgccggagatgcagacctttctcaagccccaggccgctgcgggggctcccggaggccctcgacgcctccatggcccgcaaagcggagcgggggggcgggggcgctccccggccacgacaagggccgggacgggggccgtcagccacgccgcgcagggcccggggcccggggcccgccgggggggcctggcggggtgagggccggggccggggccgcatcccttgccgccggggcaaaaatggggggcggcccccggccggaaaacaagggggaattctggttctccccccggagccccggtcgggggggccccgggggaaaggccccgccatctaaca

SEQ ID NO: 13814 - protein, 104 aa, Zea mays
  misc_feature: Ceres CLONE 1374854-F
MACKTKSLLLALSVAALLAAQSDSHGLGDFTSGSGEATTTPEMQTFLKPQAAAGAPGGPRRLHGPQSGAGGRGRSPATTRAGTGAVSHAAQGPGPGARRGGLAG

SEQ ID NO: 13815 - DNA, 718 bp, Zea mays
  misc_feature: Ceres CLONE 1374856-F
  misc_feature: Encodes the peptide sequence at SEQ ID NO. 13816
  misc_feature (414)..(414): n is a, c, t, g, unknown, or other
ggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtaacagccacggccggggcggaggacggagtggtcaaacgggaccgcagggaggacctggcggtggttgcaagcagcgtgcgagtggcaatacggaaaggaccacccgcgaaaaagggaatgcaagaacgagtgccgcnagccgcacaacaagctgacgcgggcgaggacggcgacagcggcgtggacgcctacgtctcccggtccggggagggcgagtgccggcgccagtgcctgccccccacgagggccagccgtggaagacccagagtgatgaggcggtgccccccccccggactggccctcaaattggaacaagagaacgtcccggaaacaaaagccgggccaatggccggaaagtgccacccccacaccgggggacggggggaaaagcaaccctcctatgactgaaaaaaccggaggggggagagagggcgcaccccc

SEQ ID NO: 13816 - protein, 158 aa, Zea mays
  misc_feature: Ceres CLONE 1374856-F
  misc_feature (69)..(69): Xaa is any aa, unknown, or other
MGKGSVGASWWAFLLLAGVLLVVTATAGAEDGVVKRDRREDLAVVASSVRVAIRKGPPAKKGMQERVPXAAQQADAGEDGDSGVDAYVSRSGEGECRRQCLPPTRASRGRPRVMRRCPPPGLALKLEQENVPETKAGPMAGKCHPHTGGRGEKQPSYD

SEQ ID NO: 13817 - DNA, 672 bp, Zea mays
  misc_feature: Ceres CLONE 1374857-R
  misc_feature: Pfam Name: CLPTM1 Pfam Description: Cleft lip and palate transmembrane protein 1 (CLPTM1)
cgattgggtaccgggccccccctcgaggtcgacggtatcgataagcttttttttttttttttttatcaaacaagcatatcaactagtaatggctgctaaaagacgaactggaaacgtaattgtgacagtgtgcgcctgttcgcccgctgctctagacaagactatcgtgtcccttgttacacgccttatcttatggtcagcacgtctcggtaaggcaagaccgcaagagtccagcatccagtttcagcaaaagaaatttcacgccggctgggaaggcaggtgttgcagagatgtatgctatatttggatgatcaaaagtttggagatcacttggttttcttgtcctccgtactcgtctcagacccggcctccgttaactggggtgctgcagctgaatcacttccttccgcagcctcctgagctgccggttcgtcctcgcccccgaaagcaaactcgttgacacgtttcttgtcgaccggatacttccacctctgatagaggtatatcaagaagataacatcatctctgaaaactgagagacgatgaagcattggcattttgatgacaaatgcaaaaaggtcatcgattatagtgttgaggaacttgtaagtcatttgtctccatggcatatgagcaacagacttcagcttgtagttgataaacaattggggg

SEQ ID NO: 13818 - DNA, 586 bp, Zea mays
  misc_feature: Ceres CLONE 1374858-F
  misc_feature: Encodes the peptide sequence at SEQ ID NO. 13819
  misc_feature (378)..(378): n is a, c, t, g, unknown, or other
  misc_feature (379)..(379): n is a, c, t, g, unknown, or other
  misc_feature (406)..(406): n is a, c, t, g, unknown, or other
  misc_feature (407)..(407): n is a, c, t, g, unknown, or other
ctccccgcggtggcggccgctctagaactagtggatcccccgggctgcaggaattcgcacgagaccattacctagaacatcctaatcgaaaaccaccacctcggctcctcccccgcggccatggccaccaccactctggggcaaggcgacgacggctgcaaaggccgcagcgccaacgggaatgacaatgccgtcgccttccatttggaggatgccaacatccaagatactcctaccaagatgaacagtaacagccttgcaatgagtggtgggcctgcagccggtgcaggaggcgagcacgaggagcagcagcaggatgggggaacggggatgggcagtccccaagcaggcagtcacccctgggaaagagagagacgnngatctgtctgtcacagcacgccattgnntgctgtggatcagaaggtggcgtggggagcacatctggctgaacagcccttgcgtccccaggagggctccactcaaaatggagcatcatcgggagtgggggtcattccttttccccggctggatccaccagggaatggccccggaaagtttttgttctttcaggggccaggttttctcc

SEQ ID NO: 13819 - protein, 155 aa, Zea mays
  misc_feature: Ceres CLONE 1374858-F
  misc_feature (87)..(87): Xaa is any aa, unknown, or other
  misc_feature (96)..(96): Xaa is any aa, unknown, or other
MATTTLGQGDDGCKGRSANGNDNAVAFHLEDANIQDTPTKMNSNSLAMSGGPAAGAGGEHEEQQQDGGTGMGSPQAGSHPWERERRXSVCHSTPLXAVDQKVAWGAHLAEQPLRPQEGSTQNGASSGVGVIPFPRLDPPGNGPGKFLFFQGPGFL

SEQ ID NO: 13820 - DNA, 717 bp, Zea mays
  misc_feature: Ceres CLONE 1374861-F
  misc_feature: Encodes the peptide sequence at SEQ ID NO. 13821
  misc_feature (655)..(655): n is a, c, t, g, unknown, or other
  misc_feature (666)..(666): n is a, c, t, g, unknown, or other
  misc_feature (684)..(684): n is a, c, t, g, unknown, or other
tccccgcggtggcggccgctctagaactagtggatcccccgggctgcaggaattcgcacgagaccattacctagaacatcctaatcgaaaaatagtcagccgccatcaccgctgttaggttctaccaggagaccttcggcgtccctccggccacgcgagctcgccgaaatggtcgcccacaggttccatcagtaccaggtggtgggtcgcgcgctgccgaccccaaccgatgagcaccccaagatctaccgcatgaagctctgggccaccaacgaggttcgcgccaagtccaagttctggtacttcctgagaaagctcaagaaggtgaagaagagcaatggccagatgcttgccatcaacgagatctttgagcgcaacccgaccaccatcaagaactatggcatctggctgcgctaccagagcaggactggttaccacaacatgtacaaggagtaccgcgacaccaccctgaacggcgcagtggagcagatgtacaacgagatggcctcccgccaccgcgtgaggtccccctgcatacagatcatcaagacagcgacggtccactttcagctgtgcaagagggacaacacaaagcagttcacaactccgagatcaagttcccgcttgtgtaccgcaaggtcaggccgcctaccangaagctccggnacacttttcaggcttcanggccaacttttcatgtgagagtatatcgtaccc

SEQ ID NO: 13821 - protein, 177 aa, Zea mays
  misc_feature: Ceres CLONE 1374861-F
  misc_feature (5)..(177): Pfam Name: Ribosomal_L18ae Pfam Description: Ribosomal L18ae protein family
  misc_feature (163)..(163): Xaa is any aa, unknown, or other
  misc_feature (172)..(172): Xaa is any aa, unknown, or other
MVAHRFHQYQVVGRALPTPTDEHPKIYRMKLWATNEVRAKSKFWYFLRKLKKVKKSNGQMLAINEIFERNPTTIKNYGIWLRYQSRTGYHNMYKEYRDTTLNGAVEQMYNEMASRHRVRSPCIQIIKTATVHFQLCKRDNTKQFTTPRSSSRLCTARSGRLPXSSGTLFRLXGQLFM

SEQ ID NO: 13822 - DNA, 702 bp, Zea mays
  misc_feature: Ceres CLONE 1374862-F
  misc_feature: Encodes the peptide sequence at SEQ ID NO. 13823
tccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcacccgggctggggtggcccggccgccatcgcgctggcgctcatggggggccgggttcgtcacctccggcggcctcggcgtcgctgcgctggccgtgtcctcctggatgtacaagaacctgacgggccagcacccgccgggcgccgaccagctggaccacgccaaagcgaggctggcgtccaaggcccgcgacatcaaggatgcagcaacgcaccgcatcgaccaagcgcaggggtcttgagagaagaccccctccgagcgggccgcgcgcgcgaccttcttg

SEQ ID NO: 13823 - protein, 157 aa, Zea mays
  misc_feature: Ceres CLONE 1374862-F
  misc_feature (36)..(147): Pfam Name: Oleosin Pfam Description: Oleosin
MADHHRGATGGGGGYGDLQRGGGMHGEAQQQQKQGAMMTALKAATAATFGGSMLVLSGLILAGTVIALTVATPVLVIFTRAGVARPPSRWRSWGAGFVTSGGLGVAALAVSSWMYKNLTGQHPPGADQLDHAKARLASKARDIKDAATHRIDQAQGS

SEQ ID NO: 13824 - DNA, 706 bp, Zea mays
  misc_feature: Ceres CLONE 1374864-F
  misc_feature: Encodes the peptide sequence at SEQ ID NO. 13825
  misc_feature (353)..(353): n is a, c, t, g, unknown, or other
  misc_feature (393)..(393): n is a, c, t, g, unknown, or other
  misc_feature (403)..(403): n is a, c, t, g, unknown, or other
  misc_feature (418)..(418): n is a, c, t, g, unknown, or other
  misc_feature (669)..(669): n is a, c, t, g, unknown, or other
  misc_feature (671)..(671): n is a, c, t, g, unknown, or other
  misc_feature (672)..(672): n is a, c, t, g, unknown, or other
  misc_feature (706)..(706): n is a, c, t, g, unknown, or other
ggagctccccgcggtggcggccgctctagaatagtggatcccccgggctgcaggaattcgcacgagaccattacctagaacatcctaatcgaaaaccattcatcgagtctacgctcttcgtctttctccggtccgaattccccaatcggactctcctcttcttgccggatctccacaccccattccaccccgcccatgggtgcccccacccctcgccgctgacctgtgggtacactgccccctgctcccccgccccgctcccgctcgcccacgcgaaccctaggcagctaggctttgctgctagaagagctccagcgaccgacgaggagaggagaataaagctcaaatcttgnatgcgcccgaaaccgatgcgacacctgccgcaaaaaaccngaagatgtanagatccgtgaggttngggcggacacctcgagacagagttcgccgtgatccgcgacatcgtcgacgactatccgtatgtggctatgacactgagtttccgggcgttgtgtgtcgtccgcttcgcacttacaagtcgggcggccgaggtcactacgccactcttaaagctaacggggacatgctggaacttaatcagctccggctcacctggtcgaacaacatggtgggctgccggggctaggccaaaaagccgtccgtgggtctggnanntcaactttcgagaatttacccctcgactgagggn

SEQ ID NO: 13825 - protein, 81 aa, Zea mays
  misc_feature: Ceres CLONE 1374864-F
  misc_feature (2)..(2): Xaa is any aa, unknown, or other
  misc_feature (7)..(7): Xaa is any aa, unknown, or other
MXRSVRXGRTPRDRVRRDPRHRRRLSVCGYDTEFPGVVCRPLRTYKSGGRGHYATLKANGDMLELNQLRLTWSNNMVGCRG

SEQ ID NO: 13826 - DNA, 554 bp, Zea mays
  misc_feature: Ceres CLONE 1374868-F
  misc_feature (167)..(167): n is a, c, t, g, unknown, or other
  misc_feature (220)..(220): n is a, c, t, g, unknown, or other
  misc_feature (222)..(222): n is a, c, t, g, unknown, or other
  misc_feature (266)..(266): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
tccccgcggtggcggccgctctagaactagtggatcccccgggctgcaggaattcgcacgagaccattacctagaacatcataatcgaaaaacgacccctcagccctcacacaagagacgcagctgcgagtccgccagccttatcctcctccccgtctccggctccnacccgcaagcgcggtaaggtatggcttcgacattcgtggcacttctactgtcngncttatggctgctccacagggaaaaatgtgcgcctccgaggaggntgacctccaaaggtaagagcagctaaggagctgtactttcacaaggatggtccaccttttaaagaactccccaaaggggggcaaaaaactttgggaaacctaagcggggggtttcccccccccacccccaaggggaaaaaaattgtgtttttagaaaaaaaaaaaaaggggtccccccaaaaatgtggaaaaccaggnnnnnnttctttcccttctccccaaaaaaaatgtgttgtggtggaccccccccgggaaaaaaaaattgtgggtaatttttatggtgcgcgc

SEQ ID NO: 13827 - DNA, 798 bp, Zea mays
  misc_feature: Ceres CLONE 1374869-F
aagctggagctccccgcggtggcggccgctctagaactagtggatcccccgggctgcaggaattcgcacgagaccattacctagaacatcctaatcgaaaactcctgaacacaccacccctcgtctccccacggaggccgtcctctcctctcctctgcgtccgccactgcccaccgctcgcccgcgcgcgctccattacctcggcgggcgatggccgacctatccaacaccggctccacctaacacgagcagcgcccccgcctaggcggcagctggctggtcggtcgtcgagcagctagcggcggcagcgcccgaagggaggccgtctcactctcctcgtcggcgcggcaggagatggaggccatcgtgtccgtccgcgcgccgccgcgggtccgagcctgggcccgccccccaaaaacgcccccccccgcttgttgggccctaaacccccaaggaaaaggttcccggtcccccctcacaaaggccccggaagcctgggggcttcgggggacccgataacctgaaggggccgcggatcccggcccccccgttgggcccgaggctatcttgctagaaaagggaaaaggcccccaaagcggggggggggggggtcctccataataaaagcacaaaagccccaaattttctccccccttatcttgggtgcgccccttcggccgctatatgggggggagaagggggccgtttcgggaaaaaactaacggtgggggaaaaacccctctccccacagggggcttgctttcttacgtatctcttcaaaggatgaaaatctcgcgg

SEQ ID NO: 13828 - DNA, 790 bp, Zea mays
  misc_feature: Ceres CLONE 1374871-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (278)..(278): n is a, c, t, g, unknown, or other
  misc_feature (665)..(665): n is a, c, t, g, unknown, or other
  misc_feature (672)..(672): n is a, c, t, g, unknown, or other
  misc_feature (679)..(679): n is a, c, t, g, unknown, or other
  misc_feature (790)..(790): n is a, c, t, g, unknown, or other
nnnnnnnnnnnnnnnnnnnnaatccggaaggggggtttctcaacnnnnnaaaattggggctccccgcgggggcggccgctctagaatagtggatcccccgggctgcaggaattcgcacgagaccattacctagaacatcctaatcgaaaacgcaaacccctgctcgatcgacacacggcagccgcgacccatcgcgacctgacccgaccctccccgagggcggcagccttatcctctccgcctccggctcccggcgtgccctccgacccatcaaaagnggggaggagaagaaatgggcttcgacggttcgtgccacttcttacaggtggccttatggctgctcccaacgggaagaatgtgcgccttccgaggaggggtaacttcagagtaaaaggggttaaggaggtgtactttcaccccccccccggggggggggggggaagctcccgactggaagccaaatagctttgcaaaacctaagttggagttaccctcccgaccgaaggggaagggaatgtcccttttggaaaacaagaaccgggtcctcccaaggattgttaaaccgatgggggttacagttttccaagaagaggttgacttggaaaaacccctggggggaaaagcattggaggttaatattggggcagggcaggcttggagctaanagaacanaggatcnttttgtgggcggagggacaacccccctccgggggcccttggctcagggggttgaatttgtgagaggggggtaaggggccgggggagcttgggggctaatccctggttcaan

SEQ ID NO: 13829 - DNA, 676 bp, Zea mays
  misc_feature: Ceres CLONE 1374873-F
  misc_feature: Encodes the peptide sequence at SEQ ID NO. 13830
  misc_feature (309)..(309): n is a, c, t, g, unknown, or other
  misc_feature (393)..(393): n is a, c, t, g, unknown, or other
ccccgcggtggcggccgctctagaactggtggatcccccgggctgcaggaattcgcacgagaccattacctagaacatcctaatcgaaaactgcgctgccattgctcgtccgcatcctccttggatttccctcccaggaaggttagggttttctgatgcgctcatacatggggcagcaagaagatgggatgtctgatggcttgtacacttacaagcatcaccgcgagcgaggagctgatatccacaccatctttgtgaagaagagcaaattcaggattctgctgtcatttatcggcacaacgttccttnctggtgtctgtttgctgcgccctgttatcgaaggatggtttatgtctttgttccctttggagcgattcatttgccagtgtattngcgaaatgcctgcgatgtgaccctgtgaagaaagagtcattggtgatcatgccgacttttggaattcattagagcaacacttttggagtggaagagttcatcgcaaaattgtgcccattggcaagatcctaagaccaggggctgaatgagcatggggacccctgtctcatgctactggagcttgggccttgcttggaccgcaagaatatgagctcctggttggtttcaagaggttgaatccaccagtcaagatggtgttcccaatctggaaagggttttgggc

SEQ ID NO: 13830 - protein, 81 aa, Zea mays
  misc_feature: Ceres CLONE 1374873-F
  misc_feature (48)..(48): Xaa is any aa, unknown, or other
  misc_feature (76)..(76): Xaa is any aa, unknown, or other
MGQQEDGMSDGLYTYKHHRERGADIHTIFVKKSKFRILLSFIGTTFLXGVCLLRPVIEGWFMSLFPLERFICQCIXEMPAM

SEQ ID NO: 13831 - DNA, 664 bp, Zea mays
  misc_feature: Ceres CLONE 1374874-F
  misc_feature: Encodes the peptide sequence at SEQ ID NO. 13832
  misc_feature (243)..(243): n is a, c, t, g, unknown, or other
  misc_feature (428)..(428): n is a, c, t, g, unknown, or other
tccccgcggtggcggccgctctagaactagtggatcccccgggctgcaggaattcgcacgagaccattacctagaacatcctaatcgaaaagaatgaaacccgattcacaaaaccctagcgacctcgattcctcaccagcatggccgtcggcccctacttctctcggctctctccgccggcgcggtttgataccatccctcttccacagctgcggcctcacctacgcccgcgcgtgcctgctncggttgctgcagcccgcactagcttgtctcccggcgccggtgactcccaagaacgggtcggcggctggtggtttcccgagtacgagaaatccatgaaacaggcaaggggcaccactcggtttaagagagctgccctgggttgggtttgagactcctgcggggatccgccttggctgggctggggntggggcttcccatccttcccaggaagggtatacggcaactccatggtggctcccctaaccctaaattcaagaaaaatttgccaaccataaaagcccacagagacaatccaggggggtttccaagtgaccgggaactctgaaaaaaattggaagtttcctaagggcaaccccatgataagaaagggtgaaacaaaaactttgtggtttccgggggaaaacctcccgaaacacccttt

SEQ ID NO: 13832 - protein, 83 aa, Zea mays
  misc_feature: Ceres CLONE 1374874-F
  misc_feature (35)..(35): Xaa is any aa, unknown, or other
MAVGPYFSRLSPPARFDTIPLPQLRPHLRPRVPAXVAAARTSLSPGAGDSQERVGGWWFPEYEKSMKQARGTTRFKRAALGWV

SEQ ID NO: 13833 - DNA, 664 bp, Zea mays
  misc_feature: Ceres CLONE 1374875-F
  misc_feature: Translation starting site: 171
  misc_feature (257)..(257): n is a, c, t, g, unknown, or other
gctctagaactagtggatcccccgggctgcaggaattcgcacgagaccatacctagaacatcctaatcggaactccaaagtttcgtccaccatttcgctcccgcaagcaccgatttgtttactggctctctccgacgcgcggcggcggagctccctacgacgactgaaccatgtgcggcggcgcgatccttgccaaccttcgcgagccggggccgcgccgggtcacagagcgggacatctggcagcagaaaaagaanctcaagaggggcggcggcgccggaaggcgctcggtcgcggcggagggacatgaggacttcgaggccgactttgaggtcttccaggccgactccgggagtcagatttggagctcagggaggggactgaccacgacctcgtcgaaatcaggccctcactggcaagaggactttccccaggatggcttaggaccatgactaggggtggagcagggcagcccaggagaaaaaaagaatctatacggggggtatccgccaggggccttggggccaaggggcctggtaaaaatcaaaatcccccgaaaggggggtcgggggttgggctttggacattttcaaaaaccccggagggaaggcggcaagagcttattgtggcgccaaaggggcggggggatcccggggaaaagaag

SEQ ID NO: 13834 - DNA, 680 bp, Zea mays
  misc_feature: Ceres CLONE 1374878-F
  misc_feature: Encodes the peptide sequence at SEQ ID NO. 13835
gctctagaactagtggatcccccgggctgcaggaattcgcacgagaccattacctagaacatcctaatcgaaaactccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgccccggggcttccggttccacccgacggacgaggagctggtggcgcactacctctgcccgcgcgccgcggggcgccgccggccggtgtccatcatcgccgagggccaactgtaccgcttcgacccctgggaactgccggagcgcgccctcttcggccgccggggagtgtacttcttcacgcgggggggacgcaagtaccccaagggctcccgccccaaccgggccggcggggtcgggctactggaaaggccacgggcgcggaacaagcccggggaagcacggggggccggaacgggggaggaaaaaaaaaggggctccgggttcccaaccacggaaaagcccgcgcgggggggggtaaaggaagggagggggaatcagggcgcgagttaccccccctcggccggggg

SEQ ID NO: 13835 - protein, 156 aa, Zea mays
  misc_feature: Ceres CLONE 1374878-F
  misc_feature (21)..(154): Pfam Name: NAM Pfam Description: No apical meristem (NAM) protein
MAAVQQQQQQQRRDAEAELNLPRGFRFHPTDEELVAHYLCPRAAGRRRPVSIIAEGQLYRFDPWELPERALFGRRGVYFFTRGGRKYPKGSRPNRAGGVGLLERPRARNKPGEARGAGTGEEKKRGSGFPTTEKPARGGVKEGRGNQGASYPPSAG

SEQ ID NO: 13836 - DNA, 659 bp, Zea mays
  misc_feature: Ceres CLONE 1374879-F
  misc_feature: Translation starting site: 333
  misc_feature: SWISSPROT Homolog: EC 2.7.11.24 Mitogen-activated protein kinase
gctctagaactagtggatcccccgggctgcaggaattcgcacgagaccattacctagaacatcctaatcgaaaaatccctcctcacggcacgggactcgcctcccccctcctcttcctcccctcccgcccacggctggaggtgctcacagcgagcggagcggaggcgagggattcggccgcgcgcatggcgacgcctctctgaccgaagctgctccacccactcggccagtacaaaatggcgatgatggtggatccctcccgaatggaatcggggaccagggaaagcattactactctatgtggcagaccttatttgagatagacaccaaatatgtgccgatcaagccccattgggcgaggagcttatgggatagtttgttcatccattaatcggggaaacaatgagaaagtagcaataaagaagatacaccacggttttcgacaagcggggggatgccctacggacccttgcgggagctgaaactccttcgccatctccgggatgagattgtcattgctttgaaggatatatggtgccaatacccaggagaagcttttaagggtggggtactgggaatacaaactcctggatactggattggcccagaaaatcaaatccccccggggcctttccatgaccactggcagtattttcttt

SEQ ID NO: 13837 - DNA, 668 bp, Zea mays
  misc_feature: Ceres CLONE 1374880-F
  misc_feature: Encodes the peptide sequence at SEQ ID NO. 13838
  misc_feature (409)..(409): n is a, c, t, g, unknown, or other
  misc_feature (485)..(485): n is a, c, t, g, unknown, or other
  misc_feature (505)..(505): n is a, c, t, g, unknown, or other
tccccgcggtggcggccgctctagaactagtggatcccccgggctgcaggaattcgcacgagaccattacctagaacatcctaatcgaaaactaacacttttcccgtctcccccttcctcgccgcctccactacagggctttgctcctcccaactctcgaaaccctacccacgcgatgagagatcgatcggtcgagcgcgaattccccagccgcgagcggggggatcggccgccgcccggggtgctgggtcccccgcgccgcgggccggcttacaagacgaagttgtgcgcgctgtggcagcgcggcggctgttcccgcgacacatgcagcttcgcgcacggacacgccgagctcccgccggttcccggatcgcgcacctcgtttccaccccgcgccgggagaagagantatagagggtgtgactttagaggataggttgataggaggcgctcacctcataggaggcattcccctgatggagatnccaggggccatcgctccttncgggaccgacgaccaaattcccaggaaaggaatctagctattcacgggtctccagtaggaagagggaatggggcatgataagaagcctgatgatggagaaactaactcatctagggagtctcagtgtctctgacaataatgatgatagaaaaaaggagaccct

SEQ ID NO: 13838 - protein, 86 aa, Zea mays
  misc_feature: Ceres CLONE 1374880-F
  misc_feature (33)..(57): Pfam Name: zf-CCCH Pfam Description: Zinc finger C-x8-C-x5-C-x3-H type (and similar)
  misc_feature (78)..(78): Xaa is any aa, unknown, or other
MRDRSVEREFPSRERGDRPPPGVLGPPRRGPAYKTKLCALWQRGGCSRDTCSFAHGHAELPPVPGSRTSFPPRAGRRXYRGCDFRG

SEQ ID NO: 13839 - DNA, 665 bp, Zea mays
  misc_feature: Ceres CLONE 1374886-F
  misc_feature: Encodes the peptide sequence at SEQ ID NO. 13840
  misc_feature (354)..(354): n is a, c, t, g, unknown, or other
  misc_feature (517)..(517): n is a, c, t, g, unknown, or other
tccccgcggtggcggccgctctagaactagtggatcccccgggctgcaggaattcgcacgagaccattacctagaacatcctaatcgaaaagatcgagctagatctccaggactcacctccccaaccgtttgcctccgtctcgcgtgacttcattcccagcggccggcggcgacctccacgtggtgccattcgccggcaacgagcacccgcccaccaggatccaggtttgtgctgcgagagggcctatccattcaccatgattaatttcgtgctcctgatcagccgccagggcaaggtgaggctcaccaagtggtattctccttacacccagaaagagaggacaaggtcattcncgaactcagtggactcattcttacacgaggggccaaactctgcaattttgttgagtggagaggtacaaggtcgtataccggagtatgctagcctggatttctgcatgggcattgatgcccaggacaatgaccttggaatccttgaaatcatccatcatttcgncaaaaaactggaccgtaatttggggaggggatggggagttggatttaaaaatccattttccaaaaaggcctactaactaacggggagggaattccccctcgcctgggggaattccaaaaatctacacaaaaaaaatggtttcagaaaa

SEQ ID NO: 13840 - protein, 111 aa, Zea mays
  misc_feature: Ceres CLONE 1374886-F
  misc_feature (1)..(107): Pfam Name: Clat_adaptor_s Pfam Description: Clathrin adaptor complex small chain
  misc_feature (33)..(33): Xaa is any aa, unknown, or other
  misc_feature (87)..(87): Xaa is any aa, unknown, or other
MINFVLLISRQGKVRLTKWYSPYTQKERTRSFXNSVDSFLHEGPNSAILLSGEVQGRIPEYASLDFCMGIDAQDNDLGILEIIHHFXKKLDRNLGRGWGVGFKNPFSKKAY

SEQ ID NO: 13841 - DNA, 695 bp, Zea mays
  misc_feature: Ceres CLONE 1374887-F
  misc_feature (300)..(300): n is a, c, t, g, unknown, or other
  misc_feature (301)..(301): n is a, c, t, g, unknown, or other
  misc_feature (319)..(319): n is a, c, t, g, unknown, or other
  misc_feature (323)..(323): n is a, c, t, g, unknown, or other
aagctggagctccccgcggtggcggccgctctagaactagtggatcccccgggctgcaggaattcgcacgagaccattacctagaacatcctaatcgaaaactcctgaacacaccacccctcgtctccccacggaggccgtcctctcctctcctctgcgtccgccactgcccaccgctcgcccgcgcgcgctccattacctcggcgggcgatggccgacctatccaacaccggctccacctaacacgagcagcgccccccgcctagcggcagctggctgggtcgtcgtcaagcagctagnncgcgcagcgcccggaggnaggncgtctcactctcctcgtcggggcggcaggagatggaggccatcgtgcccgcccgcgcgccgccgcgtggccgtgcctgggccgccctcaaaaagccgccgcgcgccgttggctgcccaaatcccaacgggaaggctcccggtcccggggaaaaagcccggaaaggtgggcctgtgggccccaaaaaccggaaggcccgggatcctcccccccgtgtgccccgcaaattgggggaaaaggaaaggcccccaacctggggggagcccccccccacaaaaaaaaagccccggggggttcccctatttggggggggggggggtttattggtgggggaaggggggcccgcaaaaaaccggggggaaaaaaactcacg

SEQ ID NO: 13842 - DNA, 692 bp, Zea mays
  misc_feature: Ceres CLONE 1374888-F
  misc_feature: Encodes the peptide sequence at SEQ ID NO. 13843
  misc_feature (692)..(692): n is a, c, t, g, unknown, or other
tcagaactagtggatcccccgggctgcaggaattcgcacgagaccattacctagaacatcctaatcgaaaaaagaaatccagtcggcggggctgccgcctgccgcatcctcccctcgcccaccgtcgacgacttgatcccctcccaccgttgaggccgcctcctcacggcagcgagccagcgactcctctcttcttcgtctcctacaagtagccagacaccactccgactttgccggcaacccgtcgacagcgacgaggcgcagcataaggcatacgggcacggggcccatggcgaccagctccaaacccgccgcgcccggggaccccatggtcgtgctcgcccacgagtgccccgagggggcattcgactacgacgagagggatggaacggttgtacgcgctccggggttgggggctgggggaaataaccccgtcaaaaaaaaaggagtttcctttccgggacccagggaaggggcacccacaaataaaaacccctcccaattttgggggtctttaatccccaacaaaaaaagcaagggggcttgggatttgtgggagggccgcgggccttaacttttggggggagcccttttcagggggggggccccgaaaaaaatagaagattttttggggccacccccctttttggggggggggggggtgaaaaagggggttaaaaaaagagggtgtn

SEQ ID NO: 13843 - protein, 94 aa, Zea mays
  misc_feature: Ceres CLONE 1374888-F
  misc_feature: The sequence is a functional homolog of SEQ ID NO 2 in US patent 7176349
MATSSKPAAPGDPMVVLAHECPEGAFDYDERDGTVVRAPGLGAGGNNPVKKKGVSFPGPREGAPTNKNPSQFWGSLIPNKKSKGAWDLWEGRGP

SEQ ID NO: 13844 - DNA, 784 bp, Zea mays
  misc_feature: Ceres CLONE 1374890-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (31)..(31): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (713)..(713): n is a, c, t, g, unknown, or other
  misc_feature (784)..(784): n is a, c, t, g, unknown, or other
nnnnnnnnnnnnnnnnnnnnaacgggggccnccnnntccctctccnnnnnaaaagctggagctccccgcggtggcggccgctctagaatagtggatcccccgggctgcaggaattcgcacgagaccattacctagaacatcctaatcgaaaactcttcttcgcattgcctttcccttcagttgcaccgacctccagacgaaaccacccaagacgcgtgcttccattcctagcccaacagaagcgaagcacgccaccgaccaccggcctcgaagggatcatcttctctacaactcgtcctcggggccttgttcctcctcttgtataggggactgcgggggagtggagatccggtgcgacataggccgacttcgtcgctcgctggctacgattggtgggctcacctttcaccaccccaagagttcaggaggggagcgagctcgggcagctcttggaccgcgatctccgaatcccctcccgaagacacctttcccccggcaaagggggagggaccccgccgatcttccagcgcaaagaaacggaaaacccgggcgatggggcccggacaaatttcagatgccgaaggtgggtggcccttcacaaagacctggtctttttggaagcccaaaacctggacgaagggcccttccccgaaggaggggccgctgcttaaaaacaaacggggggggattcccccgcggtcgaacttggggcngacacgcgaagggaactcgggggggcttgggcggagacccttttggaaacggtggaactttttttgggccn

SEQ ID NO: 13845 - DNA, 676 bp, Zea mays
  misc_feature: Ceres CLONE 1374891-F
  misc_feature: Encodes the peptide sequence at SEQ ID NO. 13846
  misc_feature (676)..(676): n is a, c, t, g, unknown, or other
ctggaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcgggtgcgtcccacccggtcaagctcggcgctttcagcccggaccaggaggacgcgtcggtgctgtggacggagagcagggacgggggcaaagggcttccgctggattcggagtggtcaacagcacccggcctcaactttcgacgcctttcccgggggacaaggaccaggggggggggtgaacgacgggcacccgcgcgtggtggcttctggggagggggggaaagggggcgaagaaccaaaaaggttggaaaaatccccgggcccgcgggggctccn

SEQ ID NO: 13846 - protein, 149 aa, Zea mays
  misc_feature: Ceres CLONE 1374891-F
MSWFGHHHHNQPAPPASGPNQVFKIFCRANENYCLAVRDGAVVLAPVNPKDDHQHWYKDMRFSTRVKDEEGMPAFALVNKATGLAIKHSLGCVPPGQARRFQPGPGGRVGAVDGEQGRGQRASAGFGVVNSTRPQLSTPFPGDKDQGGG

SEQ ID NO: 13847 - DNA, 892 bp, Zea mays
  misc_feature: Ceres CLONE 1374893-F
  misc_feature: Encodes the peptide sequence at SEQ ID NO. 13848
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (892)..(892): n is a, c, t, g, unknown, or other
nnnnnnnnnnnnnnnnnnnnnnnnnnnnnnnnnnnnnnnnnnnnnnnnngggggggggccaggagtaacaaagctggagctccccgcggtggcggccgctctagaactagtggatcccccgggctgcaggaattcgcacgagaccattacctagaacatcctaatcgaaaactgcacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatggttcaaaacgaatgcattttgggggaccaccaagacaatggtgttggccatgaggcaaagtacaacctgccatttggagggaaaaagatggattcctgaaaatcctgctacctaaggggggttcggggggtggtccctttttccaacttcaaaaaaatggacctgcctaacttccagacaaaaggtcccccgaaccaaaggcgtaaccctttccccttttaagtttgggacccaagtaacccggggtgtggcagcccccccctttctgggaacccgggggaggttcctggaacctttaatccccaggggagagacctaaccctctgggggggtgaaaaaaaccgcgcccccacccaaaagggaaacctaacccgggcacgggagcttgggcgccatccccaagcagaaaaagatagcgccccaagtttgacaacccaattcccccccccctcggggggcgcccaaagtgggtttttaaagaggggccccctcttcttggaccggaaaaaaagggggggggaaaccatatgaacgctcttaacaaacgcggggtgtgn

SEQ ID NO: 13848 - protein, 51 aa, Zea mays
  misc_feature: Ceres CLONE 1374893-F
  misc_feature: SWISSPROT Homolog: EC 5.3.3.2 Isopentenyl-diphosphate Delta-isomerase
MAAAVVDDAGMDAVQKRLMVQNECILGDHQDNGVGHEAKYNLPFGGKKMDS

SEQ ID NO: 13849 - DNA, 766 bp, Zea mays
  misc_feature: Ceres CLONE 1374896-F
  misc_feature: Translation starting site: 240
  misc_feature: Pfam Name: Ribosomal_S2 Pfam Description: Ribosomal protein S2
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (32)..(32): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
nnnnnnnnnnnnnnnnnnnncccccacccccnccccgcgtcnnnnnntaaaagtggggctccccgcggtggcggccgctctagaactagtggatcccccgggctgcaggaattcgcacgagaccattacctagaacatcctaatcgaaaattcggcgactatggcggcggcaccggcaggcggcggccctcgggcattgtcccagcgggagcaggacatccagatgatgctcgccgccgatgtccacctcggcaccaagaactgcgacttccagggtggagcgctacgtgtacaagcgccgcactgatggaatctatattattaaccttggaaagacctgggacaagcttcagttggccgccagggtcatcgttgccattgagaatccgcaggacattatcgtgcagtctgctaggccctatgggcggagggggtgtcctcaagtttgggcagtacactggggcccatggcattggtgggagccacactcctggtaccttcacccaccaggtggcaacctccttcgggggagcccggcttccttatccttacggacccgaggactgatcatccgcccctttaagggagtctggggcttggaaaacattccccaccattcgatttcgggggataccggactccccctaagggggttatggtggataattgggcatttcccggcccataaacaaggggaaaaccagaagccattggggtgtggccggggtccgggggtgggcgcccccccgaaagggggcccttcccg

SEQ ID NO: 13850 - DNA, 625 bp, Zea mays
  misc_feature: Ceres CLONE 1374898-F
  misc_feature: Translation starting site: 287
  misc_feature (252)..(252): n is a, c, t, g, unknown, or other
  misc_feature (283)..(283): n is a, c, t, g, unknown, or other
  misc_feature (625)..(625): n is a, c, t, g, unknown, or other
tccccgcggtggcggccgctctagaactagtggatcccccgggctgcaggaattcgcacgagaccattacctagaacatcctaatcgaaaatcatttttctctctcctgcgccgcgacgtccctcgccttcgccgccgaatccgagactccgatctcgggttcaccgcagcgcacagagcagccccgactcccggcccgatccgcgctctcctctccgtcgcttcagtcatggcaggaatggcacctgaggnttctcagttcgatgctaagcactatgattcntagatgcaggagctgctgagcactggtgagactgaggagttcttcacttcatatgatgaagtttttgagagttttgatgatatgggcctccgagaggatcttctgagaggcatttatgcttatggttttgagaagccctctgcgattcagcagagaggaaattgtcccttctggcagggtcttgatgtcattcagcaagcacaatctggtacaggaaagaacagcaccttctggttctgggatcttgcagcagctggactatggcctgggtgatggcagggccctggtccttgctcccacccgtgagctggacagcaaattgagaagtcatgggagcgcttn

SEQ ID NO: 13851 - DNA, 645 bp, Zea mays
  misc_feature: Ceres CLONE 1374901-F
  misc_feature (281)..(281): n is a, c, t, g, unknown, or other
  misc_feature (365)..(365): n is a, c, t, g, unknown, or other
  misc_feature (368)..(368): n is a, c, t, g, unknown, or other
  misc_feature (410)..(410): n is a, c, t, g, unknown, or other
  misc_feature (416)..(416): n is a, c, t, g, unknown, or other
tccccgcggtggcggccgctctagaactagtggatcccccgggctgcaggaattcgcacgagaccattacctagaacatcctaatcgaaaaacaaacccaacttccaccagacccctaaccttttcgcagctccagcgcacagccgccgccgtttcttcatcttcttcgcagagccggcgctccatcttcggctccctcccttacttgcgctcggcacgcaggcggcgctgtggctcgggatctcagtgacggcatcaggggcttcccctccccgctctcngcagtcgcctccggtcctccgcacaccgggcggtgatctctctccctccgccctcggtggatcgtcaacggcgccgggccccgncgnctgcgtcgcgcgcgtcctggaggcagctgcaggcgctgctcnactaanggcgtcgcgccgctttgggagcggttatgccccaaagtgagcgtgctcttagtgccgctcttggaaccctggaatggctactgctgttaaatgctcaccttcagtcattctagcactggcagttatgatcacacaatcagattttgggaagccaagaggggccgctggtaccggactattcaggattcagactccccagtttatccgcctgggaataacccctggaaag

SEQ ID NO: 13852 - DNA, 699 bp, Zea mays
  misc_feature: Ceres CLONE 1374902-F
  misc_feature (346)..(346): n is a, c, t, g, unknown, or other
  misc_feature (354)..(354): n is a, c, t, g, unknown, or other
  misc_feature (543)..(543): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagttaaattaggctccctctacatctgatccagctaagtagctagccagcactacagaaggcgtgccaggatcaggagagagatagcaggggggctagctagctgagctcgtgccacgaagaatggnccgaattngcaggaaacatgtggcccccgctcctggtgctcaacctcatcatggacatcatcggcatcggcttgcgggagctggaacctggaccccttcatcagggggcagaccaactaccccggcggggccggcaaacggggcgacgttctacttcctggtgtttccccatcttggccggggtggtgggcccgccnttccaagctgggggggggtgcaaccacgtggcgcgccctggggccccgaacagccttggccaccaacggccgcgtcgttccctcatccccctggcccatcaacgggggctcccctttcggggttggcctgcaaagaagaatcccacatcgggggga

SEQ ID NO: 13853 - DNA, 654 bp, Zea mays
  misc_feature: Ceres CLONE 1374908-F
  misc_feature: Encodes the peptide sequence at SEQ ID NO. 13854
  misc_feature (355)..(355): n is a, c, t, g, unknown, or other
  misc_feature (369)..(369): n is a, c, t, g, unknown, or other
  misc_feature (425)..(425): n is a, c, t, g, unknown, or other
  misc_feature (450)..(450): n is a, c, t, g, unknown, or other
  misc_feature (472)..(472): n is a, c, t, g, unknown, or other
  misc_feature (473)..(473): n is a, c, t, g, unknown, or other
  misc_feature (481)..(481): n is a, c, t, g, unknown, or other
  misc_feature (482)..(482): n is a, c, t, g, unknown, or other
  misc_feature (493)..(493): n is a, c, t, g, unknown, or other
  misc_feature (584)..(584): n is a, c, t, g, unknown, or other
  misc_feature (600)..(600): n is a, c, t, g, unknown, or other
  misc_feature (653)..(653): n is a, c, t, g, unknown, or other
tccccgcggtggcggccgctctagaactagtggatcccccgggctgcaggaattcgcacgagaccattacctagaacatcctaatcgaaaaaaccgcatcatcctttccctcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggngtccccttccgccngctcagcggccactcccacttcgtccaggacgtcgtcctcagttccgacgggcagntcgccctttccggctcctgggatgnagagctcccgctctggggactnnctcacggnnctcacacccgncgctttcgtcgccacgagaaggatgtcctctcccgtgccttctccgttgacaaccgcagatcgtctccgcgtcccgcgacaagacattaangctctgaacacctcgntgagtgcaagacaccatcggaggtgacctcgtgggcgcgaaggccacaacggng

SEQ ID NO: 13854 - protein, 140 aa, Zea mays
  misc_feature: Ceres CLONE 1374908-F
  misc_feature (8)..(47): Pfam Name: WD40 Pfam Description: WD domain, G-beta repeat
  misc_feature (70)..(70): Xaa is any aa, unknown, or other
  misc_feature (89)..(89): Xaa is any aa, unknown, or other
  misc_feature (97)..(97): Xaa is any aa, unknown, or other
  misc_feature (105)..(105): Xaa is any aa, unknown, or other
  misc_feature (108)..(108): Xaa is any aa, unknown, or other
MAGAQESLSLVGTMRGHNGEVTAIATPIDNSPFIVSSSRDKSLLVWDLTNPVHSTPESGATADYGVPFRXLSGHSHFVQDVVLSSDGQXALSGSWDXELPLWGLXHGXHTRRFRRHEKDVLSRAFSVDNRRSSPRPATRH

SEQ ID NO: 13855 - DNA, 710 bp, Zea mays
  misc_feature: Ceres CLONE 1374912-F
  misc_feature: Encodes the peptide sequence at SEQ ID NO. 13856
  misc_feature (330)..(330): n is a, c, t, g, unknown, or other
  misc_feature (409)..(409): n is a, c, t, g, unknown, or other
  misc_feature (422)..(422): n is a, c, t, g, unknown, or other
  misc_feature (537)..(537): n is a, c, t, g, unknown, or other
tggagctccccgcggtggcggccgctctagaactagtggatcccccgggctgcaggaattcgcacgagaccattacctagaacatcctaatcgaaaagatttcttctcttaactctcgcgtctcgcgtccttttcccttcctcccctccgttgcgtccctccgtccgtccgtccgtcgtcaccagcctcctccctcgcgcccaccgccgggatccgtccctcctcgtctgcgcccgcctcggtctagatttctgagaaaatggcgagaagtgcgggaactaggaggcgtgtgggctcgcagctcaagtccacacatcccattccttcatnacgatggaagtcaaagcccatgaaaaaagcgatgaaaaaatccacccgaaagcagtgttgccaacctttgcaaagatgnactgggaagatgncaattgctctgtgtgcatggaataccacataatgctgtgctcatcctttgctcatccatgataaaggttgtcgtccctatatgggtggactagctaccgcactctaatggctggnatcaggtcaagaaagcttacacaagggggcatggcttgaggaagtcctgcaataagggtggctctaatcggaattcgcgccattgctggaaaaaaaatgactccattgactttcatgcccattggggccgggaaggggaaaagggtgaaccgtggtgaacccatttcaaatac

SEQ ID NO: 13856 - protein, 64 aa, Zea mays
  misc_feature: Ceres CLONE 1374912-F
  misc_feature (24)..(24): Xaa is any aa, unknown, or other
  misc_feature (50)..(50): Xaa is any aa, unknown, or other
  misc_feature (55)..(55): Xaa is any aa, unknown, or other
MARSAGTRRRVGSQLKSTHPIPSXRWKSKPMKKAMKKSTRKQCCQPLQRXTGKMXIALCAWNTT

SEQ ID NO: 13857 - DNA, 728 bp, Zea mays
  misc_feature: Ceres CLONE 1374913-F
ggagctccccgcggtggcggccgctctagaatagtggatcccccgggctgcaggaattcgcacgagaccattacctagaacatcctaatcgaaaaacactctgcccagctaagctccctccgtccatcggcatggcgactaccactactaccatcctcctcctcctcctcgtcgaacaactgccgtctcggcggccgacctctccgtgtaccacaacgtgcacccgccatcccggtcccgctcgagtcaatcatcgcgctcgcccgcgccgaggaggggcggttcttcttctcctcatcaaggggggcctcgacggggggggccactccggtcccggtcgcctccgggcaaaattcggccctcgtaactcggccggggggggttcagaacccccgttccaaaagttggttctcccggtcgaaaccaaagccaaaaccacctgggttcaattggcgcgctgggaaacctggcccccccggaagggggtttttcccgggaaagtccctctcgaaagccctccctcccgggggccttcaaagggggcccccttctttaagagggcccccggggcccgaaaacaaaaaaccctcggggcccttgggggggagggccctcttcaaaggcttttgggggacacccttttaagggggtttggggaaaaaacaccttcctccgggggaagagaccccccccggtatatctcttggggggggggggggggagggact

SEQ ID NO: 13858 - DNA, 739 bp, Zea mays
  misc_feature: Ceres CLONE 1374916-F
  misc_feature: Encodes the peptide sequence at SEQ ID NO. 13859
  misc_feature (508)..(508): n is a, c, t, g, unknown, or other
  misc_feature (509)..(509): n is a, c, t, g, unknown, or other
  misc_feature (573)..(573): n is a, c, t, g, unknown, or other
  misc_feature (682)..(682): n is a, c, t, g, unknown, or other
  misc_feature (694)..(694): n is a, c, t, g, unknown, or other
  misc_feature (695)..(695): n is a, c, t, g, unknown, or other
  misc_feature (739)..(739): n is a, c, t, g, unknown, or other
tccccgcggtggcggccgctctagaactagtggatcccccgggctgcaggaattcgcacgagaccattacctagaacatcctaatcgaaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggctggcaggctaaagggctccacgctccttaccgaaggagtggtgacggatggatccgatgaatggggcatctacnngcggaccggagagtttgctatggcgagaggtgtcgtcaaaagaaggtacccttgcgatagggancgcgccgggaacactgacgagctcagcatgcagttttcctggcccggtgtttggctcatcacagcacccaaacagcaggactcccacatctctgtcaccagaatggggntatggggggggnnaaaaagaggggtccgcgcaagacatcacgacgacggagccacgn

SEQ ID NO: 13859 - protein, 200 aa, Zea mays
  misc_feature: Ceres CLONE 1374916-F
  misc_feature (124)..(124): Xaa is any aa, unknown, or other
  misc_feature (145)..(145): Xaa is any aa, unknown, or other
  misc_feature (182)..(182): Xaa is any aa, unknown, or other
  misc_feature (186)..(186): Xaa is any aa, unknown, or other
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGRLKGSTLLTEGVVTDGSDEWGIYXRTGEFAMARGVVKRRYPCDRXRAGNTDELSMQFSWPGVWLITAPKQQDSHISVTRMGXWGGXKRGVRARHHDDGAT

SEQ ID NO: 13860 - DNA, 707 bp, Zea mays
  misc_feature: Ceres CLONE 1374918-F
  misc_feature: Translation starting site: 174
  misc_feature: SWISSPROT Homolog: EC 1.11.1.11 L-ascorbate peroxidase
ggagctccccgcggtggcggccgctctagaactagtggatcccccgggctgcaggaattcgcacaagaccattacctagaacatcctaatcgaaaaaccgaattcattccacccccgtctcctccgatcggaccaccgggccagcagcggggcggatcgtgacgtcagcagccatggtgaaggcctaccccacggtgaacgaggactacctcaaggcggtcgacaaggccaagcgcaggctccgcggcctcatcgccgagaagaattgcgccccgctcatgctccgcctcgcatggcactccgcgggcaccttcgatgtggccaccaagaccggggggccccttcgggaccatgaagaacccccgcgagcagggggagggggagcaacgccgggactggaaaaggccatcaggctgctagagcccatcaagggagcagttccccatcctatcctacgctgacttctaccagcttgttggaggccggggcaagtcgagggaaccggggggaccctgatggtccccttccccccccgggaggggaggaaaaggcctgaaccctccaccggaagggccgcctttcctggatgccccccaagggttcttgatccacctcgggcggggttttcttccaaacaggatggggttggagcggacccaagaacattggttgggcttttctgggggggccaccccgggggaaagacg

SEQ ID NO: 13861 - DNA, 733 bp, Zea mays
  misc_feature: Ceres CLONE 1374919-F
  misc_feature (176)..(176): n is a, c, t, g, unknown, or other
  misc_feature (312)..(312): n is a, c, t, g, unknown, or other
  misc_feature (451)..(451): n is a, c, t, g, unknown, or other
  misc_feature (534)..(534): n is a, c, t, g, unknown, or other
  misc_feature (535)..(535): n is a, c, t, g, unknown, or other
ggagctccccgcggtggcggccgctctagaactagtggatcccccgggctgcaggaattcgcacgagaccattacctagaacatcctaatcgaaaagttctctctccctccccctttcctctggtcatcgcacccgtctccccgctctgactccgcccgcgccgccgactcccggnacggccccccaggcttcatctccgccgccgccgtcgccgccgcctcgctccgatcgacccccgaaacgccggaaaccgtgggcttcgcgaggttgcctctcttcgtccagcggagataaataacatgcgacaggtngaatttgcagagagaagggggggcatttggtcgctgcatgatggcggaggcccccaatttcgctgggatgatttgtgggcaattgacaaatgggggggattttctgcgacatgggatactacccggaaacttggcggangctctccaacaatgtcggtagacacccttaatagaatgcagacagccacactggtggctccttgggatgtctgtgaccacaannaagggtaaggtcctggactcccatactaagatgctcatcaccttggctcaggggaactgtcgttggaaaataacccggtcgggggaaaagatttttcccgcaaggggacgggggctcaacgctttgaggaacatggcttgggaaaaaggggttttgggacccaagtacccactgaaaacccagggggtttttgggggg

SEQ ID NO: 13862 - DNA, 670 bp, Zea mays
  misc_feature: Ceres CLONE 1374921-F
  misc_feature: Encodes the peptide sequence at SEQ ID NO. 13863
  misc_feature (670)..(670): n is a, c, t, g, unknown, or other
ccccgcggtggcggccgctctagaactagtggatcccccgggctgcaggaattcgcacgagaccattacctagaacatcctaatcgaaaaaattaaagaaaaaggaaattttcttgggcgttcttcggcttcattgtcacaaggttcgagttcgtcaccgtctagtacgactgtgcgaggcaggaagaggcgaggataacatgcacatcttcgtggagaccctgacgggggacgacatcaccctcgaggtggagagcattgacaccgtcgacaacgtcaaggccaacatcagggacaaggaagggattcccccatatcaacagcgactgatattcgctggcaagcacctggaggatgcacgcacgctgggtggactacacatcccaaaggagtcaactcttcatttggtcctcaggcttaggggtggcatcatgatcaaggccaaactctcactgggaagagatcgagatcgactttgaccccctgactcctatggcaggaccagggagcggggtgaaaaaaaagaatgtattccctccgggggaggaagggctcatctatgctgggaaagcagtttggcgagggaaaagaccggaaaaggacctaccaggtggggggggggaaacgggcccccccatcttgggcccttggcccgggggggggggggtcn

SEQ ID NO: 13863 - protein, 92 aa, Zea mays
  misc_feature: Ceres CLONE 1374921-F
  misc_feature (6)..(74): Pfam Name: ubiquitin Pfam Description: Ubiquitin family
MHIFVETLTGDDITLEVESIDTVDNVKANIRDKEGIPPYQQRLIFAGKHLEDARTLGGLHIPKESTLHLVLRLRGGIMIKAKLSLGRDRDRL

SEQ ID NO: 13864 - DNA, 696 bp, Zea mays
  misc_feature: Ceres CLONE 1374926-F
  misc_feature: Encodes the peptide sequence at SEQ ID NO. 13865
  misc_feature (177)..(177): n is a, c, t, g, unknown, or other
  misc_feature (180)..(180): n is a, c, t, g, unknown, or other
  misc_feature (219)..(219): n is a, c, t, g, unknown, or other
  misc_feature (242)..(242): n is a, c, t, g, unknown, or other
  misc_feature (295)..(295): n is a, c, t, g, unknown, or other
  misc_feature (366)..(366): n is a, c, t, g, unknown, or other
  misc_feature (367)..(367): n is a, c, t, g, unknown, or other
  misc_feature (465)..(465): n is a, c, t, g, unknown, or other
  misc_feature (696)..(696): n is a, c, t, g, unknown, or other
ggcggccgctctagaactagtggatcccccgggctgcaggaattcgcacgagaccattacctagaacatcctaatcgaaaacgagtcgtcttcccgttgatcggcaaagagactttagggttttagcggcttctatttctgagcgagggtttatccgccaggggcggcgcgacgcgncgncagttgagctgggatttccttcccatcccgtcccttccnagcgagcgatggacgagggcgcngtcgacgacctcatccgggcgctcctcgaggcccgcgcgggcgcaccccgcgncacgcgcaggtgaccgacgctgagatccggcgcctctgcgccgccgccaggatgtgttcctctcccagccnnacctctggagctcgaggcccccatcagatatgcgggatgtcatggtcagtatcagaccttctcgatattggaggatggggggctatcacagatgcaantatctggtcctcgtgactatgttgaaggggggaacagagctagaaacatatggcttctctgggatacaagataaagacccagaaacttctttctctcaggggaaccatgatgcgcccatcacccaattatatggtttttttgatgaggaagaggagatcatggtctatctgaaaaaatccccgatggtttactgcccccagggctgccttatgatgacaacctgggcgggn

SEQ ID NO: 13865 - protein, 100 aa, Zea mays
  misc_feature: Ceres CLONE 1374926-F
  misc_feature (23)..(23): Xaa is any aa, unknown, or other
MRDVMVSIRPSRYWRMGGYHRCXYLVLVTMLKGGTELETYGFSGIQDKDPETSFSQGNHDAPITQLYGFFDEEEEIMVYLKKSPMVYCPQGCLMMTTWAG

SEQ ID NO: 13866 - DNA, 695 bp, Zea mays
  misc_feature: Ceres CLONE 1374929-F
  misc_feature: Encodes the peptide sequence at SEQ ID NO. 13867
  misc_feature (428)..(428): n is a, c, t, g, unknown, or other
  misc_feature (453)..(453): n is a, c, t, g, unknown, or other
  misc_feature (640)..(640): n is a, c, t, g, unknown, or other
  misc_feature (641)..(641): n is a, c, t, g, unknown, or other
tggcggccgctctagaactagtggatcccccgggctgcaggaattcgcacgagaccattacctagaacatcctaatcgaaaaattatcacggcggcggtggcggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctggnttcatggatgtcatttccatccccnagaccaatgagaactacaggctgctgtacgataccaagggcggcttcgccttcacccaatcagggatgaggatgctaagttcaagctttggcagggtaggtcctggtcagtttgggcagaagggcatcccctatctgaccacgtatgacgggccgaccattccgctaccctgaccccctcatcaggnncacgaccccatcaaggatcgatctggagaccaacaggattgtggccttcttcca

SEQ ID NO: 13867 - protein, 150 aa, Zea mays
  misc_feature: Ceres CLONE 1374929-F
  misc_feature (3)..(40): Pfam Name: RS4NT Pfam Description: RS4NT (NUC023) domain
  misc_feature (42)..(90): Pfam Name: S4 Pfam Description: S4 domain
  misc_feature (94)..(94): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPXTNENYRLLYDTKGGFAFTQSGMRMLSSSFGRVGPGQFGQKGIPYLTTYDGPTIPLP

SEQ ID NO: 13868 - DNA, 753 bp, Zea mays
  misc_feature: Ceres CLONE 1374930-F
  misc_feature (218)..(218): n is a, c, t, g, unknown, or other
ggagctccccgcggtggcggccgctctagaatagtggatcccccgggctgcaggaattcgcacgagaccattacctagaacatcctaatcgaaaaaaggttcccgtggtcgtcccacactcccacccctaccaacgctctgcgccaacgaacgcgtccgcaagtcaaaccaggcccggagccaccagcaaccacccgagcgcatggaggccgcggcgncgaccgcgctcccgttcgcggcggccgtccccactggctgtagggtgggcgcgagcccgcgaacgcggcggcgctccggggggggggaactggaaccccgcctccggcaaggggcctcccaccaccaactaatgggggcccctcaacaaggcccccgggaaggaccccccccctccgccaaatcctggggaaacctcaaaaaagggcccccccgaacaaaaacatccacccccaaaactaacccccggcaagtgggaccaatgaaaaaagaatggctttttttttaacgccccacggtggggggggaaaaatcccgcgatgtaatcattcccgaaaaagggaaatgtgacccggggttttcggaggggaactttaagggaacgggagggggaggttaacggaggtccccggggcccacccaacataactggggggcccaaaggaaatcctttttccccccccaaaaaaaattgttttttgcaaagccgggggcggggtaacttttttgccccgaacccgtcccccccgggtggtg

SEQ ID NO: 13869 - DNA, 707 bp, Zea mays
  misc_feature: Ceres CLONE 1374932-F
  misc_feature: Encodes the peptide sequence at SEQ ID NO. 13870
  misc_feature (624)..(624): n is a, c, t, g, unknown, or other
  misc_feature (667)..(667): n is a, c, t, g, unknown, or other
ggagctccccgcggtggcggccgctctagaactagtggatcccccgggctgcaggaattcgcacgagaccattacctagaacatcctaatcgaaaaatacgcacctaccctccgccaccgttccccccctctgcatctcgcccgccgttctcgtccttgtagatctcctcgcacctcgcccattcgcttcaccaagggtttaagaccggcggcgatggcggcgaagctggcgcagctgcgcacacaggtaacgcgtgcggcggagttcgcctcgaagcacggctgctcctactacaaggaggtaatggagaagaacaagcagtacgtcgttcagccccccaccgtcgagaagtgccaggagctctccaagcagctcttttacacccgcctcgcaagcctaccaggtcgctatgagtcattctggaaggagcttgattgtgtcaagcaggtatggaagaacaggaaggacctcacggttgaggaccttggcattgccagtttgtttggagtgagctctatgcatggttctgcgtaggcgagattgtccggcagaggtttcacttgaccggctataaggtctagatgatttccactggtcaagacctgcttatataatgatactcnttagctgatgcttgcgaaacgacgacatggaaccctgcttggntcccaatttttgttcttttggaaaaagttaccctagggcg

SEQ ID NO: 13870 - protein, 106 aa, Zea mays
  misc_feature: Ceres CLONE 1374932-F
  misc_feature (8)..(107): Pfam Name: ATP-synt_G Pfam Description: Mitochondrial ATP synthase g subunit
MAAKLAQLRTQVTRAAEFASKHGCSYYKEVMEKNKQYVVQPPTVEKCQELSKQLFYTRLASLPGRYESFWKELDCVKQVWKNRKDLTVEDLGIASLFGVSSMHGSA

SEQ ID NO: 13871 - DNA, 732 bp, Zea mays
  misc_feature: Ceres CLONE 1374935-F
  misc_feature: Encodes the peptide sequence at SEQ ID NO. 13872
  misc_feature (368)..(368): n is a, c, t, g, unknown, or other
  misc_feature (394)..(394): n is a, c, t, g, unknown, or other
  misc_feature (415)..(415): n is a, c, t, g, unknown, or other
  misc_feature (452)..(452): n is a, c, t, g, unknown, or other
  misc_feature (593)..(593): n is a, c, t, g, unknown, or other
  misc_feature (615)..(615): n is a, c, t, g, unknown, or other
tccccgcggtggcggccgctctagaactagtggatcccccgggctgcaggaattcgcacgagaccattacctagaacatcctaatcgaaaaatgggtaattcctcgctcccggattcagcgtcgggtttctctctctctctctacaattatcactacctgctgctccctcatgcaccgtgctcaaatctgaccaaagtgggttctgctgactgttttttgtgtttttttggggtctctcgatcttctctggatgcaggcaagattaagatcggaatcaacggcttcggaaggatcggcaggctcgtgggccaggtcgccctccagagcgaggatgtcgagctcgtcgccgtcaacgaccccttcatcnacacggactacatgacctacatgttncagtacgacaccgtccacggncactggaagcacagcgacatcacactcaaggactccnaagaccttctcttcggtgacaagccggtcaccgtctttggcatcaggaaccctgaggaaaaatccgtggggtgaggctggcgctgagtatgtcgtggagtccaccggcgtcttcactgacaaggacaggctgctgcacatnctcagggtggtgccaagaaggnttgtatctctgccccaagaagacgcacccatgttttgttttgtgtgtcaatgaggacagcacacctcggatggttacattgttccaatgctagctgcacaacaactgcctgctcccc

SEQ ID NO: 13872 - protein, 144 aa, Zea mays
  misc_feature: Ceres CLONE 1374935-F
  misc_feature (58)..(145): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (93)..(93): Xaa is any aa, unknown, or other
  misc_feature (101)..(101): Xaa is any aa, unknown, or other
  misc_feature (121)..(121): Xaa is any aa, unknown, or other
MGNSSLPDSASGFSLSLYNYHYLLLPHAPCSNLTKVGSADCFLCFFGVSRSSLDAGKIKIGINGFGRIGRLVGQVALQSEDVELVAVNDPFIXTDYMTYMXQYDTVHGHWKHSDITLKDSXDLLFGDKPVTVFGIRNPEEKSVG

SEQ ID NO: 13873 - DNA, 725 bp, Zea mays
  misc_feature: Ceres CLONE 1374937-F
  misc_feature: Encodes the peptide sequence at SEQ ID NO. 13874
  misc_feature (280)..(280): n is a, c, t, g, unknown, or other
  misc_feature (393)..(393): n is a, c, t, g, unknown, or other
  misc_feature (429)..(429): n is a, c, t, g, unknown, or other
  misc_feature (443)..(443): n is a, c, t, g, unknown, or other
  misc_feature (678)..(678): n is a, c, t, g, unknown, or other
  misc_feature (687)..(687): n is a, c, t, g, unknown, or other
ggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggncgcccgatgggtgagcaggtgaagggcatgctccacgacaaggggccgacggcgtcgcaggcgctgacggtggtgacgctgttccccgctgggcggctgctgctggtgctgtncgggctggcgctgacggcctccgtggtggggctggncgtggccacgccgntgttcctgatcttcagccccgtgctcgtccccgccgcgctgctcatcgggacggccgtcatggggtccctcacgtcgggcgcgctgggggctcggggggcctgtcctcgctcacgtgcctcgccacacgggggcggagggcgttcagcgcaccccggactaacgtggaggaggcgcacgcaaggatgcggaagccgcggcgcacgcggccacaagaccgcggcaggaggccagcnatccagggncaggccgcaggaagccgccccccggaggaaggggcagg

SEQ ID NO: 13874 - protein, 175 aa, Zea mays
  misc_feature: Ceres CLONE 1374937-F
  misc_feature (44)..(161): Pfam Name: Oleosin Pfam Description: Oleosin
  misc_feature (65)..(65): Xaa is any aa, unknown, or other
  misc_feature (77)..(77): Xaa is any aa, unknown, or other
  misc_feature (82)..(82): Xaa is any aa, unknown, or other
  misc_feature (160)..(160): Xaa is any aa, unknown, or other
  misc_feature (163)..(163): Xaa is any aa, unknown, or other
MADRDRSGIYGGAHATYGQQQQQGGGGRPMGEQVKGMLHDKGPTASQALTVVTLFPAGRLLLVLXGLALTASVVGLXVATPXFLIFSPVLVPAALLIGTAVMGSLTSGALGARGACPRSRASPHGGGGRSAHPGLTWRRRTQGCGSRGARGHKTAAGGQXSRXRPQEAAPRRKGQ

SEQ ID NO: 13875 - DNA, 683 bp, Zea mays
  misc_feature: Ceres CLONE 1374939-F
  misc_feature: Encodes the peptide sequence at SEQ ID NO. 13876
  misc_feature (393)..(393): n is a, c, t, g, unknown, or other
  misc_feature (413)..(413): n is a, c, t, g, unknown, or other
  misc_feature (425)..(425): n is a, c, t, g, unknown, or other
  misc_feature (426)..(426): n is a, c, t, g, unknown, or other
  misc_feature (463)..(463): n is a, c, t, g, unknown, or other
ctccccgcggtggcggccgctctagaactagtggatcccccgggctgcaggaattcgcacgagaccattacctagaacatcctaatcgaaaaacaagaggtggccgccgcagtccgcaccccctccccaatcacgccacccgacaccgcgctccgcagattcgtagtcgccgctaggcttccggcgagatggacgtggtgaaggcggcgcagttgtcggggcggacgctggaacgggtagtggtgcatcccttggtgctgctcagcatcgtcgaccactacaaccgcgtcgcccgcgacacccgcaagcgcgtcgtcggcgtcctcctcgcacctcatcccgcgggtccgtcgatgtcaccactcctacgccgtggcgttttgaggagatgancaggatcctaggatctggtncttttgacacanntacacggagtcatgttctccatggtcaagagggatantgccaaggaccatgttggtggctggtacagcactggcccaaactaggggagacggacttggatggccatgcattattcaacggttatggtccaaacccagcctgggggattatggggggccaacccagggggttgggtataccgaacaaggggaacacggtgggggggggggggaaaaagaaaggccctcaaaaaaagccaaagggtttttggcccgttt

SEQ ID NO: 13876 - protein, 67 aa, Zea mays
  misc_feature: Ceres CLONE 1374939-F
MDVVKAAQLSGRTLERVVVHPLVLLSIVDHYNRVARDTRKRVVGVLLAPHPAGPSMSPLLRRGVLRR

SEQ ID NO: 13877 - DNA, 716 bp, Zea mays
  misc_feature: Ceres CLONE 1374943-F
  misc_feature: Translation starting site: 223
  misc_feature (488)..(488): n is a, c, t, g, unknown, or other
  misc_feature (563)..(563): n is a, c, t, g, unknown, or other
  misc_feature (564)..(564): n is a, c, t, g, unknown, or other
  misc_feature (612)..(612): n is a, c, t, g, unknown, or other
tctgaactagtggatcccccgggctgcaggaattcgcacgagaccattacctagaacatcctaatcgaaaagtgttacctcacccatacatggcaccatctactgcttccctatcccccgcctgctgtgttcactaacccacctccgtcccccgttgcgggtccccctccccgtcagaaggttccccagatttatagcccggagtagcggcggcgacggggcatgcgctcggagcccaaaccagcttacaacgagagcaaggccatccctgatgccttcttccttgagaaggcctccgcggaggcgttcacggagcgagtcgagtcggtattggcctagtgggcgaggtattcaacatcgtcaggcagtggcaaactcagcagcagaagcaggtctaggagttccagaagtagcaaagttttattatttcctggctggagagcagtttacatgaaaagataattgaggcatgcaacaaccttattgcnaagctcaagtaagtgaggtagtcacgaatggctcagttgatgaattccctgaatcacattttccatatggctcgnnaacaacggttggggtggaaatgccccactggaggtatgcagctttacnataagatttggctcattggatgtgaccccatggctttactcggtcacaaacatctttgagcaaggctcagcggaagtaggtaaagccctccctgaatagaaatt

SEQ ID NO: 13878 - DNA, 713 bp, Zea mays
  misc_feature: Ceres CLONE 1374947-F
  misc_feature: Encodes the peptide sequence at SEQ ID NO. 13879
tccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtctttgcgagcatgatgtcgcaaatgatgatgccacaatgtcactgcgacgccgtctcgcagattatgctgcaacagcagtttacattcatgttcaacccaatgggcatgacgattccacccatgttctacagcacccctttgttggtgctgcatccagaaagaaatattttgtggtgatcgataaatgattgacttgccatccgcgtgggactcataatacaaataaaccagtttcctctaaaaaaaaaaaagtaaccccccccccccc

SEQ ID NO: 13879 - protein, 156 aa, Zea mays
  misc_feature: Ceres CLONE 1374947-F
MAAKMLALFALLALCASATSATHIPGHLPPVMPLGTMNPCMQYCMMQQGLASLMACPSLMLQQLLALPLQTMPVMMPQMMTPNMMSPLMMPSMMSPMVFASMMSQMMMPQCHCDAVSQIMLQQQFTFMFNPMGMTIPPMFYSTPLLVLHPERNILW

SEQ ID NO: 13880 - DNA, 753 bp, Zea mays
  misc_feature: Ceres CLONE 1374948-F
  misc_feature (409)..(409): n is a, c, t, g, unknown, or other
  misc_feature (415)..(415): n is a, c, t, g, unknown, or other
  misc_feature (416)..(416): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (428)..(428): n is a, c, t, g, unknown, or other
  misc_feature (438)..(438): n is a, c, t, g, unknown, or other
  misc_feature (441)..(441): n is a, c, t, g, unknown, or other
  misc_feature (618)..(618): n is a, c, t, g, unknown, or other
  misc_feature (663)..(663): n is a, c, t, g, unknown, or other
  misc_feature (686)..(686): n is a, c, t, g, unknown, or other
  misc_feature (698)..(698): n is a, c, t, g, unknown, or other
  misc_feature (742)..(742): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (751)..(751): n is a, c, t, g, unknown, or other
ggagctccccgcggtggcggccgctctagaactagtggatcccccgggctgcaggaattcgcacgagaccattacctagaacatcctaatcgaaaagtccgatctctctcccgagtccactccaagccttttcgccttttcctccgccttctcgcgatggcgccgccgcgccgcgctctactcgacctcgccgctctcctcctctccctctcccttggcggcgcctccttccattccgatgtcatcctcatcatccatgacgaacagcccagttacttgtttgccgcccgtcggccccctcgccggggaaacatagtgtgcaaagggcgtcttacatgacatgctagtaatagtgcctgttactgcttgacgcagggtgagagcaaagctcactgtgtggtggtacgtnataggnnttgnnnaacggnaaacggcttncgncctcagctgggaacctttcttcggcccgccctcaaggacctttcggccagaatcaaactcgttatccctttcgggcaaagatgaagttcccaaatttcagaaccacacaagtgtgacaacctggcatcatttgggatttatatgggtttggccttaaggcaagtggcttgcataatnctcccatagttggcggtgtatcggccggattgatgagctttcagngcttccagctgctctctggtatncccgaatggggnaaactgcacggttgcgcttgatgaacccacaccagtgatgcagnttnnnnttntt

SEQ ID NO: 13881 - DNA, 736 bp, Zea mays
  misc_feature: Ceres CLONE 1374949-F
  misc_feature: Encodes the peptide sequence at SEQ ID NO. 13882
  misc_feature (516)..(516): n is a, c, t, g, unknown, or other
  misc_feature (570)..(570): n is a, c, t, g, unknown, or other
  misc_feature (578)..(578): n is a, c, t, g, unknown, or other
  misc_feature (579)..(579): n is a, c, t, g, unknown, or other
aaagctggagctccccgcggtggcggccgctctagaactagtggatcccccgggctgcaggaattcgcacgagaccattacctagaacatcctaatcgaaaacactccctcccccccgcctccactaccccactcccaggcgccgcacaggtacgtcgccggcggcgatgacgacgcgcttcaagaagaaccgcaagaagcgcggccacgtgtccgccgggcacggccgcatcggcaagcaccggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaaaaggcggcggaagccgtcggcgacaggccccgcagatcgacgtcacgcagttcggctacttcaagtgctcggggaaggggggtgctgccgcccnagcccatcgtcgtcaaggccagctcatctcccagggtcgcgagaagagatcaangcgcccgnnggcgccgtcgggctcaccgcctagtttcagtcttatccgcctcttggggtttgagatcatacctggactagcagggctttcctgtcctcactatttggggtaagaaaacgtagtttttaatccatggctccctccttgttgggaagtgctttctatt

SEQ ID NO: 13882 - protein, 160 aa, Zea mays
  misc_feature: Ceres CLONE 1374949-F
  misc_feature (117)..(117): Xaa is any aa, unknown, or other
  misc_feature (135)..(135): Xaa is any aa, unknown, or other
  misc_feature (138)..(138): Xaa is any aa, unknown, or other
MTTRFKKNRKKRGHVSAGHGRIGKHRKHPGGRGNAGGMHHHRILFDKYHPGYFGKVGMRYFHKLRNKFYCPAVNIERLWSMVPAEKAAEAVGDRPRRSTSRSSATSSARGRGVLPPXPIVVKASSSPRVARRDQXARXRRRAHRLVSVLSASWGLRSYLD

SEQ ID NO: 13883 - DNA, 748 bp, Zea mays
  misc_feature: Ceres CLONE 1374951-F
  misc_feature: Translation starting site: 195
  misc_feature (351)..(351): n is a, c, t, g, unknown, or other
  misc_feature (505)..(505): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (628)..(628): n is a, c, t, g, unknown, or other
aagctggagctccccgcggtggcggccgctctagaactagtggatcccccgggctgcaggaattcgcacgagaccattacctagaacatcctaatcgaaaacttttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccnagaagcggttccgcaaggcgcagtgcccgatcgttgagcgccttacaaactccctcatgatgcacgggcgcaacaacggcaagaaggtcatggctgtccgcatcatcaagcataccctgaagatcattcacctgctcaccgatgccaccccatnccagtcgtcgtcgacgcgatcatcaacagtggcccccgtgagatgcaacccgtattggttcccccctggtgtgnnnaaaaaaggcagcccgtgatattcacccccttggaggagggtgaccangccatctacctcctcacactggggggccaggggaagagtgctttcggaacatcaaaccccatggcgaatggcctgggaaaatgagctgatcaacgctgcccaggctcattccacagtacc

SEQ ID NO: 13884 - DNA, 734 bp, Zea mays
  misc_feature: Ceres CLONE 1374954-F
  misc_feature: Translation starting site: 203
  misc_feature: Pfam Name: Ferritin Pfam Description: Ferritin-like domain
  misc_feature: SWISSPROT Homolog: EC 1.16.3.1 Ferroxidase
  misc_feature (367)..(367): n is a, c, t, g, unknown, or other
  misc_feature (560)..(560): n is a, c, t, g, unknown, or other
  misc_feature (641)..(641): n is a, c, t, g, unknown, or other
tggagctccccgcggtggcggccgctctagaactagtggatcccccgggctgcaggaattcgcacgagaccattacctagaacatcctaatcgaaaagcacaatccatccatccatctattctccagtccacccattccattccactacccacgcccagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggcgtcccctcgccggccgctggcgccgcgtgcagggccgcgggcaaggggaaggaggtgctcagncgggtcgtgttccagcccttcgaggagatcaggggggagctcgccctcgtgccccagtcccccgacagtcgctcgcgcgccacaaagtcgtcgatgactgcgaggccgcccctcacgagcagatcaacgtggagtacaacgcctcgtatgcataccactcccctctcgcctatttcgaccgcgacaacgtggnctctcaaggatttgccaagttctttcaggaatccagcgacgaggagagggagcacgctgaaaagctcatggagtaccaaancaaacgtggaagggagggtgaggctcccatcgattgggacgcctttaccggagtttgaccaccctgaaaaaggagatgctcttgacgctatgg

SEQ ID NO: 13885 - DNA, 735 bp, Zea mays
  misc_feature: Ceres CLONE 1374957-F
  misc_feature: Encodes the peptide sequence at SEQ ID NO. 13886
  misc_feature (651)..(651): n is a, c, t, g, unknown, or other
  misc_feature (653)..(653): n is a, c, t, g, unknown, or other
  misc_feature (701)..(701): n is a, c, t, g, unknown, or other
  misc_feature (702)..(702): n is a, c, t, g, unknown, or other
  misc_feature (704)..(704): n is a, c, t, g, unknown, or other
aagctggagctccccgcggtggcggccgctctagaactagtggatcccccgggctgcaggaattcgcacgagaccatacctaaaacatcctaatcgaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctcctgagcgaggatgtcgagctcgtcgccgtcaacgaccccttcatcaccacggactacatgacctacatgttcaagtacgacaccgtccacggccactggaagcacagcgacatcacactcaaggactccgagacccttctcttcggagacaagccggtcaccgtctttggcatcaggaaccctgaggaaatcccgtggagtgaggctggcgctgagtatgtcctgcagtccaccggcgtcttcactgacaaggacaaggctgctgcacatctcatggatgatgacccagaaggttgttatctctggccccagcaaagatgcaccccatggtttggttgttggttgtcaatgatgacagcacccccctcggatggtaacaatgggttgcaatggctagctgcacancnaaactggcttggctcccctttgctaaaggtcattcatgacactttcgnnanttttgtgggtggagggttttggatggacaac

SEQ ID NO: 13886 - protein, 186 aa, Zea mays
  misc_feature: Ceres CLONE 1374957-F
  misc_feature (4)..(122): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (158)..(158): Xaa is any aa, unknown, or other
  misc_feature (159)..(159): Xaa is any aa, unknown, or other
  misc_feature (175)..(175): Xaa is any aa, unknown, or other
  misc_feature (176)..(176): Xaa is any aa, unknown, or other
MGKIKIGINGFGRIGRLVARVALLSEDVELVAVNDPFITTDYMTYMFKYDTVHGHWKHSDITLKDSETLLFGDKPVTVFGIRNPEEIPWSEAGAEYVLQSTGVFTDKDKAAAHLMDDDPEGCYLWPQQRCTPWFGCWLSMMTAPPSDGNNGLQWLAAXXNWLGSPLLKVIHDTFXXFVGGGFWMDN

SEQ ID NO: 13887 - DNA, 742 bp, Zea mays
  misc_feature: Ceres CLONE 1374980-F
  misc_feature: Encodes the peptide sequence at SEQ ID NO. 13888
  misc_feature (604)..(604): n is a, c, t, g, unknown, or other
aaagctggagctccccgcggtggcggccgctctagaactagtggatcccccgggctgcaggaattcgcacgagaccattacctagaacatcctaatcgaaaaaacgaacaatcgaatgcccagtcctgaatcacgacttcaccgcgtgctcgagcggtgtgtgcattccttccgcctccacgctccccacgggcaccgtgcacagataccacacagtctgctccccatggtcgtcttcattggagcttgccgctgctacgacaaaataagaaaaactccgcctgctgggcctggacgaccaggagaaccacagcggcggcggtttctgggaatacctctgcctcgaaccgccgagctccgagcccgccgccccgatcacgagctccgcgctcgctctcgccctcatacaacaacggctccgcgagctccggtcttggctcagaacagtggacgctctacgaggacgtgggcacatcggccatggattgccaacgtctctatggggaacaggactgtattggagtccgttcagaacaacttcctgtcagcacacgaatagcccgactacaatctcatctggatgaagcatcagaagaatggtgtngaagatgaaagagcctacgcgctagtcctggaatacaatccatttgaccagattgtacacaagaggaaaattgctatgccaggagcacaaggcggtatgtcgatagtgattgattatcacaataactatctggaattg

SEQ ID NO: 13888 - protein, 54 aa, Zea mays
  misc_feature: Ceres CLONE 1374980-F
MKHQKNGVEDERAYALVLEYNPFDQIVHKRKIAMPGAQGGMSIVIDYHNNYLEL

SEQ ID NO: 13889 - DNA, 691 bp, Zea mays
  misc_feature: Ceres CLONE 1374982-F
  misc_feature: Encodes the peptide sequence at SEQ ID NO. 13890
  misc_feature (527)..(527): n is a, c, t, g, unknown, or other
  misc_feature (528)..(528): n is a, c, t, g, unknown, or other
  misc_feature (625)..(625): n is a, c, t, g, unknown, or other
cgctctagaactagtggatcccccgggctgcaggaattcgcacgagaccattacctagaacatcctaatcgaaaaaggacctgcttgtttgattgtttcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactacccccggcgtggccgcaaacgggcgcgacgtctacctttcctggtgtcccatccgggcccccccnngggggggggggccgcgccctccaaaccttgggcgggggtggccccacgtggcgcgcctgggcgccacgacagcctggccaccaaaacggccgcgtcngtccgctcatcgcctggggccatcacgagcgctcggccttcgggctggcccctggcaaggagatcc

SEQ ID NO: 13890 - protein, 117 aa, Zea mays
  misc_feature: Ceres CLONE 1374982-F
  misc_feature (63)..(63): Xaa is any aa, unknown, or other
MAGIGRNMVAPLLVLNLIMYIIVIGFASWNLNHFINGQTNYPRRGRKRARRLPFLVSHPGPPXGGGAAPSKPWAGVAPRGAPGRHDSLATKTAASVRSSPGAITSARPSGWPLARRS

SEQ ID NO: 13891 - DNA, 653 bp, Zea mays
  misc_feature: Ceres CLONE 1374985-F
  misc_feature: Encodes the peptide sequence at SEQ ID NO. 13892
  misc_feature (478)..(478): n is a, c, t, g, unknown, or other
  misc_feature (498)..(498): n is a, c, t, g, unknown, or other
  misc_feature (504)..(504): n is a, c, t, g, unknown, or other
  misc_feature (515)..(515): n is a, c, t, g, unknown, or other
  misc_feature (561)..(561): n is a, c, t, g, unknown, or other
tccccgcggtggcggccgctctagaactagtggatcccccgggctgcaggaattcgcacgagaccattacctagaacatcctaatcgaaaaattcgcggtttgcctctctgcctgcctccctcagatcctccctaagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagtttctcaacctgatggcacgcaagatgaaggacacagactctgaggaggagctcaaggaggccttccgcgtgttcgacaaggaccagaacggcttcatctctgctgctgaacttcgacatgtcatgaccancctaggtgagaaactgacgnacgagnaggtggatganatgatccgtgaagccgacggggacggtgatggccagatcacctacnaggagttcgtgaaggggatgatggccaagtgaaatgatggggctgttttgaagctagtccctcccctgaaggaaaacctagcccaggggggg

SEQ ID NO: 13892 - protein, 149 aa, Zea mays
  misc_feature: Ceres CLONE 1374985-F
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature (121)..(149): Pfam Name: efhand Pfam Description: EF hand
  misc_feature: SWISSPROT Homolog: EC 2.7.11.1 Non-specific serine/threonine protein kinase
  misc_feature (112)..(112): Xaa is any aa, unknown, or other
  misc_feature (119)..(119): Xaa is any aa, unknown, or other
  misc_feature (121)..(121): Xaa is any aa, unknown, or other
  misc_feature (124)..(124): Xaa is any aa, unknown, or other
  misc_feature (140)..(140): Xaa is any aa, unknown, or other
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTXLGEKLTXEXVDXMIREADGDGDGQITYXEFVKGMMAK

SEQ ID NO: 13893 - DNA, 682 bp, Zea mays
  misc_feature: Ceres CLONE 1374997-F
  misc_feature (295)..(295): n is a, c, t, g, unknown, or other
  misc_feature (316)..(316): n is a, c, t, g, unknown, or other
  misc_feature (335)..(335): n is a, c, t, g, unknown, or other
  misc_feature (336)..(336): n is a, c, t, g, unknown, or other
  misc_feature (398)..(398): n is a, c, t, g, unknown, or other
  misc_feature (592)..(592): n is a, c, t, g, unknown, or other
  misc_feature (615)..(615): n is a, c, t, g, unknown, or other
  misc_feature (674)..(674): n is a, c, t, g, unknown, or other
  misc_feature (675)..(675): n is a, c, t, g, unknown, or other
tggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggggtgtgtggtgtccaagctacacacnggatgctactaactagctgcnagcaagggcgaagaatggnncagcctttcatgttgctcgggcgggacgtggttggccgttccgggggctcttgcccgccagnttgttgctgtgcgcccacttgctgcttccctatcggggggttcccgtcccggaacgaaaaggggcaagtggttttgccttgccgccaaatttccccccgtttggccagggggtaaggaatttcctttgcccaggccccgggccggtgccattcctaagtttggggggcctcccccagaaggcgggaaagggggntttttttaatttgcacgggcggnaaaaccccttgggggggccgggggttttaaaaagggggccccccttaaacccccgccgnncccgcgc

SEQ ID NO: 13894 - DNA, 646 bp, Zea mays
  misc_feature: Ceres CLONE 1375000-F
  misc_feature: Encodes the peptide sequence at SEQ ID NO. 13895
  misc_feature (384)..(384): n is a, c, t, g, unknown, or other
tggagctccccgcggtggcggccgctctagaactagtggatcccccgggctgcaggaattcgcacgagaccattacctagaacatcctaatcgaaaaatcaaccatattattgagaccaacaagcaacatagaaagtggaatacagtagcaacaatagagcaacaatggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacagggctcaacaagcaatcgcaacaagcaacttacctttatcacccctgttnctttcacaatcgccagccctatctttggtgcagtcattggtacaaacatcagggcacacagctgcagcaactcgggctaacagtgatcagcccagagctctgggaaacttttttcctaatcttagaacaaaaatttcttcattcacccattgctaacctgaaccgggtggttattgggggaaaaaaaataataactttcggccgttgggtttggccaacttcagaaaaaaaattctttcatttaaccaattcccccagggaa

SEQ ID NO: 13895 - protein, 124 aa, Zea mays
  misc_feature: Ceres CLONE 1375000-F
  misc_feature (73)..(73): Xaa is any aa, unknown, or other
MAAKIFSILMLLALSACVANATIFPQYSQAPIAALLPPYLPSMTASVCENPALQPYRAQQAIATSNLPLSPLXLSQSPALSLVQSLVQTSGHTAAATRANSDQPRALGNFFPNLRTKISSFTHC

SEQ ID NO: 13896 - DNA, 712 bp, Zea mays
  misc_feature: Ceres CLONE 1375003-F
  misc_feature: Encodes the peptide sequence at SEQ ID NO. 13897
tggagctccccgcggtggcggccgctctagaactagtggatcccccgggctgcaggaattcgcacgagaccattacctagaacatcctaatcgaaaaagccgtggatcgagtgcggagggggagaagcgtctatcccatgtcccgcgacggcggggaatagggcgacagctgcggtggggatcggctgcggcggctcgacgaggcggcggcggcggcgcgggtgggcggcggcaccatgtctgcggtagtctgtggcaagaggtcctcctccatcttcaccgacgagctcctcccgccatcccctacctcccctcactcctcccaccagacggcgcccaagaggtcccgccggtccccctcgcaccgcggcagctccgacggacaccgacgggaggcgctcgtccaccatctgcttttactcttccccgacatggatccacagttgcttgaaaaagctctggaagcatctggagatgacttggattctgcaataaagagtttgaatttgctacgcttagagtcagcagaggctatcttgacatctactggtttcaaacctgaatatgctcagcatactgcaattcagcctcctgttgaaggaattcctaatggtggtgtggatacgactactgaacatcatcctactggagatgattaccagacgagctaaaatgcctctgaatgggttgagctatttgtcagggagatgac

SEQ ID NO: 13897 - protein, 144 aa, Zea mays
  misc_feature: Ceres CLONE 1375003-F
MSAVVCGKRSSSIFTDELLPPSPTSPHSSHQTAPKRSRRSPSHRGSSDGHRREALVHHLLLLFPDMDPQLLEKALEASGDDLDSAIKSLNLLRLESAEAILTSTGFKPEYAQHTAIQPPVEGIPNGGVDTTTEHHPTGDDYQTS

SEQ ID NO: 13898 - DNA, 582 bp, Zea mays
  misc_feature: Ceres CLONE 1375009-F
  misc_feature: Encodes the peptide sequence at SEQ ID NO. 13899
  misc_feature (413)..(413): n is a, c, t, g, unknown, or other
  misc_feature (415)..(415): n is a, c, t, g, unknown, or other
  misc_feature (416)..(416): n is a, c, t, g, unknown, or other
  misc_feature (425)..(425): n is a, c, t, g, unknown, or other
  misc_feature (426)..(426): n is a, c, t, g, unknown, or other
gctctagaactagtggatcccccgggctgcaggaattcgcacgagaccattacctagaacatcctaatcgaaaaaaaccctagaagcctccaccctccagcgcctccaccttcctcgccgcctcactccctctgaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaaggtcgagtcctactggccggcgctcttcgctaagctcctggagaagcgcagcgttgaggatctaatcctctccgtgggatctgggtggtggcgctgctccagttgctggcttccgccccagctggggngnngggttgaannttggtggttgcccctggttggaaaagggaaaaaaaaggaaagccccccccggggggggttttttgggagaaccaaggggggtttttcccccgggggggtgggggggaaaggccccccccccccccccccccccccaaaaaaaaaaatttttttttg

SEQ ID NO: 13899 - protein, 135 aa, Zea mays
  misc_feature: Ceres CLONE 1375009-F
  misc_feature (80)..(80): Xaa is any aa, unknown, or other
  misc_feature (81)..(81): Xaa is any aa, unknown, or other
  misc_feature (84)..(84): Xaa is any aa, unknown, or other
MASGELACTYAALILSDDGIAITAEKIATIVKAANIKVESYWPALFAKLLEKRSVEDLILSVGSGWWRCSSCWLPPQLGXXVEXWWLPLVGKGKKKESPPRGGFFGRTKGGFSPGGVGGKGPPPPPPPPKKKIFF

SEQ ID NO: 13900 - DNA, 799 bp, Zea mays
  misc_feature: Ceres CLONE 1375014-F
  misc_feature: Encodes the peptide sequence at SEQ ID NO. 13901
  misc_feature (710)..(710): n is a, c, t, g, unknown, or other
ggggggggggggcgggggcgggcccgggggaggaaattggcggtgggggggaataaaagtggagctccaccgcggtggcggccgctctagaactagtggatcccccgggctgcaggaattcgcacgagaccattacctagaacatcctaatcgaaaaagcaagcaattgtcaaccgactctatcttagctctctttgcaagccagtaggtcaccactcaaaagcttgtgaagcaggtgagatgggcaaggaggtggatgtgtccactctagaggccggcggcgtccgtgaccgtgactacgcggaccctccgccggcaccgctgatcgacatcgacgagctcggcaagtggtccctgtaccgcgccgtgatcgccgagttcgtggccacgctgctgttcctgtacatcacggttgccacggtgatcgggtacaagcaccagacggacgcgtcggtgtctgggcccgacgcggcgtgcagcggcgtgggcatcctgggcatcggcgtggggcgttcggcgagcatgatcttcatcctcggctactggaccgccgaggatctcggggtggggacctccggaccggggccgacgggggaccgcccctcgttcgtgggacgcgcacgcgccacccaggggggggcggctgaaggaatgaaaaagggcccgcagctcccaacacttggccacagcgcgccccgggccgccgcccncgaactaacttcgcctcttcgtatcacccgatacatgcgagacggctccgcccacccccgcctgtgcttcgcccgccccccccccgccc

SEQ ID NO: 13901 - protein, 186 aa, Zea mays
  misc_feature: Ceres CLONE 1375014-F
  misc_feature (157)..(157): Xaa is any aa, unknown, or other
MGKEVDVSTLEAGGVRDRDYADPPPAPLIDIDELGKWSLYRAVIAEFVATLLFLYITVATVIGYKHQTDASVSGPDAACSGVGILGIGVGRSASMIFILGYWTAEDLGVGTSGPGPTGDRPSFVGRARATQGGAAEGMKKGPQLPTLGHSAPRAAAXELTSPLRITRYMRDGSAHPRLCFARPPPA

SEQ ID NO: 13902 - DNA, 635 bp, Zea mays
  misc_feature: Ceres CLONE 1375016-F
  misc_feature: Encodes the peptide sequence at SEQ ID NO. 13903
  misc_feature (520)..(520): n is a, c, t, g, unknown, or other
  misc_feature (592)..(592): n is a, c, t, g, unknown, or other
cgcggtggcggccgctctagaactagtggatcccccgggctgcaggaattcgcacgagaccattacctagaacatcctaatcgaaaaaaaaatcgaacccaagtcgaaaccctaacctcggccttctcgatgtcggccgccacaaccgccccaacccctgcggtggccaccccgatggcgccgcctccgtcgtacccggcctcctccacgatctccgcctccgtggccgcgtcggtcgaggaagaggacgacctctatggccgcctcaagtcgctccagcgccacatggagttcgtcgagatccaggaggagtacgttaaagacgaacagaagaacctcaagcgcgaactcctccgtgcgcaggaggaggtcaagcggatccagtccgtaccgctcgtcatcggccagtttatggagatggtcgacggcaacaacggcatcgtgggttctactacgggcagcaactactaatgtgcggatcctcagcaccatcaaccgcgagctgctcaagccgtcagcnatctgtcgcgttgcatcgtcactccaacgctttttagtcgacgtgctgccgccccgagggcgactccacatnctcctttgggtggggatcggccggagaagcccaacgtcaccta

SEQ ID NO: 13903 - protein, 113 aa, Zea mays
  misc_feature: Ceres CLONE 1375016-F
MSAATTAPTPAVATPMAPPPSYPASSTISASVAASVEEEDDLYGRLKSLQRHMEFVEIQEEYVKDEQKNLKRELLRAQEEVKRIQSVPLVIGQFMEMVDGNNGIVGSTTGSNY

SEQ ID NO: 13904 - DNA, 670 bp, Zea mays
  misc_feature: Ceres CLONE 1375019-F
  misc_feature: Encodes the peptide sequence at SEQ ID NO. 13905
  misc_feature (540)..(540): n is a, c, t, g, unknown, or other
  misc_feature (600)..(600): n is a, c, t, g, unknown, or other
  misc_feature (623)..(623): n is a, c, t, g, unknown, or other
  misc_feature (624)..(624): n is a, c, t, g, unknown, or other
tccccgcggtggcggccgctctagaactagtggatcccccgggctgcaggaattcgcacgagaccattacctagaacatcctaatcgaaaaattcctcggagaggagaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctcgctcgcaagtacaaccaggacaagatgatctgccgcaaatgctatgcacggctgcaccctagggctgtcaactgccgcaagaagaagtgtggtcacagcaaccagctgagggccaagaagaaatnagaaaactgaggtgtgcctgctagtcagttctgggacatgtgtgtttttggtggtgaaanccccggttggtacacatggattnntttttttttgggggggggaaaccaacccgggtgttgttacccgaaa

SEQ ID NO: 13905 - protein, 129 aa, Zea mays
  misc_feature: Ceres CLONE 1375019-F
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature: SWISSPROT Homolog: EC 3.1.2.15 Ubiquitin thiolesterase
  misc_feature (127)..(127): Xaa is any aa, unknown, or other
MQIFVKTLTGKTITLEVESSDTIDNVKAKIQDKEGIPPDQQRLIFAGKQLEDGRTLADYNIQKESTLHLVLRLRGGIIEPSLQALARKYNQDKMICRKCYARLHPRAVNCRKKKCGHSNQLRAKKKXEN

SEQ ID NO: 13906 - DNA, 597 bp, Zea mays
  misc_feature: Ceres CLONE 1375022-F
  misc_feature: Encodes the peptide sequence at SEQ ID NO. 13907
acccgcggtggcggccgctctagaactagtggatcccccgggctgcaggaattcgcacgagaccattacctagaacatcctaatcgaaaaatcaaccatattattgagaccaacaagcaacatagaaagtgaaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcaggatgtgaaaacccagctcttcaaccctataggctccaacaagcaatcgcagcaagcaacatacctttatcagccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttctatcattcaaccaactgtctacattgaaccgtgctgcttatttgcagcaacatctattaccattcaggcagctagctactg

SEQ ID NO: 13907 - protein, 146 aa, Zea mays
  misc_feature: Ceres CLONE 1375022-F
MATKIFSLLMLLALSACVANATIFPQCSQAPIASLLPPYLPSMIASGCENPALQPYRLQQAIAASNIPLSALFQQSPALSLVQSLVQTIRAQQLQQLVLPVINQVALANLSPYSQQQQFLSFNQLSTLNRAAYLQQHLLPFRQLAT

SEQ ID NO: 13908 - DNA, 740 bp, Zea mays
  misc_feature: Ceres CLONE 1375023-F
ctagaactagtggatcccccgggctgcaggaattcgcacgagaccattacctagaacatcctaatcgaaaaacaaatatcattgacaccacctagcaatccagaacgaacaatagcgtaccaacaatgctagcccccaaaatctgcttccttatgctcctcggcatatctgcaaaggctgctaccgcaagcacaatcccacgatgggcagaagatcatataccttcttttcttcctccatacctctcaccagcagaggcttcattatctccaacaccaattgttcctccccacaggatccaacaggatatcgcattagggatcttataattatgactcctgctcctccgccaaccgtcagcactatgacagccacctacctgcccagcttcggctgctcccaaagaaaaagggtcgagaactacaacaacccccctgccaggaaacctttgtgcctactgctcacgacaagaacgcgtcttcccgtctatccaaccggcgtgcaatggagcccgcgtcccaaattgcttgcaagaactacgcacccatcacacctacgtggttgcctacccaccagaagacaacctaaatgccaaacaaccggcccaaaattcaaacccgagctgggtaatgtcatccacagacggcatacaaaccgatgcatcgcgaatacaatgaggcgcgccccgcggtttactacgctaacacaccaaatcgctgttgtccccgcgcggaaccccc

SEQ ID NO: 13909 - DNA, 650 bp, Zea mays
  misc_feature: Ceres CLONE 1375027-F
  misc_feature: Encodes the peptide sequence at SEQ ID NO. 13910
tccccgcggtggcggccgctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggaaaaacaggtgaaggaaattgtgttgaaggctatgggacaggctataagcaaggcagtggctattgctgagatcataaagaagaggattcctggtttgcatcaagatacaataatcagttctgtcagtattactgatgtatgggagcccattgaggaaggacttgtaccattggagatgactcgtcatgtttcaatgatatcgatttccttgtcacctaaggagcataacaagaatt

SEQ ID NO: 13910 - protein, 121 aa, Zea mays
  misc_feature: Ceres CLONE 1375027-F
  misc_feature (18)..(88): Pfam Name: Alba Pfam Description: Alba
  misc_feature: SWISSPROT Homolog: EC 3.1.26.5 Ribonuclease P
MDRYQRVEKPPPEAAAIGENEIRITTQGLVRNYVTYATSLVQEKQVKEIVLKAMGQAISKAVAIAEIIKKRIPGLHQDTIISSVSITDVWEPIEEGLVPLEMTRHVSMISISLSPKEHNKN

SEQ ID NO: 13911 - DNA, 727 bp, Zea mays
  misc_feature: Ceres CLONE 1375028-F
  misc_feature: Encodes the peptide sequence at SEQ ID NO. 13912
  misc_feature (541)..(541): n is a, c, t, g, unknown, or other
  misc_feature (562)..(562): n is a, c, t, g, unknown, or other
  misc_feature (567)..(567): n is a, c, t, g, unknown, or other
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaaacgcagcagcgacgcgacgcccccgccccgcgtcttctactcttcttcatcttcactgctcaccaacccatccatcccccagtcctcctcactgctcacccgtctcccatccccacaccaccaccaccaccatcttccggtcttcccctccccacacccggcgggatccccaccatccccgccccccgatggagctgttcgcgcgcgccaaggtggtgcggctcaagagccaccacgacaagttcctgtacgcggacgaggacgaggcgcacgtgacgcaggagcgggacgggtcgtcggcgaacgcgcggtgggccgtggagccggcgccgcacaacccgggcgccatccgcctgcggagccggtacggccactacctcaccgcctccggggagccgttcctgctggggatgacgggccggaaggtgacgcagacggngcccgccgcgccccgccccgncaacngcgtcgtggactgggagcccgtgcgggaacgcttcccagcgcgcctccgcaccggggggggccacttccctcgcgncaacggggggctccccgccctggaggaaactcgtcacccacgaagtgccccacccgcacgccacgaaggactgggtggtctggg

SEQ ID NO: 13912 - protein, 145 aa, Zea mays
  misc_feature: Ceres CLONE 1375028-F
  misc_feature (1)..(134): Pfam Name: DUF569 Pfam Description: Protein of unknown function (DUF569)
  misc_feature (84)..(84): Xaa is any aa, unknown, or other
  misc_feature (91)..(91): Xaa is any aa, unknown, or other
  misc_feature (93)..(93): Xaa is any aa, unknown, or other
  misc_feature (118)..(118): Xaa is any aa, unknown, or other
MELFARAKVVRLKSHHDKFLYADEDEAHVTQERDGSSANARWAVEPAPHNPGAIRLRSRYGHYLTASGEPFLLGMTGRKVTQTXPAAPRPXNXVVDWEPVRERFPARLRTGGGHFPRXNGGLPALEETRHPRSAPPARHEGLGGL

SEQ ID NO: 13913 - DNA, 729 bp, Zea mays
  misc_feature: Ceres CLONE 1375031-F
  misc_feature: Encodes the peptide sequence at SEQ ID NO. 13914
aaagctggagctccccgcggtggcggccgctctagaactagtggatcccccgggctgcaggaattcgcacgagaccattacctagaacatcctaatcgaaaaagtctgcacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaacttctaggaagatgatccgatctacggaaggctgtgcaaagagcattactttggagaggaacaacaaatcagacgatgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtgccaccatgttccaacccggaaataggagcatcaaacatacaaggaccaactttgccatgagagtcaacagtttcttgcgtcagctacgcactcatcctactcttaataagtttgttattaagttcgggctgcgcaggaagcacactcgccatgtcaacagatggattcgcttctgctccgtgtcgcgagcaagacacatcactattaatttcactcctg

SEQ ID NO: 13914 - protein, 158 aa, Zea mays
  misc_feature: Ceres CLONE 1375031-F
  misc_feature (38)..(85): Pfam Name: F-box Pfam Description: F-box domain
MAKQKEGVDKRTSRKMIRSTEGCAKSITLERNNKSDDVQLHDLPNDILGSILSRLTFRESSQMGLVSHTWRRLWRSCCRKLVFTSATMFQPGNRSIKHTRTNFAMRVNSFLRQLRTHPTLNKFVIKFGLRRKHTRHVNRWIRFCSVSRARHITINFTP

SEQ ID NO: 13915 - DNA, 673 bp, Zea mays
  misc_feature: Ceres CLONE 1375032-F
  misc_feature: Encodes the peptide sequence at SEQ ID NO. 13916
  misc_feature (522)..(522): n is a, c, t, g, unknown, or other
  misc_feature (604)..(604): n is a, c, t, g, unknown, or other
  misc_feature (646)..(646): n is a, c, t, g, unknown, or other
  misc_feature (658)..(658): n is a, c, t, g, unknown, or other
ggagctcaccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctactttcctggtgttcccatcctggccccccntggttggggccgcggcgtccaactttttggcgggcgtgcacccacgtgcgcgcctggcgccacgacagcctggccacaaaangcccgcgtcgtggcttcatcgcctgggccatcacgggctcgncctttcggctgncccttttgaaggaaa

SEQ ID NO: 13916 - protein, 109 aa, Zea mays
  misc_feature: Ceres CLONE 1375032-F
  misc_feature (14)..(100): Pfam Name: AWPM-19 Pfam Description: AWPM-19-like family
  misc_feature (62)..(62): Xaa is any aa, unknown, or other
  misc_feature (89)..(89): Xaa is any aa, unknown, or other
  misc_feature (107)..(107): Xaa is any aa, unknown, or other
MAGIGRNMVAPLLVLNLIMYIIVIGFASWNLNHFINGQTNYPGVAGNGATFYFPGVPILAPXGWGRGVQLFGGRAPTCAPGATTAWPQXARVVASSPGPSRARPFGXPF

SEQ ID NO: 13917 - DNA, 656 bp, Zea mays
  misc_feature: Ceres CLONE 1375039-F
  misc_feature: Encodes the peptide sequence at SEQ ID NO. 13918
  misc_feature (243)..(243): n is a, c, t, g, unknown, or other
gctctagaactagtggatcccccgggctgcaggaattcgcacgagaccattacctagaacatcctaatcgaaaaaacgagagcacccggaccagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggncctcctcccaaactaccaccggttcaacatcaagggccgcatttacccggcgatcctgcccgttgagagcaagagagttgctgggaggggtatcatgggtggtactgatgaagagctccagctttctgacgcgtttgaagacgtggagtacacgaggaccagagctgagatatcattgggtggatcttcccagacaatgctggctggaacttacgggggggagggatggagagggttcccatcttttttggggaaggggatttttgggggggattgcttgttttcctgccaccccggggggggtaagggtattgggatatacggggcaggggggctctatccaagggggggaacttatagggtttggggggcgccctgggaaataaaaattttgggggcgcccccccactagg

SEQ ID NO: 13918 - protein, 180 aa, Zea mays
  misc_feature: Ceres CLONE 1375039-F
  misc_feature (19)..(116): Pfam Name: AIG2 Pfam Description: AIG2-like family
  misc_feature (44)..(44): Xaa is any aa, unknown, or other
MAMKPAAAAPPTPAAAHSVFVYGSLMADEVVRTILKRVPPAAPXLLPNYHRFNIKGRIYPAILPVESKRVAGRGIMGGTDEELQLSDAFEDVEYTRTRAEISLGGSSQTMLAGTYGGEGWRGFPSFLGKGIFGGDCLFSCHPGGGKGIGIYGAGGLYPRGGTYRVWGAPWEIKILGAPPH

SEQ ID NO: 13919 - DNA, 691 bp, Zea mays
  misc_feature: Ceres CLONE 1375040-F
  misc_feature: Pfam Name: DUF159 Pfam Description: Uncharacterised ACR, COG2135
  misc_feature (393)..(393): n is a, c, t, g, unknown, or other
  misc_feature (416)..(416): n is a, c, t, g, unknown, or other
  misc_feature (436)..(436): n is a, c, t, g, unknown, or other
  misc_feature (437)..(437): n is a, c, t, g, unknown, or other
  misc_feature (575)..(575): n is a, c, t, g, unknown, or other
  misc_feature (576)..(576): n is a, c, t, g, unknown, or other
  misc_feature (599)..(599): n is a, c, t, g, unknown, or other
  misc_feature (682)..(682): n is a, c, t, g, unknown, or other
ggagctccccgcggtggcggccgctctagaactagtggatcccccgggcttgcaggaattcgcacgagaccatttacctaaaacatcctaatcgaaaaagcaccctcagcccaggtccccgtcgcctccgctcaacttgccgccgcagggcccgcttgcaggctttccatgtgtggtagggcccggtgtacccttcagcccggccgaggttgccagggccttcggcttccccacccacctccgccaacgcgggcggcggtggagacggcctcgctgtgccgacgcttccattctttaaccggttccggccgtcgtacaatgtgttgcctggggcgtaccttgcctgtgggcgccattgcgggcacttaccaggttcgcccacggaggagaagntttcggaatggggagggggccgntgatccgtgcatgaagttgnngggctggtgcccagcttcaccggcaaggccgagaaacccgactattttcaggatgttcaatgcccagatcagagtccgtaaaaagaaaaagttttcatttccgtcgactaattcaaaaaaataggtgccttgtgccannaaaaaagggttttttatgagtgnaaaaaaagaatggattcaaaaaaacagccatactacatacattttccaagatcataggccctcttgtctttgcaggcccttgnaatgatgca

SEQ ID NO: 13920 - DNA, 732 bp, Zea mays
  misc_feature: Ceres CLONE 1375042-F
  misc_feature: Encodes the peptide sequence at SEQ ID NO. 13921
  misc_feature (653)..(653): n is a, c, t, g, unknown, or other
  misc_feature (656)..(656): n is a, c, t, g, unknown, or other
  misc_feature (732)..(732): n is a, c, t, g, unknown, or other
aaagctggagctccccgcggtggcggccgctctagaactagtggatcccccgggctgcaggaattcgcacgagaccattacctagaacatcctaatcgaaaaaagcaaaaatgaaaccagcaacggtagcaaagtggcaatggtttcacttccagtccaatcaattccttcgtttgacgttctatccctgactcaggtagtcaggtgtagtgctgctgcggccacagtgctcggcgctcgctcgtgctgcctgctggtgctctgtgctcgagtgctcgacggccgctgcccgctgcgctgggagcttgcgacgagccaacgggtcaccggtcgacggccacccgcgcgccaccgcgccagactgggcgcgccctcctcgccgtgggtcctccactccgggatccggcggcggcggcggcctccctgcggccctgcctgcgccgtgcagtgccgcccctcgccggcggtcggctcaactccctgtccaccacagtgccgagccggcatccacctcctgcttccaccgccagtttgccacagtgccgcgccggcctcccgtccctggtcgaaggccgccaccgccacctactgaattgtgataatgaacgtgacggcggcgaggcagcggaggctgcccccgctcgggccacggnggncactcccgccgccgcgcctcctcgccgctgtcatcgccttcgccttcgcgctcctcttcctgctcctcgtgcttcn

SEQ ID NO: 13921 - protein, 43 aa, Zea mays
  misc_feature: Ceres CLONE 1375042-F
  misc_feature (18)..(18): Xaa is any aa, unknown, or other
  misc_feature (19)..(19): Xaa is any aa, unknown, or other
MNVTAARQRRLPPLGPRXXLPPPRLLAAVIAFAFALLFLLLVL

SEQ ID NO: 13922 - DNA, 671 bp, Zea mays
  misc_feature: Ceres CLONE 1375051-F
  misc_feature: Translation starting site: 144
  misc_feature (247)..(247): n is a, c, t, g, unknown, or other
  misc_feature (304)..(304): n is a, c, t, g, unknown, or other
  misc_feature (364)..(364): n is a, c, t, g, unknown, or other
  misc_feature (366)..(366): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (383)..(383): n is a, c, t, g, unknown, or other
  misc_feature (391)..(391): n is a, c, t, g, unknown, or other
  misc_feature (397)..(397): n is a, c, t, g, unknown, or other
  misc_feature (418)..(418): n is a, c, t, g, unknown, or other
  misc_feature (419)..(419): n is a, c, t, g, unknown, or other
  misc_feature (453)..(453): n is a, c, t, g, unknown, or other
cgctctagaactagtggatcccccgggctgcaggaattcgcacgagaccattacctagaacatcctaatccaaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccnttcttcccccataccttccatcaattatagcttcaatatgtgaaaacccagctcttncaccatataggctttcacaagcaatcgcagcaagcaacatacctttatcgcccgtgttgntncannncatcgcagcccntatcttgntgcagncattggtacaaaccatcaggnncacacagctgcaggcactcgtgctacctctgatncacaaagtagctctggaaaacctttctccctactctcaggaacaacaatttctccattcaaccaattgtcaacctggaaccctggtgctttatttggcgcaaacactaataaccatttaacccggtaggttcgggctaatttcagaaaaaaaaactttttccctttatacaattgggccgaaggggacccccctgtttatttgggggaaaaaaaaata

SEQ ID NO: 13923 - DNA, 693 bp, Zea mays
  misc_feature: Ceres CLONE 1375058-F
  misc_feature: Encodes the peptide sequence at SEQ ID NO. 13924
  misc_feature (387)..(387): n is a, c, t, g, unknown, or other
  misc_feature (445)..(445): n is a, c, t, g, unknown, or other
  misc_feature (526)..(526): n is a, c, t, g, unknown, or other
  misc_feature (552)..(552): n is a, c, t, g, unknown, or other
  misc_feature (556)..(556): n is a, c, t, g, unknown, or other
  misc_feature (612)..(612): n is a, c, t, g, unknown, or other
  misc_feature (632)..(632): n is a, c, t, g, unknown, or other
  misc_feature (645)..(645): n is a, c, t, g, unknown, or other
  misc_feature (646)..(646): n is a, c, t, g, unknown, or other
  misc_feature (650)..(650): n is a, c, t, g, unknown, or other
tggagctccccgcggtggcggccgctctagaactagtggatcccccgggctgcaggaattcgcacgagaccattacctagaacatcctaatcgtaaagaggaagcggtaagcgcggagggaggacgggagagagagataggcgtgccttcgtcgtccgtgccggtgcgtggcgtggtggccgtgccgaccgtccgtccaccccctctcctcttcccggcgccggcgacagcgggagggactccctgggaggaatggccgtggtgagggctccgctcggcgcggtggcggtggccgctctcgtcgtcgccatcttcatgccggccgccgccagcggcgcaggcaccggcgcccgcgcccaccagcgacggcacatcaatcgacctggnggatcgcgtacatcctttatgctggtggccctggtgctcacctacctgatccacccgnctggacgcgtcctccccctacaagctcttttaatctctgctccttttcgtttggtcatgcggggttatgggtgctataggnaattttaggtgcgcgagatgtttaangtgngggtttgggaggggtttaaaagggggtgatgattgccatccttttggatcttgggnatgtatccaggctcaaaaancccgcttgggggnntccnatatgtgggttggaaatttggaaccggattccctataattttt

SEQ ID NO: 13924 - protein, 93 aa, Zea mays
  misc_feature: Ceres CLONE 1375058-F
  misc_feature (9)..(63): Pfam Name: DUF1070 Pfam Description: Protein of unknown function (DUF1070)
  misc_feature (65)..(65): Xaa is any aa, unknown, or other
  misc_feature (92)..(92): Xaa is any aa, unknown, or other
MAVVRAPLGAVAVAALVVAIFMPAAASGAGTGARAHQRRHINRPGGSRTSFMLVALVLTYLIHPXGRVLPLQALLISAPFRLVMRGYGCYRXF

SEQ ID NO: 13925 - DNA, 698 bp, Zea mays
  misc_feature: Ceres CLONE 1375059-F
  misc_feature: Encodes the peptide sequence at SEQ ID NO. 13926
  misc_feature (433)..(433): n is a, c, t, g, unknown, or other
  misc_feature (498)..(498): n is a, c, t, g, unknown, or other
  misc_feature (593)..(593): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
tccccgcggtggcggccgctctagaactagtggatcccccgggctgcaggaattcgcacgagaccattacctagaacatcctaatcgaaaaaaaccttgcccctgctcctcacgccgccgccgccgccgccgtcgccgccaccacatccgtagcgcccagccgccggagaagaggagggagccagcaccagccaccatgggtcgcgtccgcaccaagaccgtgaagaagacctccaggcaggtgatcgagaagtactactcccgcatgaccctcgacttccacaccaacaagaaggtgctggaagaggtctcgatcctcccctcgaagcgcctccgcaacaaggttgccggcttcaccacccacctgatgcgccgcatccagcgggggccccgtccgtggcatctcgctcaagctgcaggaaggaggagcggnagcgccgcatggacttcgtccccggagaagcaggcgctcgagggtcgaagagatccgcgtcgacnaggagacccatggagatgctcgcggcacttggcatggccgatcctcccgggcgtaaggcggccaggctgagggtctccagcgtccccgcctaggncgccgnnnnnnnnatggagggtccccgccgtgacccggcgtctaggttcacggccgattggcagtgggtttgggggtcgtggctcgcaccgttaactcaacaggt

SEQ ID NO: 13926 - protein, 123 aa, Zea mays
  misc_feature: Ceres CLONE 1375059-F
  misc_feature (1)..(124): Pfam Name: Ribosomal_S17e Pfam Description: Ribosomal S17
  misc_feature (101)..(101): Xaa is any aa, unknown, or other
MGRVRTKTVKKTSRQVIEKYYSRMTLDFHTNKKVLEEVSILPSKRLRNKVAGFTTHLMRRIQRGPRPWHLAQAAGRRSGSAAWTSSPEKQALEGRRDPRRXGDPWRCSRHLAWPILPGVRRPG

SEQ ID NO: 13927 - DNA, 677 bp, Zea mays
  misc_feature: Ceres CLONE 1375068-F
  misc_feature: Translation starting site: 210
  misc_feature: Pfam Name: NAD_binding_5 Pfam Description: Myo-inositol-1-phosphate synthase
  misc_feature: SWISSPROT Homolog: EC 5.5.1.4 Inositol-3-phosphate synthase
  misc_feature (414)..(414): n is a, c, t, g, unknown, or other
  misc_feature (546)..(546): n is a, c, t, g, unknown, or other
tccccgcggtggcggccgctctagaactagtggatcccccgggctgcaggaattcgcacgagaccattacctagaacatcctaatcgaaaaacacaacccaaagcagccacagcagcctccttcctcctctcactctcgctcgtgctgcgctcgctacctcgcttcgcattccattcgaggagagcggtgagaggggaggaaaggcaagatgttcatcgagagcttccgcgtcgagagcccccacgtgcggtacggcccgacggagatcgagtcggagtaccggtacgacacgacggagctggtacacgagggcaaggacggcgcctcacgctgggtcgtccgccccaagtccgtcaagtacaacttccggaccagaaccgccgtccccaagctcggggtggatgcttgtgggngtggggaggcaacaacgggtccacgctttgacggctggggtcattgcccaacaggggaggggattctcatggggcgaccaaggacaaggtgcagcaagccaactactacggctccctcacccaggcctccanccatcagagtcggagtaccacggggggggaggagatcctatggcgccgttcaagagcctcctttcccatggtgaccagaacaaacatttttgggttttcgggaggcttgggacattagcaacatggaacct

SEQ ID NO: 13928 - DNA, 615 bp, Zea mays
  misc_feature: Ceres CLONE 1375069-F
  misc_feature: Translation starting site: 199
  misc_feature: SWISSPROT Homolog: EC 2.4.1.207 Xyloglucan:xyloglucosyl transferase
  misc_feature (493)..(493): n is a, c, t, g, unknown, or other
  misc_feature (589)..(589): n is a, c, t, g, unknown, or other
  misc_feature (615)..(615): n is a, c, t, g, unknown, or other
gctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcgggcgcgggctggacctgacgctggaccgcacgtccggctccgggttccagtccaagagcgagtacctgttcggcaagatcgacatgcagatcaagctggtgccaggcaactcccgtggcacggtcacccaccttctacctgtcgtcccagggcgacggncacgacgagtccgacttcgagttcctgggcaacgtggagcggggagccctacacgctgcacaccaacgtgttcacgccgcggaagggggcagcggngaagcagcagttcccgccctctggtn

SEQ ID NO: 13929 - DNA, 608 bp, Zea mays
  misc_feature: Ceres CLONE 1375071-F
  misc_feature: Encodes the peptide sequence at SEQ ID NO. 13930
ggcggccgctctagaactagtggatcccccgggctgcaggaattcgcacgagaccattacctagaacatcctaatcgaaaactgccttcctgcctgcttccctccctccgtgagatccccgctcgggttgccatggcggaccagctcaccgacgaacagatcgccgagttcaaggaggccttcagcctcttcgacaaggacggcgacggctgcatcaccaccaaggaacttggcactgtgatgcgctcattggggcagaaccctactgaggctgagcttcaggacatgatcaatgaggttgatgctgatggcaatggaaccatcgactttcctgagtttctcaacctgatggcgcgcaagatgaaggacaccgactccgaggaggagctcaaggaggcgcttccgtgtgttcgacaaggaccagaacggcttcatctccgctgctgagcttcgccatgtcatgaccaacctaggcgagaagctgacggacgaggagggtggacgagatgatccgtgaagccgatgtgggacggtgatggccagacaacctaccgatgagtttcgtgaaaggtgatgatggccaagtgagtaatggcccggcgtttttt

SEQ ID NO: 13930 - protein, 104 aa, Zea mays
  misc_feature: Ceres CLONE 1375071-F
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDEQIAEFKEAFSLFDKDGDGCITTKELGTVMRSLGQNPTEAELQDMINEVDADGNGTIDFPEFLNLMARKMKDTDSEEELKEALPCVRQGPERLHLRC

SEQ ID NO: 13931 - DNA, 667 bp, Zea mays
  misc_feature: Ceres CLONE 1375075-F
  misc_feature: Encodes the peptide sequence at SEQ ID NO. 13932
  misc_feature (451)..(451): n is a, c, t, g, unknown, or other
  misc_feature (452)..(452): n is a, c, t, g, unknown, or other
  misc_feature (487)..(487): n is a, c, t, g, unknown, or other
  misc_feature (605)..(605): n is a, c, t, g, unknown, or other
  misc_feature (631)..(631): n is a, c, t, g, unknown, or other
ccccgcggtgggcggccgctctagaactagtggatcccccgggctgcaggaattcgcacgagaccattacctaaaacatcctaatcgaaaaaaccttgcaggaaaaaaaaagagacgaccccccaaatcggaatccgcacacccatcatccatggccgccgccctgcttccgccgcttgccggcggcgcgcgcgctccttttgccggcactttcgtcccgcctcgtcgcgtccaagccccactcctcgtcccccgcgccgccgccacctgcgaaggccgactccagcacgaagaccttctcgatctaccggtgggacccggactcgccgtcgacgaagccgcacctcaaggactaccaggtggacctgtccgactcgcgggccggatggtgctggacgcgctgctcaagatcaagaacgagcaggacccgtcgctcaccttccgccgcagnntgtgcgggagggcatcttgcgggagctgcgcctgnaacatcgacggcgacaacggcctcgcctgcctcaccaagaatctccggcgcctcctcccgcgtcccacggtctcgcccttccccccaaaatgttcgtcgcagggaacccctttgtggntgggacatggaccaactttctacagnccagtacaaagaaagcgtcgagcccatggcttcaag

SEQ ID NO: 13932 - protein, 94 aa, Zea mays
  misc_feature: Ceres CLONE 1375075-F
  misc_feature: SWISSPROT Homolog: EC 1.3.5.1 Succinate dehydrogenase (ubiquinone)
  misc_feature (22)..(22): Xaa is any aa, unknown, or other
  misc_feature (23)..(23): Xaa is any aa, unknown, or other
  misc_feature (34)..(34): Xaa is any aa, unknown, or other
  misc_feature (74)..(74): Xaa is any aa, unknown, or other
  misc_feature (82)..(82): Xaa is any aa, unknown, or other
MVLDALLKIKNEQDPSLTFRRXXCGRASCGSCAXNIDGDNGLACLTKNLRRLLPRPTVSPFPPKCSSQGTPLWXGHGPTFYXPVQRKRRAHGFK

SEQ ID NO: 13933 - DNA, 677 bp, Zea mays
  misc_feature: Ceres CLONE 1375076-F
  misc_feature: Encodes the peptide sequence at SEQ ID NO. 13934
  misc_feature (427)..(427): n is a, c, t, g, unknown, or other
  misc_feature (482)..(482): n is a, c, t, g, unknown, or other
  misc_feature (611)..(611): n is a, c, t, g, unknown, or other
tccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactaacgccgggtgtgggcagccgagcgccatgttccagccgctccggcaacagtgctgccagcagangatgaggatgatgggacgtgcagtccgtcgcgcagcagctgcagatgatgatgcnagcttgagcgtgccgctgccgccagcagcagcctgtacgagccagctctgatgcagcagcagcagcagctgctggccagcccagggtctcaacccatgggccatgttggatggcgcagaacatgcgggnccatgggtggactctaccagtaccagctgcccagctaccgcacccaccccctgtggcgtctccgct

SEQ ID NO: 13934 - protein, 69 aa, Zea mays
  misc_feature: Ceres CLONE 1375076-F
MKMVIVLVVCLALSAASASAMQMPCPCAGLQGLYGAGAGLTTMMGAGGLYPYAEYLRQPQCSPLAAAPY

SEQ ID NO: 13935 - DNA, 715 bp, Zea mays
  misc_feature: Ceres CLONE 1375078-F
  misc_feature: Encodes the peptide sequence at SEQ ID NO. 13936
  misc_feature (579)..(579): n is a, c, t, g, unknown, or other
aagctggagctccccgcggtggcggccgctctagaactagtggatcccccgggctgcaggaattcgcacgagaccattacctagaacatcctaatcgaaaactccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgccctcttcggccgccgcgagtggtacttcttcacgccgcgggaccgcaagtaccccaacggctcccgccccaaccgcgccgccgggtcgggctactggaaggccacgggcgcggacaagcccgtggagcacggnggccggacggcggggatcaagaaggcgctcgtgttctaccacggcaagccgccgcgcggggtcaagacggagtggatcatgcacgagtaccgcctcgccggcgacgcgaagaagtccggcgccggcacgctcagga

SEQ ID NO: 13936 - protein, 159 aa, Zea mays
  misc_feature: Ceres CLONE 1375078-F
  misc_feature (21)..(147): Pfam Name: NAM Pfam Description: No apical meristem (NAM) protein
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 745 in the 11/479,226 US patent application
MAAVQQQQQQQRRDAEAELNLPPGFRFHPTDEELVAHYLCARAAGRRPPVSIIAEVDLYRFDPWDLPERALFGRREWYFFTPRDRKYPNGSRPNRAAGSGYWKATGADKPVEHGGRTAGIKKALVFYHGKPPRGVKTEWIMHEYRLAGDAKKSGAGTLR

SEQ ID NO: 13937 - DNA, 626 bp, Zea mays
  misc_feature: Ceres CLONE 1375086-F
  misc_feature: Encodes the peptide sequence at SEQ ID NO. 13938
  misc_feature (499)..(499): n is a, c, t, g, unknown, or other
  misc_feature (500)..(500): n is a, c, t, g, unknown, or other
  misc_feature (532)..(532): n is a, c, t, g, unknown, or other
  misc_feature (568)..(568): n is a, c, t, g, unknown, or other
  misc_feature (570)..(570): n is a, c, t, g, unknown, or other
ggcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacgggccgtcatggnngtcctcacgtcgggcgcgctgggggctcgggnggcctgtccctcgctcacgtgcctcgccaacacggngncgggaggcgttcccagcgcacccccggactaacgtggaggaggcgcaccggaagga

SEQ ID NO: 13938 - protein, 145 aa, Zea mays
  misc_feature: Ceres CLONE 1375086-F
  misc_feature (44)..(134): Pfam Name: Oleosin Pfam Description: Oleosin
  misc_feature (104)..(104): Xaa is any aa, unknown, or other
  misc_feature (127)..(127): Xaa is any aa, unknown, or other
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTGRHGXPHVGRAGGSGGLSLAHVPRQHGXGRRSQRTPGLTWRRRTGR

SEQ ID NO: 13939 - DNA, 619 bp, Zea mays
  misc_feature: Ceres CLONE 1375095-F
  misc_feature: Encodes the peptide sequence at SEQ ID NO. 13940
  misc_feature (421)..(421): n is a, c, t, g, unknown, or other
  misc_feature (436)..(436): n is a, c, t, g, unknown, or other
  misc_feature (469)..(469): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
tcaccgcggtggcggccgctctagaactagtggatcccccgggctgcaggaattcgcacgagaccattacctagaacatcctaatcgaaaaattatcacggcggcggtggcggagcgtaaggcgaaggagtagcagcagcaggcggcgccgagtagcggctccccatctcgagctttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacnagacctaccctgctnggttcatggatgtcatttccatccccaagaccnatgagaactacaggctgctgtacgataccaagggccgcttcccgcttcaccaaatcagggatgaggatgctaagtttcagctttgcnnnagggtaggcctgttcagttttgggcagaagggcatcccttatctgaccccggtatgacggc

SEQ ID NO: 13940 - protein, 143 aa, Zea mays
  misc_feature: Ceres CLONE 1375095-F
  misc_feature (3)..(40): Pfam Name: RS4NT Pfam Description: RS4NT (NUC023) domain
  misc_feature (80)..(80): Xaa is any aa, unknown, or other
  misc_feature (85)..(85): Xaa is any aa, unknown, or other
  misc_feature (96)..(96): Xaa is any aa, unknown, or other
  misc_feature (125)..(125): Xaa is any aa, unknown, or other
MARGLKKHLKRLNAPKHWMLDKLGGAFAPKPSSGPHKSRECLPLILIIRNRLKYALTYREVISILMQRHVLVDGKVRTDXTYPAXFMDVISIPKTXENYRLLYDTKGRFPLHQIRDEDAKFQLCXRVGLFSFGQKGIPYLTPV

SEQ ID NO: 13941 - DNA, 668 bp, Zea mays
  misc_feature: Ceres CLONE 1375098-F
  misc_feature: Encodes the peptide sequence at SEQ ID NO. 13942
  misc_feature (388)..(388): n is a, c, t, g, unknown, or other
  misc_feature (414)..(414): n is a, c, t, g, unknown, or other
  misc_feature (488)..(488): n is a, c, t, g, unknown, or other
cgctctagaactagtggatcccccgggctgcaggaattcgcacgagaccattacctagaacatcctaatcgaaaaaaaagtttcgtccaccatttcgctctcgcaagtcgcaagccaccgatttgtttacaggcgccggagctcccgacgacgactgagccatgtgcggcggcgcgatccttgccgagctccgcgagccggcgccgcgccggctcacggagcgggacatctggcagcagaagaagaagcccaagaggggcggcgccggcgggaggcgctcgttcgcggcggaagacgatgaggacttcgaggccgacttcgaggactttgaagccgactccggtgattcgatttttggagcctccggggaaggggcttgacgacgacngtcatcgagatcaagcccttcgccgncaagagtactttcctccagagatggcttaggcaccatgactactggctggttatgatggccctgcaagccaggnttgcccaaagggaaagagaaaatcctttaccgggggattccccaggcccctggggggaaagggggctggggaaatcaaacccccaaaaggggggcccggggttggctttgaaccttcaaaaaccccgggggggatctcacagcttttttgtggggagggggccagtttttcggggaaaaa

SEQ ID NO: 13942 - protein, 72 aa, Zea mays
  misc_feature: Ceres CLONE 1375098-F
MCGGAILAELREPAPRRLTERDIWQQKKKPKRGGAGGRRSFAAEDDEDFEADFEDFEADSGDSIFGASGEGA

SEQ ID NO: 13943 - DNA, 643 bp, Zea mays
  misc_feature: Ceres CLONE 1375099-F
  misc_feature: SWISSPROT Homolog: EC 4.1.1.33 Diphosphomevalonate decarboxylase
  misc_feature (534)..(534): n is a, c, t, g, unknown, or other
  misc_feature (604)..(604): n is a, c, t, g, unknown, or other
ggagctccccgcggtggcggccgctctagaactagtggatcccccgggctgcaggaattcgcacgagaccattacctagaacatcctaatcgaaaaaatccatttacctgtccaccaaaccagtctgtagtgttttttccctccctaatgaacagaccacggaggtgacgaagcagcggtagagacaaattagcgagcagagaaggggtactggcgatgacacaccttgccattgagccacatgcggtcggaagggaatgaggggctgacggcgacagtggtggtggcgcagagatggtcggggtcgagcgttacgctgatgctgtcgttgatggggaggatgagcgcctcgtcccgcttcccccagtacttgatcaccgcaatgttgggtcggcgtccgccccgttgccatgagcacccactgcccctccgccgccgccattggatctctcgcttcgcgctgctctatgcccgataattccttggccaaggggaagttagtaggcataatccctactactcttaaagcacggnggttgtaggcgtgcacaccgtgcgccatcgttctgccagcctcccgatgtcccctgggccaggatccggncacaactttttgtcgccgcaatcatcgggctacctgccc

SEQ ID NO: 13944 - DNA, 516 bp, Zea mays
  misc_feature: Ceres CLONE 1375101-F
  misc_feature: Encodes the peptide sequence at SEQ ID NO. 13945
  misc_feature (361)..(361): n is a, c, t, g, unknown, or other
tccccgcggtggcggccgctctagaactagtggatcccccgggctgcaggaattcgcacgaggccattacctagaacatcctaatcgaaaaatcacccataatattttgagcattcagaaacacaccaagcgaagcgcactagcaacgacctaacaacaatggctaccaagatattagccctccttgcgcgtcttgccctttttgtgagcgcaacaaatgcgttcattattccacaatgctcacttgctcctagtgccattattccacagttcctcccaccagtttactttcatggggcttccaacacctagctggggcaagcccaaaaatggcaaacaaaaaaaacgcctttgggggggnaaaagcggggttaaacaaaacccccatggggcgccccaatttggaaaaaaaaaaaaatcctctttgtgggccccccctttttttaaaaaaaaaaaaaaaagaggggggggggtttctcctcctcccaaaagcgcggggggggagggaggagaaaa

SEQ ID NO: 13945 - protein, 50 aa, Zea mays
  misc_feature: Ceres CLONE 1375101-F
MATKILALLARLALFVSATNAFIIPQCSLAPSAIIPQFLPPVYFHGASNT

SEQ ID NO: 13946 - DNA, 657 bp, Zea mays
  misc_feature: Ceres CLONE 1375103-F
  misc_feature: Translation starting site: 152
  misc_feature (180)..(180): n is a, c, t, g, unknown, or other
  misc_feature (272)..(272): n is a, c, t, g, unknown, or other
  misc_feature (288)..(288): n is a, c, t, g, unknown, or other
  misc_feature (290)..(290): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (299)..(299): n is a, c, t, g, unknown, or other
tccccgcggtggcggccgctctagaactagtggatcccccgggctgcaggaattcgcacgagaccattacctagaacatcctaatcgaaaaatcgaacgcacactcgcactcgcacgtacaccacactagttaccacagacgacgggcgccatgaaagtcccggtgcttctcctcctggntctcctgtgcttctcgctcgcgctcgcgtggcaaacggacacggaatcgggctcaggcaggccggtacactaccgcgaggagagtttccggnactggacccgctcccngnaggnnncgntcagggggctggacggtttcaccccacaaactttttgggagaaacccttcgggaactaaaccggttcccaaattggaggcccggccccgggggtttttgggggcccccccttataatttccacaaagggatgttcctaaaagaaaaggagaggggtgtttcgtggtttttcccccgggggaaaaaagggaatttttcttcggcccggggaggggggaaattttttttttccccccgggggggcccctggtttttttccccacaacccccccccggggggggtttccccccttttttttttcttcccccccgggttcccccgggggggggttttaaagagagtttcctcccccgggggg

SEQ ID NO: 13947 - DNA, 698 bp, Zea mays
  misc_feature: Ceres CLONE 1375107-F
  misc_feature (19)..(19): n is a, c, t, g, unknown, or other
  misc_feature (20)..(20): n is a, c, t, g, unknown, or other
  misc_feature (24)..(24): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
ggggggggggggggccccnnccanaaccaaaaaaacgccaannntttgtnnnnngggccaagctggggctccccgcggtggcggccgctctagaactagtggatcccccgggctgcaggaattcgcacgagaccattacctagaacatcctaatcgaaaaaaaaaaaaacgccggctgcaactgcaatcggcgacggtgaaccatagagcagccggcagcgtcgccgtcgcgccgctcccgcactgctcccctgccccggccgccgccgccgtcgtcgtccgcccgctcaccgctgatcgatgaccgcccgctctggcgctcggccttcgccccgtttctgccctcgcccctcagccgcctcggcgcctgtccgagaccgacgtcctctctccatccagtcagttgaccagctcgactgctctagctcgtgctctccgtcgcggatttgatttcttcctttcagcccaacccagcccaaagccgccagatcgcggcactccgtccaaccctcggggccaccgatccccttctccaccccctctcctcctcgggggggggggaagatgattccccagagccagagcagctcccctggcaggcccttccacacgtcgagaaacgggatagtgcgggttgctggaagtttgcgggaagcggtggaatggaggagctgggaatacctccccagggccccccg

SEQ ID NO: 13948 - DNA, 665 bp, Zea mays
  misc_feature: Ceres CLONE 1375111-F
  misc_feature: Encodes the peptide sequence at SEQ ID NO. 13949
aagctggagctccccgcggtggcggccgctctagaactagtggatcccccgggctgcaggaattcgcacgagaccattacctagaacatcctaatcgaaaaggggagtgtgcagcagtatgttctcggtctcgccatcgcatctcgcagagtagacactcaaatccgattgtcgagggggagaaggtggagatcgttgtaacggctagttgcgtcggcccgatggacccgtcgtaccatggcggcggcgccgccggtggaagcgccgacgaccatggccaaattctttgggattggacagaacagcattgtgaacctaacgattcaagtcatgatgctactaaatttgtgtgggattgcctcaatcaagatgacaatgagctgttgggattgcttggaaatcaaaccccattgagatactgccgtgatttcttcgctgaccttgatgatatcacatgcaaggagaccctggacctggaggaatctcgggaatcaaagcggcggcgcacattggagtaccctttggagtctagtcagtcagaagttgggactcatgaaaccggttcacctttcgtcacacctgaggtagcagaaatttcattgctctgcactgataaaccacagagcttaaattgtgatgaagcaccctaccagcaagaggatatt

SEQ ID NO: 13949 - protein, 148 aa, Zea mays
  misc_feature: Ceres CLONE 1375111-F
MDPSYHGGGAAGGSADDHGQILWDWTEQHCEPNDSSHDATKFVWDCLNQDDNELLGLLGNQTPLRYCRDFFADLDDITCKETLDLEESRESKRRRTLEYPLESSQSEVGTHETGSPFVTPEVAEISLLCTDKPQSLNCDEAPYQQEDI

SEQ ID NO: 13950 - DNA, 706 bp, Zea mays
  misc_feature: Ceres CLONE 1375112-F
  misc_feature: Translation starting site: 181
  misc_feature: SWISSPROT Homolog: EC 2.7.10.2 Non-specific protein-tyrosine kinase
  misc_feature (178)..(178): n is a, c, t, g, unknown, or other
  misc_feature (236)..(236): n is a, c, t, g, unknown, or other
  misc_feature (294)..(294): n is a, c, t, g, unknown, or other
tccccgcggtggcggccgctctagaactagtggatcccccgggctgcaggaattcgcacgagaccattacctagaacatcctaatcgaaaaattcacacaccacacctcccgaactacaagtttcgcttctcgtcgcgacgactgggcgagaccgccgccgccgcctgagttctgtanaaatggctgatggtgaggacatccagcctcttgtctgcgacaatggcactggaatggntcaggctggttttgctggcgacgatgcaccaagggctgttttccctagtattggtggnccgtcctcgccacactggtgttatggtagggatgggacagaagatgcttatgttggcgacgaggcccagtccgaggagaggtattctcacgctcaagtatccgatcgagcatggaatggggagcaattgggagtaactgggaaaaatctgggattacccatttcaaaaaggaggttccggtttcccccaaaggaacccccttgggttggccctggaggctccttttaaccccaagggcccaagggggaaaaaggcccccaattttgttccaagattttcagggtcctggcggggaacttaaaatttaaggggggggttgtccctttttgccgggggggcaaaaaatgggtgttttttccccccctcgcgggggggggggggaaccccccggccccctttttaaggggggtgt

SEQ ID NO: 13951 - DNA, 683 bp, Zea mays
  misc_feature: Ceres CLONE 1375114-F
  misc_feature: Encodes the peptide sequence at SEQ ID NO. 13952
  misc_feature (458)..(458): n is a, c, t, g, unknown, or other
  misc_feature (461)..(461): n is a, c, t, g, unknown, or other
  misc_feature (465)..(465): n is a, c, t, g, unknown, or other
  misc_feature (493)..(493): n is a, c, t, g, unknown, or other
  misc_feature (505)..(505): n is a, c, t, g, unknown, or other
tccccgcggtggcggccgctctagaactagtggatcccccgggctgcaggaattcgcacgagaccattacctagaacatcctaatcgaaaaagcactatcagtaataagaaacacgtcgaagtcgtcgtatttttacgtgctcccgtccgtcccgtgcgccatgtcacgcagcaacgccttgatgtggttgttgcttctcgcgctctcgtgctggtcgtggtgcggcgccgtcacggcgcggccgaccccgagcgccagcaccagcaccagcacagccggcggcggcttcatcaggtcgtggtgcgcggggacggactacccggtcctgtgcaacgcgacgctggccccgtacgctgagcatgtcggggacagcccggcgcgtctgtcgctgccggcgctgactgtcactctgcacggcgcgcgtagggcgacgcccactatgaatgcaatgtctgcnggncggngctagcacccaccaccctcgtgccgtgncggtcgaggcgncggcagactgggtgggcatgctcgaggacgccgtggacctgctgcggcagtcggtggatgaaatggagcgcctccgcaagggacccgccagccccagtgccagggccaggcggcaggccggcggaagcctcaggctcccggtgaaacagggtggaaacatgggccaaaggccccgctt

SEQ ID NO: 13952 - protein, 101 aa, Zea mays
  misc_feature: Ceres CLONE 1375114-F
MSRSNALMWLLLLALSCWSWCGAVTARPTPSASTSTSTAGGGFIRSWCAGTDYPVLCNATLAPYAEHVGDSPARLSLPALTVTLHGARRATPTMNAMSAGR

SEQ ID NO: 13953 - DNA, 709 bp, Zea mays
  misc_feature: Ceres CLONE 1375119-F
  misc_feature: Encodes the peptide sequence at SEQ ID NO. 13954
  misc_feature (325)..(325): n is a, c, t, g, unknown, or other
  misc_feature (370)..(370): n is a, c, t, g, unknown, or other
aagctggagctccccgcggtggcggccgctctagaactagtggatcccccgggctgcaggaattcgcacgagaccattacctagaacatcctaatcgaaaaactactctctctctctctgcctgcaaagctgcttgatccatcatcgatcacatcactccaccagccgcagcgcacgaacgtacgactcatggcagatcgcgaccgcagcggcatctacggcggcagcgcctacggacagcagcaggggggcggccacccgatgggtgagcaggtgaaaggcatgatccacgactagggggccgacggcgtcccaggggctgacngttgcgacgctgttcccctctgggcgggctgcttcctggtgctgncggggcctgggggctggcgggcctccaggggggggggctggccccgggccacgcccgtgggtcctgggtttttaagccccgggggttggcccccgccgggggtggtcatcgggaacggcccgtccgggggggtcccccccgcccgggggggccgtgggggtctccgggggcctgttccccccctcacacggggccccccccaaaaaggggggggggggggggtttccacggggaaccccggggaaaaaattataggggagggccgcccccacaaaaaggggagagagcgccgggggccaacccggggcccacaaaaaaccgcggggagggggggggaaa

SEQ ID NO: 13954 - protein, 35 aa, Zea mays
  misc_feature: Ceres CLONE 1375119-F
MADRDRSGIYGGSAYGQQQGGGHPMGEQVKGMIHD

SEQ ID NO: 13955 - DNA, 717 bp, Zea mays
  misc_feature: Ceres CLONE 1375120-F
  misc_feature: Encodes the peptide sequence at SEQ ID NO. 13956
tggagctccccgcggtggcggccgctctagaactagtggatcccccgggctgcaggaattcgcacgagaccattacctagaacatcctaatcgaaaagaaaggatctctctgcgcgccggggcggcgatggcgagggtgccggcgcccctgccggcgcccgtcgcagactggtgggagcgcgtcaacgactcgccggcgtggcaggacgggatcttctggaccctcgccgtcctctacggtgccattgctaccgcctcattcatccaagttgccaggatacagggcagagtccctgaatatggatggacaacccataaggtcttccagttcctgaatttcgtggtcagtggggccaggagctctatctttgctttccgtcgcccagcgcaacaagtgaaccctccgatctttcagcatgtcattcttgatcttcctggccttgcattcttcactacctatgcactgttagcgcttttctgggccgagatactttaccaagcacgtggaataatgactgatcgacttagatcaggattctacatcattacttgtgctgtatatgcaccgcaggcttctctgtgcttgtggctgtgccggaatccaatcattctatgctaggcactactagctattcattgcaggtctttcttatttcactggcttgggttttctgatctatgaagcaaggcttttctcatgctgaatatttttctatt

SEQ ID NO: 13956 - protein, 163 aa, Zea mays
  misc_feature: Ceres CLONE 1375120-F
  misc_feature (1)..(164): Pfam Name: DUF1084 Pfam Description: Protein of unknown function (DUF1084)
MARVPAPLPAPVADWWERVNDSPAWQDGIFWTLAVLYGAIATASFIQVARIQGRVPEYGWTTHKVFQFLNFVVSGARSSIFAFRRPAQQVNPPIFQHVILDLPGLAFFTTYALLALFWAEILYQARGIMTDRLRSGFYIITCAVYAPQASLCLWLCRNPIILC

SEQ ID NO: 13957 - DNA, 654 bp, Zea mays
  misc_feature: Ceres CLONE 1375121-F
  misc_feature: Encodes the peptide sequence at SEQ ID NO. 13958
aagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccccattcaccactgtctacattgaaccgtgctgctttattgcagcaacaactattaccatttcagcagctagctactgcctactctcagaaacacaacttcttccatttaaccaattggccgcc

SEQ ID NO: 13958 - protein, 161 aa, Zea mays
  misc_feature: Ceres CLONE 1375121-F
MATKIFSLLMLLALSACVANATIFPQCSQAPIASLLPPYLPSMIASVCENPALQPYRLQQAIAASNIPLSPLFQQSPALSLVQSLVQTIRAQQLQQLVLPVINQVALANLSPYSQQQQFLPHSPLSTLNRAALLQQQLLPFQQLATAYSQKHNFFHLTNWP

SEQ ID NO: 13959 - DNA, 698 bp, Zea mays
  misc_feature: Ceres CLONE 1375129-F
  misc_feature: Translation starting site: 288
  misc_feature: SWISSPROT Homolog: EC 3.1.3.16 Phosphoprotein phosphatase
  misc_feature (265)..(265): n is a, c, t, g, unknown, or other
  misc_feature (357)..(357): n is a, c, t, g, unknown, or other
  misc_feature (381)..(381): n is a, c, t, g, unknown, or other
tggagctccccgcggtggcggccgctctagaactagtggatcccccgggctgcaggaattcgcacgagaccattacctagaacatcctaatcgaaaagaggaaaaatctcgcattcgcaaaccaagcaaatggaggcatgagctccgccgcctccccgtctctcgccgatctcccccaaaccctagcctcgacctgaccgccagcgggcccgcaggccggagaaggagtcggagtcgcccccacccacccaccctctgccgcggncggggagcgggcggcggacgagatgccgtcgcacggggatctggaccggcagatcgcgcagctgcgcgactgcaagtacctgccccgagcgnaggtcaaggtgctctgcgagcagnccagggccatcctcatggaggaatggaacgtgcagcccgtgcgctgccccgtcacggtctgcggggacttcacgggcaggtctatgacctcatcgaggtcttccggatcgggggggactctcccgaaaccactacctctttatgggggactacggcgatcgtggctattaattcaggtgaaacgggttcccctggtaggggctttaaaaggccgttacgaaaaaaaaattccaaactttcgggaaaacctgggaggcaaaaaacccccgcggggggcggtttcattggggggggtaaaaaaaatgggaagggggagg

SEQ ID NO: 13960 - DNA, 729 bp, Zea mays
  misc_feature: Ceres CLONE 1375130-F
  misc_feature: Encodes the peptide sequence at SEQ ID NO. 13961
aaggtggagctccccgcggtggcgggcgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcggccaaggtgctggacatgggcgcggcggcgatgcagtcgttgcgccccgtgaagcaggcgaagcagcacatgtgcacgttcgcgctgtacgcgcacgacccgaagcgggaggtggagacgcaccactgcggctcccgcctcaaccaggacttcctccagtgcgccggctatgactccgacaaaggcgacgcgcggcctcatcggcgggggagtacatccgggtgcgaggaaagatcttccgactcgcttgccgggggagggacgaaccggcttggggcactccgcacgcgcagagaggccaagccgggccctgtggacgagccccccacggtgggggggcctgctggaggaagggggaagctggaccacttgccccccccggtcggggaaggtgtcggggggacccggggggagggggaccccgggagacccgctggccgtggggcgccccccgggctcctgtggggggccccccg

SEQ ID NO: 13961 - protein, 191 aa, Zea mays
  misc_feature: Ceres CLONE 1375130-F
  misc_feature (26)..(183): Pfam Name: DUF1264 Pfam Description: Protein of unknown function (DUF1264)
MASSDGKPLPTPASVGGGGGSSTAPPGQPTTVAAKVLDMGAAAMQSLRPVKQAKQHMCTFALYAHDPKREVETHHCGSRLNQDFLQCAGYDSDKGDARPHRRGSTSGCEERSSDSLAGGGTNRLGALRTRREAKPGPVDEPPTVGGPAGGRGKLDHLPPPVGEGVGGTRGEGDPGRPAGRGAPPGLLWGAP

SEQ ID NO: 13962 - DNA, 680 bp, Zea mays
  misc_feature: Ceres CLONE 1375131-F
  misc_feature (191)..(191): n is a, c, t, g, unknown, or other
  misc_feature (328)..(328): n is a, c, t, g, unknown, or other
  misc_feature (329)..(329): n is a, c, t, g, unknown, or other
  misc_feature (364)..(364): n is a, c, t, g, unknown, or other
  misc_feature (368)..(368): n is a, c, t, g, unknown, or other
  misc_feature (380)..(380): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (607)..(607): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (659)..(659): n is a, c, t, g, unknown, or other
aagctggagctccccgcggtggcggccgctctagaactagtggatcccccgggctgcaggaattcgcacgagaccattacctagaacatcctaatcggaaaattttctctcctctctccgtcgccgcctcgggccaaaccctacgcagggagttgattgatcgattgcagccatgagtaagttgcattccngagcttctcaaggattgcatctcccagatagttcaggatgccaagaagaataggaagttcactgagactgttgagcttcagattagtctgaagattatgatcacaaaaggggacagcgttcagtggctctggtaagnntgcctcacatcccctcgtcccaaaagaatgaaggnggtngcatggcttggntggatgcccaggcacggttgaaggagggtttgagaagaatggggcacttgggcctaaccgggggaggggtttgagggcccccccccccgagagaaaagggggggccccccaaaaaacaccccnnnnnntttttttttttttttttaaaaaaaaaaaaaaagtttttgctcccccacaaaaaaaaaaaaaacacacggccccttgtttttttttttttttgttggaanaaactcaacaaaaaacaaaannncaaccaccacccttcccctcctttacctntgggagggctcgctgcgccca

SEQ ID NO: 13963 - DNA, 757 bp, Zea mays
  misc_feature: Ceres CLONE 1375132-F
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (23)..(23): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (221)..(221): n is a, c, t, g, unknown, or other
  misc_feature (360)..(360): n is a, c, t, g, unknown, or other
  misc_feature (366)..(366): n is a, c, t, g, unknown, or other
gggttggtgtnnntnnnnnnaancacnnnngctnnngnnggggnggtgtccnnnnccaaagctggggctccccgcggtggcggccgctctagaactagtggatcccccgggctgcaggaattcgcacgagaccattacctagaacatcctaatcgaaaaaattgaaaacagggccttggtcgagttaaaaaaaacgcgagtgaaacacactgacaccgcanacacgccaaccggcctaccgccttcttctcttgtctcgtcctcctcgcgactatggccgccgccgccgaggtagaccccagccccaacccgccgccaactacagcctccggcctctccaagaccaagacgcagggaggncgaccngcgccgacgccgccgcatcaaggccaagaagaacaagtccgtcactgaggctgatgcccaggacgctggacggggagcttccagcctccgacgccaaggaagaaccgccgatccccaacccccgaacccccagggttggagggggaagaataaagtaaccgtgcccggaaaaaaaggcccaaattttgaaccaacccctcccccccggggagagattttccaaggggccccccctttccaaaaaaagatttcccccttttaaaaaccccctttttttcaaccgggggccccccggggttttttttataaaaaaaccacagggggggccccccttaatcccccacaaaaaaaagggggtgcccccgggggggtggggatggcgccccccccc

SEQ ID NO: 13964 - DNA, 726 bp, Zea mays
  misc_feature: Ceres CLONE 1375141-F
  misc_feature: Encodes the peptide sequence at SEQ ID NO. 13965
  misc_feature (362)..(362): n is a, c, t, g, unknown, or other
  misc_feature (638)..(638): n is a, c, t, g, unknown, or other
  misc_feature (673)..(673): n is a, c, t, g, unknown, or other
  misc_feature (681)..(681): n is a, c, t, g, unknown, or other
tggagctccccgcggtggcggccgctctagaactagtggatcccccgggctgcaggaattcgcacgagaccattacctagaacatcctaatcgaaaagtaccacgttcaaaacggcaagtcgatcgatctgaaaccacagatcgatcgacgaccagcacaagacgacgtacgtgaaaccgcgagacagtgcgaggacgactggggtgtggcggtgcgatccatcgacaaggccatgggacaacggcgctttgaggacgaacgcgcagctctggcgactgtggcaagcttgctgctcatcctaacgacagcccaagctgctgctgctgctgcttctggacgccatctgtctttgcccacgcanaaggcggcggcggcgcgcatgaacgacaccagtagtagtgacatgcaggtcatcacacccgcgccactcgctatctcgacggcggctcgaatggggccggacgggtgctccggggaggacgtggcggtgtaccagagcagcgccaaccctctgcccagcggcatcccggcctacaccgtgcgcatcatcaacgtctgcagcggggggtgcaccgtctacgacgtccacgtctcctgcggcgacttcgcgtccacggagctggtcgacccggccagnttccagcgcgtcggctttcacgactgcgtcgttcnagggcggntggggcgctcgagcccagcgagaccgtgctctttcagtacgtcaa

SEQ ID NO: 13965 - protein, 164 aa, Zea mays
  misc_feature: Ceres CLONE 1375141-F
  misc_feature (43)..(43): Xaa is any aa, unknown, or other
  misc_feature (135)..(135): Xaa is any aa, unknown, or other
  misc_feature (147)..(147): Xaa is any aa, unknown, or other
  misc_feature (150)..(150): Xaa is any aa, unknown, or other
MGQRRFEDERAALATVASLLLILTTAQAAAAAASGRHLSLPTXKAAAARMNDTSSSDMQVITPAPLAISTAARMGPDGCSGEDVAVYQSSANPLPSGIPAYTVRIINVCSGGCTVYDVHVSCGDFASTELVDPAXFQRVGFHDCVVXGRXGRSSPARPCSFSTS

SEQ ID NO: 13966 - DNA, 844 bp, Zea mays
  misc_feature: Ceres CLONE 1375145-F
  misc_feature: Encodes the peptide sequence at SEQ ID NO. 13967
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
nnnnnnnnnnnnnnnnnnncccccccccctcgggtnntgcgttccnnncaagctggcgctccaccgcggtggcggccgctctagaactagtggatcccccgggctgcaggaattcgcacgagaccattacctagaacatcctaatcgaaaaacacacatattattgagaccaactagcaacatagaaagcacaatagtgtaccaacaatggcagccaaaatattttgcctccttatgctccttggtctttctgcaagtgctgctacggcgaccattttcccacaatgctcacaagctccctatagcttcccttcttccctcgtacctctcccagcggtgtcttcggtatgtgaaaacccaatttcttcaccctacgggatccaacagggaatttgcaggttggaatcttaaccttttatcagccctttggttcctcccaaaacgatcatcgaccccctattaacggaaggtacccttttggggggaattttattggggacaaaaaaaatcgggggggcgccaaaaaacttaacaaccaacttttgggggcttaacaaaaacccttgggtggggcctaatctcccccgagaaacccgtcaaggttttccttttcccatttccaacccaaaattaaacttgggcacttgagaaccccgggcgctcctttattttggccaacaacccagccgagtctaccattttcgggccaggcttattgtggctggcccaaccccctcagaaattttcctctccccttccacccaaggcgggaaggaactgggaccccccccgggtttatttaacgggcgggcgaacaactactaccatttccggccggtggagg

SEQ ID NO: 13967 - protein, 67 aa, Zea mays
  misc_feature: Ceres CLONE 1375145-F
MAAKIFCLLMLLGLSASAATATIFPQCSQAPYSFPSSLVPLPAVSSVCENPISSPYGIQQGICRLES

SEQ ID NO: 13968 - DNA, 663 bp, Zea mays
  misc_feature: Ceres CLONE 1375149-F
  misc_feature: Encodes the peptide sequence at SEQ ID NO. 13969
  misc_feature (230)..(230): n is a, c, t, g, unknown, or other
  misc_feature (263)..(263): n is a, c, t, g, unknown, or other
  misc_feature (267)..(267): n is a, c, t, g, unknown, or other
  misc_feature (274)..(274): n is a, c, t, g, unknown, or other
  misc_feature (277)..(277): n is a, c, t, g, unknown, or other
  misc_feature (280)..(280): n is a, c, t, g, unknown, or other
  misc_feature (283)..(283): n is a, c, t, g, unknown, or other
  misc_feature (286)..(286): n is a, c, t, g, unknown, or other
  misc_feature (287)..(287): n is a, c, t, g, unknown, or other
  misc_feature (292)..(292): n is a, c, t, g, unknown, or other
  misc_feature (324)..(324): n is a, c, t, g, unknown, or other
aagctggagctccccgcggtggcggccgctctagaactagtggatcccccgggctgcaggaattcgcacgagaccattacctagaacatcctaatcgaaaattttttttgtttggttgttcctctcgctcgccagtcgccaccaggcagcaggcatcccaatctcgcgagagccagtagcggcggcggcgcttccggcttcccttccattggctccgggatggcgctccngctcacgacgtcgcggtctggctctcccggcgntcgncgccggncgncgnagnggnnggagnttcgtcgccggcggcttcatgaggttcggcgncgtctccaccagggtggagaaaaagaaggcatttgctccttcgagggagggacatgggcagggtacacaattcaatggcatctccacagaatggaaattttccagggcccctggagggtgggctataggataatatcattgagacatctcaagagccaactaaaagagggtgtggaaacacagggaaatcccctccgggacccggaaatgtaagggtttcctggggtgaataaggaagtcccaggaacggggccaggaaaatcctgaagataatattgggtgggttgggggggaacattggatcagtggaggaatctcaaccaacatacaagactaggt

SEQ ID NO: 13969 - protein, 48 aa, Zea mays
  misc_feature: Ceres CLONE 1375149-F
  misc_feature (5)..(5): Xaa is any aa, unknown, or other
MRFGXVSTRVEKKKAFAPSREGHGQGTQFNGISTEWKFSRAPGGWAIG

SEQ ID NO: 13970 - DNA, 694 bp, Zea mays
  misc_feature: Ceres CLONE 1375153-F
  misc_feature: Encodes the peptide sequence at SEQ ID NO. 13971
  misc_feature (580)..(580): n is a, c, t, g, unknown, or other
tggagctccccgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgattgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtcttttttcgcctccgtgctctccgggctcttcggccaggccgaggccgaggacgaggacgaggacgaagagatgcccacgcgcaaccacaacgctgccgcggctgccgctccgcagcatcaccatcacaaccgaggtggtgctccccgctctgnaaagagcagggccgtgccccggccgagctgatgccatgaaccggcgagccccccttcgggatatgggcaacctcgtcagggtccgcccaggcgaaggggaacctccgctggcgg

SEQ ID NO: 13971 - protein, 37 aa, Zea mays
  misc_feature: Ceres CLONE 1375153-F
  misc_feature (28)..(28): Xaa is any aa, unknown, or other
MPTRNHNAAAAAAPQHHHHNRGGAPRSXKSRAVPRPS

SEQ ID NO: 13972 - DNA, 741 bp, Zea mays
  misc_feature: Ceres CLONE 1375154-F
  misc_feature: Translation starting site: 220
  misc_feature (520)..(520): n is a, c, t, g, unknown, or other
  misc_feature (597)..(597): n is a, c, t, g, unknown, or other
  misc_feature (607)..(607): n is a, c, t, g, unknown, or other
  misc_feature (642)..(642): n is a, c, t, g, unknown, or other
aagctggagctcaccgcggtggcggccgctctagaactagtggatcccccgggctgcaggaattcgcacgagaccattacctagaacatcctaatcgaaaaatatacctcctcaaggcacgttcaccacagtcctctctttccccggcaccaccaccaccacccaggctaacaggactggaccgagtgttgaacaacactgcagtgagcgacggtagacatggcgagccgtgaaaatttgcacctggtgctggacccggcgtatctgggcgcgccttgggccgacccggccgcggcaaacatccctccgcagctcctcgccgggctgggagagaaactctactccccaccgcggcgacgggggggaggggggcctaacgggaagggcatggaagcaaaaggggcccgggggaggcgggggctcgaaaaaaaaacaagccaaaaaattgggacggaggtggggctacggggccaaccggggggaagggggggggggggaagggggaaacccaggggggcangaaaaccttgcccccgggggaaggagggcaacaaacgcggtcccggaacgtcgaacgggggggtccaaaaagggggnggggaagganaccggggggccaaccggggcggcaggggaaaactngtagggcctacaatgggcgcacacccaaaggggggggaaaaaagggctggggccaccactgcaccaaacggtgggggggagggaggaacaaaatgggaa

SEQ ID NO: 13973 - DNA, 736 bp, Zea mays
  misc_feature: Ceres CLONE 1375157-F
  misc_feature: Encodes the peptide sequence at SEQ ID NO. 13974
  misc_feature (538)..(538): n is a, c, t, g, unknown, or other
  misc_feature (582)..(582): n is a, c, t, g, unknown, or other
  misc_feature (696)..(696): n is a, c, t, g, unknown, or other
  misc_feature (703)..(703): n is a, c, t, g, unknown, or other
  misc_feature (704)..(704): n is a, c, t, g, unknown, or other
  misc_feature (714)..(714): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacggccgtcatggagttcctcacgtcgggcgcgctggangcatcgggggcctgtcctcgctcacgtgcctcgccaacacggcngcggcaggcgttccagcgcactcgggactaacgtggaggaggcgcaccgcagggatggcggaggtcgcggcgcacgcgggccaaaagaccgcgcaggcagacaggccatccagnctagggnncagaagctgntttcccgggaaatggtcaggtt

SEQ ID NO: 13974 - protein, 135 aa, Zea mays
  misc_feature: Ceres CLONE 1375157-F
  misc_feature (44)..(136): Pfam Name: Oleosin Pfam Description: Oleosin
  misc_feature (111)..(111): Xaa is any aa, unknown, or other
  misc_feature (126)..(126): Xaa is any aa, unknown, or other
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTAVMEFLTSGALXASGACPRSRASPTRXRQAFQRTRD

SEQ ID NO: 13975 - DNA, 666 bp, Zea mays
  misc_feature: Ceres CLONE 1375158-F
  misc_feature: Encodes the peptide sequence at SEQ ID NO. 13976
  misc_feature (493)..(493): n is a, c, t, g, unknown, or other
tggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggngtgcgccagttcaacgagggccccgtggaggcgaagcaggcgctctactcgagggacctcgctcgcaacctgcgcttcgcctccaacttcgacctcttcaaggctgctgcggccgactggcgcgacacgctcttctgcgaggtggctccgaacccgccgccgcggaggagctg

SEQ ID NO: 13976 - protein, 174 aa, Zea mays
  misc_feature: Ceres CLONE 1375158-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPVEAKQALYSRDLARNLRFASNFDLFKAAAADWRDTLFCEVAPNPPPRRS

SEQ ID NO: 13977 - DNA, 714 bp, Zea mays
  misc_feature: Ceres CLONE 1375159-F
  misc_feature (444)..(444): n is a, c, t, g, unknown, or other
  misc_feature (559)..(559): n is a, c, t, g, unknown, or other
tggagctccccgcggtggcggccgctctagaactagtggatcccccgggctgcaggaattcgcacgagaccattacctagaacatcctaatcgaaaaacaacaaaacaagcctaatggcttcctctccatctcacgccactgcgttgcctacttgccctagaaccctcgccgccgcccctctttaggattcccatgtccctggtcgccccctgacacgcccgccccggatcctgcaccggaattccgcgtggaattccgggccgaaccgcctctctgcgtgcgcctccgaccaccaaactctctctctcacacgcgcgcgcgcgcgcacgtctgaggcggttggattctccggtgggggttccttggtctcgatttgctgctgatgggggtgccgaagcagcgctggacgccggagggagaggccgcgctcaagggcggcgtcngcaagcacgggccccggaaggtgcgcaccatcctccggactcggacttcaggggggtcctggcgctccggtccatgttgactccaggtgaccctcggatccccggggaaggcggnccgtggggtttttgggaaccacttgggggagaaacgaaggaattccccggcttttttaaaagcaaaaaaaaatgggggttttggagcgcccaaacagggtggggggggtcccttattgggccccaaaacgggatttttaagggggggaaaaaaaa

SEQ ID NO: 13978 - DNA, 705 bp, Zea mays
  misc_feature: Ceres CLONE 1375162-F
  misc_feature: Translation starting site: 217
  misc_feature (333)..(333): n is a, c, t, g, unknown, or other
  misc_feature (336)..(336): n is a, c, t, g, unknown, or other
  misc_feature (469)..(469): n is a, c, t, g, unknown, or other
  misc_feature (470)..(470): n is a, c, t, g, unknown, or other
  misc_feature (580)..(580): n is a, c, t, g, unknown, or other
  misc_feature (648)..(648): n is a, c, t, g, unknown, or other
aagctggagctccccgcggtggcggccgctctagaactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggattcaggctgacggtcagatgcccggtgacnaangacattgggggaggtgatgatggctttcaacacctttcctcagtggagaactggtgctggggagccacgtgcccccgtggctgtttttggtggacctttgaacccactgtcatcgatgaagtggaggactggnnacctaccggcaggttcttccaccctggagcagctcatcaggggggaagggaggatgcagcccacaaacttttgccccgtgggcactaacaccatgggcaagggagatggnttgacttatggccttgatcgcatcagggagctgggcggacactgcactggccctcaggggcttctcgncttcaacgctgttggtggagaacgggctctggccttgggtccctcctctagagcgcg

SEQ ID NO: 13979 - DNA, 736 bp, Zea mays
  misc_feature: Ceres CLONE 1375165-F
  misc_feature: Encodes the peptide sequence at SEQ ID NO. 13980
ggagctccccgcggtggcggccgctctagaactagtggatcccccgggctgcaggaattcgcacgagaccattacctagaacatcccaatcgaaaactcgaaaccctagcgccggcgcctccacttcgttttcctcactctctcctccagctcagggtccggcggcgaagggaaggcaggatgtacaccgcgaggaagaagatccagaaggagaagggccttgagccctccgagttcgaggactccgttgcccaggctttctttgatctggagaacgggaaccaggagctcaagagcgacctcaaggacctgtacatcaacaatgctatccagatggatgttaccgggagcaggaaggttgttgtcatccacgtaccataccgcctgcgcaaggacttcaggaagatccatgtcagactcggcagggagctggagaagaaattcagcggcaaggatgtgggaattgttgctacaaggaggattgtgaggccacccaagaaggcttcagctgttctgcgccctcgcaccaagactctgactgctggtcacgatggcatcttggaggatggtgtccacccagctgagattggtgggaagcgtgccacatacccgtcggggaggttccaagaatatcaagattttcttggacccaaagggaagggaacaacaccgggatacaagctggagaccctgcactgggggtctaaccgcaaggttgtgtggggaaagaatgtgg

SEQ ID NO: 13980 - protein, 185 aa, Zea mays
  misc_feature: Ceres CLONE 1375165-F
  misc_feature (6)..(185): Pfam Name: Ribosomal_S7e Pfam Description: Ribosomal protein S7e
MYTARKKIQKEKGLEPSEFEDSVAQAFFDLENGNQELKSDLKDLYINNAIQMDVTGSRKVVVIHVPYRLRKDFRKIHVRLGRELEKKFSGKDVGIVATRRIVRPPKKASAVLRPRTKTLTAGHDGILEDGVHPAEIGGKRATYPSGRFQEYQDFLGPKGKGTTPGYKLETLHWGSNRKVVWGKNV

SEQ ID NO: 13981 - DNA, 676 bp, Zea mays
  misc_feature: Ceres CLONE 1375168-F
  misc_feature: Encodes the peptide sequence at SEQ ID NO. 13982
  misc_feature (436)..(436): n is a, c, t, g, unknown, or other
ctccccgcggtggcggccgctctagaactagtggatcccccgggctgcaggaattcgcacgagaccattacctagaacatcctaatcgaaaaaagaaaataggagcagcttcacctcggaagctcagactcagtaggatgcaacaagaacatgcccaaccttcaatggttggtgcgaaggggtgtgagagatgcagggactggcaggagcactactactgggagcatatggatgcgagcaagatccgcttcttcaggtgcatgacaggagactttgctcatcgcattagcgtgccagagaagttcgcaaagaacttcaaggggcagatcaccgaagagtttcacctgaaatcacctagcagcgctgagacatggcacgtcggtgtaaagaagcatggcgacaactattcctcgtgtcaggttgggagatttcgccnaggctcatgagctggaggagaacgatctcctgctcttcgcttgctctggaaactcttccttttgagggtcctaatcttcgagcaagtggcttgtgagaagtgtcatccctggttggcagggggactttggtccggaaatgggcaaacaattcagggatgggggggcgccaaacctggggggcatccttctggggagtgggagggatctgagggaaaccgttggccctcccaggtggttca

SEQ ID NO: 13982 - protein, 93 aa, Zea mays
  misc_feature: Ceres CLONE 1375168-F
  misc_feature (91)..(91): Xaa is any aa, unknown, or other
MVGAKGCERCRDWQEHYYWEHMDASKIRFFRCMTGDFAHRISVPEKFAKNFKGQITEEFHLKSPSSAETWHVGVKKHGDNYSSCQVGRFRXGS

SEQ ID NO: 13983 - DNA, 718 bp, Zea mays
  misc_feature: Ceres CLONE 1375169-F
  misc_feature: Encodes the peptide sequence at SEQ ID NO. 13984
  misc_feature (561)..(561): n is a, c, t, g, unknown, or other
tggagctccccgcggtggcggccgctctagaactagtggatcccccgggctgcaggaattcgcacgagaccattacctagaacatcctaatcgaaaaattaaaacccactcacgctcctctccaagtagtagtagtaagtaagaacagatgtcaaacaacacttcccatgttcctcccatgcccctctctcatcacttcagcgactatggcttcgatccccagatcgactactttcaggttttggaagaagcgaggaagcacaagaaagaaactccctccattgacagtatacatcagttcaagctccagaaacctatatctaaggatgatctgatccgaaccgctctccacaagaagaagaagcgctggttcttgaaaaacgctatgctcttcttcagctggcggaaatggcgaaggcgaggcagtcattacgcagaggaaggagacgtggagatggaactcgacgttcacatggcgagggctaggaactttcgcgccacatcagtcgtcggagccggttcgatatctggtccggtttacgtgacggagagctggagcgnttcgagcacaccgtaccgaacgataagaccttcttcgctgacgtcgacgccagctgctggtccgtatatgagtctacgggagcttaacatggagcggcaacagaggagcaacgcatcttcttctaggtcgggtcctctttacttgggcacgtgattt

SEQ ID NO: 13984 - protein, 178 aa, Zea mays
  misc_feature: Ceres CLONE 1375169-F
  misc_feature (128)..(128): Xaa is any aa, unknown, or other
MPLSHHFSDYGFDPQIDYFQVLEEARKHKKETPSIDSIHQFKLQKPISKDDLIRTALHKKKKRWFLKNAMLFFSWRKWRRRGSHYAEEGDVEMELDVHMARARNFRATSVVGAGSISGPVYVTESWSXSSTPYRTIRPSSLTSTPAAGPYMSLRELNMERQQRSNASSSRSGPLYLGT

SEQ ID NO: 13985 - DNA, 675 bp, Zea mays
  misc_feature: Ceres CLONE 1375170-F
  misc_feature: Encodes the peptide sequence at SEQ ID NO. 13986
  misc_feature (407)..(407): n is a, c, t, g, unknown, or other
aaagctggagctccccgcggtggcggccgctctagaactagtggatcccccgggctgcaggaattcgcacgagaccattacctagaacatcctaatcgaaaaacacgaactcgagacctcgcccgtccaaatacaaaagcctcagatctcagcgaccagcgccgccgcttcgttcgtgcctaatagagaacagaggaaatggaggagagcgagggcgtgctcctggggatgcgcaaccccctcctcgacatctccgccgttgtcgatgacgccttcctgggaaagtatgacatcaagctgaacaatgccattctcgttgaggagaagcactcgcctatgtatgatgagttggctactaacagcaatgttgaatatattgctggaggagccacccacaactctatcanggttgcccaatggatgcttcagactcctggtgcaacaagttacatgtcatgcattgcgaacgacaagtttggtgaggatatgaagaaaaatgctcaagctgcaggagctactgctcattactatgaggatgagactgctcctactggaacatgtgctgtatgtgttgctggtggcgcaaggtcattgattgcaaatctgtctgcggcaaactgttactaatctgagcatctcaagagaccagagaactgggcactacttgagaaggga

SEQ ID NO: 13986 - protein, 142 aa, Zea mays
  misc_feature: Ceres CLONE 1375170-F
  misc_feature: SWISSPROT Homolog: EC 2.7.1.20 Adenosine kinase
  misc_feature (70)..(70): Xaa is any aa, unknown, or other
MEESEGVLLGMRNPLLDISAVVDDAFLGKYDIKLNNAILVEEKHSPMYDELATNSNVEYIAGGATHNSIXVAQWMLQTPGATSYMSCIANDKFGEDMKKNAQAAGATAHYYEDETAPTGTCAVCVAGGARSLIANLSAANCY

SEQ ID NO: 13987 - DNA, 714 bp, Zea mays
  misc_feature: Ceres CLONE 1375172-F
  misc_feature: Encodes the peptide sequence at SEQ ID NO. 13988
  misc_feature (509)..(509): n is a, c, t, g, unknown, or other
ctggagctccccgcggtggcggccgctctagaactagtggatcccccgggctgcaggaattcgcacgagaccattacctagaacatcctaatcgaaaaattaacgtttcagggataaaagctctcgaacaaagagggtgtaccggcgccaccgccagcacacaccagctcgccggagatcacaagaagatacaagaccgtgctcctcgacgccgcccgacatggcggacgccgcctctggccgcggccacgtcgtctaccctccccgctccgccgaggacatcttcaaggactaccgcgcccgccggtccgccatcctccgcgccctcactcacgaggtcgaggacttctacgcgcagtgcgatccacacaaggagaacctgtgcctgtacggctacacgaacgaggcgtggaaggtggcgctgccggcagaggaggtgcccacggagctgccggagcctgcgctgggaatcaacttcgcgcgcgacggaatgaaccgccgcgactggnttgcgctcgtcgccgtccactccgactcgtggctcctctccgtcgccttttactatgccgctcggcttaatcgtaatgaccgtgagcgcttatttggtatgattaatgaattgcaacgtgtttttgaagttgtctccggtgcgaacaacaacatcctaaggagaggggcagtatgggacaatggtggtacagccaggcctgtaag

SEQ ID NO: 13988 - protein, 164 aa, Zea mays
  misc_feature: Ceres CLONE 1375172-F
  misc_feature (97)..(97): Xaa is any aa, unknown, or other
MADAASGRGHVVYPPRSAEDIFKDYRARRSAILRALTHEVEDFYAQCDPHKENLCLYGYTNEAWKVALPAEEVPTELPEPALGINFARDGMNRRDWXALVAVHSDSWLLSVAFYYAARLNRNDRERLFGMINELQRVFEVVSGANNNILRRGAVWDNGGTARPV

SEQ ID NO: 13989 - DNA, 898 bp, Zea mays
  misc_feature: Ceres CLONE 1375174-F
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
tttttcccttttttttttttnnnancccccacccgacccggccccnntnccaaagctggggctccccgcggtggcggccgctctagaactagtggatcccccgggctgcaggaattcgcacgagaccattacctagaacatcctaatcgaaatttttttccccggtctgctctgcgcgcccctctcctccctagtccctccccctacccccgcccgtcaaagcgagagcgccgtatcacctgtctctgcgtccaccggcgactcgatccgcgcccaaagatacctttcccccaccccttcctcgcgacggccgttttgggggggaccatgacgggggaggggggaggccaagaaaccccgtcggccgggtggcgggcaggtggaaaacccccctggcaccaaccaggttggggcgccggcggccaggtcgccggcaccaagggggggaagggggggcccagtggaagccttgccagaccggaggggaaccgcggcacaaagacgcacggcccccggcccaaaaacagcgacacccaaaaagtgggggacagggcggggcgcgcccgtgtgtaaacaatcgacttcccgcccgccccttgggataaaaagagatagggaccccgcggggggaagagaatatcccgggaagaaacccttgccccccggcccacgtccccccccccgcagacaggcgtgcttgtcaacccgcccgcccgcccgagtggtaaaaaaacgcaaaagcgcggcggggggtgaaccgcccacccccgtctggggagtgtggggcaccgcccagtcgcgccctactccacggcgccctcggccacgccgcaggggcgcggcaccacccgcggcgtgtgcacaacgggagcggggcggtccccaccaaaagcctgcc

SEQ ID NO: 13990 - DNA, 669 bp, Zea mays
  misc_feature: Ceres CLONE 1375177-F
  misc_feature: Translation starting site: 217
  misc_feature (574)..(574): n is a, c, t, g, unknown, or other
tggagctccccgcggtggcggccgctctagaactagtggatcccccgggctgcaggaattcgcacgagaccattacctagaacatcctaatcgaaaaagcacaagaacactcctagctagctgaagatctcgagtgcaacgcaacgttggcgcttggcggccagtagtagcagctaatttagcgtcgctccttcctagacgagagatcgagaaaccatggccaagctccaagtcactcctggcgccgcgttcaccgagtgcaatgaactcaacttccagggcctgtacctgtaccacacgcccctgggccccaaggccaaccaagctgcgatcgtagagagcaaggccaagatcggcatcggtgccaccgtggttaacaactgggcagtgtatgacgggccagggccaggcgctaagctcgtcggccgtgcgcaggggcttgcacatcctagccggcaactgggtcaactcattcaccctgggtgtcgaggatgaaaggttcagtgggtccacgcttgaagtgaggggcataacggttgaaactggcgagtgggctggtgttgggggcaccggncaggttgctatggcgaacggcatccatctccagaagttccacgagcagagaagcgacggggacgtcatagagcttagtgtcatgcattctgcccg

SEQ ID NO: 13991 - DNA, 664 bp, Zea mays
  misc_feature: Ceres CLONE 1375185-F
  misc_feature: Encodes the peptide sequence at SEQ ID NO. 13992
  misc_feature (619)..(619): n is a, c, t, g, unknown, or other
  misc_feature (638)..(638): n is a, c, t, g, unknown, or other
  misc_feature (639)..(639): n is a, c, t, g, unknown, or other
tggagctccccgcggtggcggccgctctagaactagtggatcccccgggctgcaggaattcgcacgagaccattacctagaacatcctaatcgaaaagaagcttggctttgtgaagcaggttgctaagaggaacccttgggtaggggagaagctcttcggttttgtcctgcagagggccgaaaacacgaaggcgcagtatcggagaaaccagctgctggagttggcagagttcatactgaaatcatgggccgatggcacgccagagatgttcttgaaccatctgtctcagctgtgcgggttgatacaagcagccctttcagccgttgccgaaaacaagtcgcgccgcaaggaagtgcgcaacttctgcactgggatcctgcagacggtgctgaagcttggtctcaaagaccagttccagaacgcgttgagtccctgaaacttatttccctctggcgagggccaagttagggggttgggggttttcccgccctttaaaaaaagggggtatgggggggggcacccccggtaaaatttttttttcccccccagaggggggggggcttttgggggggtttttttaaaaaaaaaaaaaaaggggggcgcccccccccccccccntgttggggggggggggggnngggggggggaaaaaaaaaaaaaaaa

SEQ ID NO: 13992 - protein, 56 aa, Zea mays
  misc_feature: Ceres CLONE 1375185-F
MFLNHLSQLCGLIQAALSAVAENKSRRKEVRNFCTGILQTVLKLGLKDQFQNALSP

SEQ ID NO: 13993 - DNA, 646 bp, Zea mays
  misc_feature: Ceres CLONE 1375187-F
  misc_feature: Encodes the peptide sequence at SEQ ID NO. 13994
  misc_feature (433)..(433): n is a, c, t, g, unknown, or other
  misc_feature (476)..(476): n is a, c, t, g, unknown, or other
aaagctggagctccccgcggtggcggccgctctagaactagtggatcccccgggctgcaggaattcgcacgagaccattacctagaacatcctaatcgaaaaactcactcactccccccattcctacctttcttctcctccacctcgtcaggcaccctcaaaccctcgccgcaagaaagaagaggtcaatcaaatcgaaccaaaacctcccgaccccacaaggccaagctcatttccatggtggtgtacacgcaggaacatgtgtaccggcacccgtgggaccgggtgacagcggcggcgtggcgcaagttcacggatccggcctcctgtacggcgctctcccacgtcgcagacgttcacaccctacaccgccgcctcgactccgacacgggccgcctccaggccgcgcgctccatcaccgtgcggtccccgnccgctccttttcgtctggcgcgactcctccccgtccgcgcggngtcccaaaacggcgcgcgctctggcactgcgtcaagacctcgctcgtggacgccccaggcccgggcatggacgtcgtcgtgcgcaacgtcagcctccgggggctcatcgagggcagagagggggcctcctacagaccaaattcggaacgggcccgaggattggacccaat

SEQ ID NO: 13994 - protein, 136 aa, Zea mays
  misc_feature: Ceres CLONE 1375187-F
  misc_feature (66)..(66): Xaa is any aa, unknown, or other
  misc_feature (80)..(80): Xaa is any aa, unknown, or other
MVVYTQEHVYRHPWDRVTAAAWRKFTDPASCTALSHVADVHTLHRRLDSDTGRLQAARSITVRSPXAPFRLARLLPVRAXSQNGARSGTASRPRSWTPQARAWTSSCATSASGGSSRAERGPPTDQIRNGPEDWTQ

SEQ ID NO: 13995 - DNA, 692 bp, Zea mays
  misc_feature: Ceres CLONE 1375190-F
  misc_feature: Encodes the peptide sequence at SEQ ID NO. 13996
  misc_feature (361)..(361): n is a, c, t, g, unknown, or other
  misc_feature (395)..(395): n is a, c, t, g, unknown, or other
  misc_feature (418)..(418): n is a, c, t, g, unknown, or other
aagctggagctccccgcggtggcggccgctctagaactagtggatcccccgggctgcaggaattcgcacgagaccattacctagaacatcctaatcgaaaaaatcccagatccacccctccccatctccatccgcggccatggcctccgccgacgccggcacttgcccgtgggatgccctcccgttgcacctccaggagcgaatcctctccctcctccccatcaccgaactacttcccgttgccgccgtgtcccgcgccttccaccgccttctgcgctccccgaccttccatgccctcctctccccgcatcgactcgacgccttcttcctcctttcccacgggtcgccgtccacccgctgntccgccgcgtccgcactatgcccgcgttcagcgngctctctcctcattcctaccggntcgtctcctccccgtcccatcactcctaatcactgcgcctcactccagtgctcccggcgatccccgacgaggctacctcctatcggtatcgtccatcgggggggtcctccacctctggaaccctggcgcggtaataccggggaagccgggggtcttaaacgtggaaccgggggtcccctcccccggggggggttaaagggggatccccggtgttccccacccccgggaaaaacccggggtcccggggccccaaaaaaactttcccccccggggg

SEQ ID NO: 13996 - protein, 184 aa, Zea mays
  misc_feature: Ceres CLONE 1375190-F
  misc_feature (9)..(56): Pfam Name: F-box Pfam Description: F-box domain
  misc_feature (74)..(74): Xaa is any aa, unknown, or other
  misc_feature (86)..(86): Xaa is any aa, unknown, or other
MASADAGTCPWDALPLHLQERILSLLPITELLPVAAVSRAFHRLLRSPTFHALLSPHRLDAFFLLSHGSPSTRXSAASALCPRSAXSLLIPTGSSPPRPITPNHCASLQCSRRSPTRLPPIGIVHRGGPPPLEPWRGNTGEAGGLKRGTGGPLPRGGLKGDPRCSPPPGKTRGPGAPKKLSPPG

SEQ ID NO: 13997 - DNA, 665 bp, Zea mays
  misc_feature: Ceres CLONE 1375192-F
  misc_feature: Encodes the peptide sequence at SEQ ID NO. 13998
  misc_feature (390)..(390): n is a, c, t, g, unknown, or other
  misc_feature (462)..(462): n is a, c, t, g, unknown, or other
  misc_feature (477)..(477): n is a, c, t, g, unknown, or other
  misc_feature (631)..(631): n is a, c, t, g, unknown, or other
aagctggagctccccgcggtggcggccgctctagaactagtggatcccccgggctgcaggaattcgcacgagaccattacctagaacatcctaatcgaacttcccgtgtttctaactccggtggctccaccaccagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaggctctgcacaagaacctagctngcagagaattgctataccaacaccagcataacaaaaggatgagctgccctgccatggcacagctcctctccnataccctgtactacnagcgcttctttcccatatacgccttcaatgtgctcggtgggcttgacagcgaggggaaagggtgtgttttcacctatgatgcagtaggttcctacgagagaactggttatagtgctcagggaactggatctacttttgatatgccagtcctggnacatcactaaaatcaccaagtcctctattgctcc

SEQ ID NO: 13998 - protein, 156 aa, Zea mays
  misc_feature: Ceres CLONE 1375192-F
  misc_feature (10)..(157): Pfam Name: Proteasome Pfam Description: Proteasome A-type and B-type
  misc_feature: SWISSPROT Homolog: EC 3.4.25.1 Proteasome endopeptidase complex
  misc_feature (74)..(74): Xaa is any aa, unknown, or other
  misc_feature (98)..(98): Xaa is any aa, unknown, or other
  misc_feature (103)..(103): Xaa is any aa, unknown, or other
  misc_feature (154)..(154): Xaa is any aa, unknown, or other
MSRRGDWVYENNGGTCVAIAGADYCVVAADTRLSVGYSILTRDHSKICDLADKCVLASSGFQGDIKALHKNLAXRELLYQHQHNKRMSCPAMAQLLSXTLYYXRFFPIYAFNVLGGLDSEGKGCVFTYDAVGSYERTGYSAQGTGSTFDMPVLXHH

SEQ ID NO: 13999 - DNA, 713 bp, Zea mays
  misc_feature: Ceres CLONE 1375194-F
  misc_feature: Translation starting site: 253
  misc_feature (573)..(573): n is a, c, t, g, unknown, or other
  misc_feature (678)..(678): n is a, c, t, g, unknown, or other
tccccgcggtggcggccgctctagaactagtggatcccccgggctgcaggaattcgcacgagaccattacctagaacatcctaatcgaaaaagtgcccttctgtctcctatctccccggagtccccgctgcccagcccggtctcactttccagtctccgagactccgagtctcgctcgcaccccgtcccctgcagcctgtgctctgggttggagggaggtgagctgcgagggagcgcggagggggcgaggagatggaggcagattcggcgaggaagagacttgcattgctggccctgcttctcctggcggcgcccgtccgcccggcctcggcggctccggtggaggatggcctgctcagcaatggtgactttgagacagcaccaagtggtggttttgtaaaatctgcttctgttgctgagggtgcatcgtcaaatccctgggttggacgatcaacggcacggttgaactcatttcagcaggccaacaccagggtggcatgatcctgattgttccacagggggaccatgcagtaaggctagggaatgatgctagcgttgggcaggtggtgacgnttgagaaaggttcggagtatgctatcacattcagtgctgcccggacatgtgcacaactggaggcctggaatggttccgtgctaaggggcgtgtctcagacagagnacttgcagacgttgtacacatagaagggctggaag

SEQ ID NO: 14000 - DNA, 614 bp, Zea mays
  misc_feature: Ceres CLONE 1375195-F
  misc_feature: Encodes the peptide sequence at SEQ ID NO. 14001
  misc_feature (369)..(369): n is a, c, t, g, unknown, or other
tggagctccccgcggtggcggccgctctagaactagtggatcccccgggctgcaggaattcgcacgagaccattacctagaacatcctaatcgaaaaaagagatcgaggctcctatctggtataggacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccacggtcctcgtctacnacgccaccgggggcaggctgagcctggtgaccacggaaagatggatggctcggctacggtcgcgatccggaaaccttcacaggggaggggatcgcttcctcccgtcagcccggttcgtgggcaaggaaacagccccccgggggttcccgggaggaactccaatgccggaaccggaacttcccccgccggggaaatccccggggaaaactttccggcccggtttaccttggattgggggggaaaac

SEQ ID NO: 14001 - protein, 150 aa, Zea mays
  misc_feature: Ceres CLONE 1375195-F
  misc_feature (69)..(69): Xaa is any aa, unknown, or other
MSPFGAVITPETLKYMSKYQGREITQVDCAREAMRLIHAEDKNLKAEDSAWELKKKFGNGVSTTVLVYXATGGRLSLVTTERWMARLRSRSGNLHRGGDRFLPSARFVGKETAPRGFPGGTPMPEPELPPPGKSPGKTFRPGLPWIGGEN

SEQ ID NO: 14002 - DNA, 730 bp, Zea mays
  misc_feature: Ceres CLONE 1375197-F
  misc_feature: Translation starting site: 254
  misc_feature: Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature (423)..(423): n is a, c, t, g, unknown, or other
tccccgcggtggcggccgctctagaactagtggatcccccgggctgcaggaattcgcacgagaccattacctagaacatcctaatcgaaaaagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtgggccaaccatggccgtcattgccctcaagtgcccagacattgaggtcgtcgtcgttgacatctcccagccccgcatgtgagggctggaacagtgacaccctggccatctacgaggctggtctcgatgatngtgtggagcagtgcaggggcaagaaactccttcttcagcactgatggtgagagccacgtcgctgaggctgacattatctttgtctcggtgaacacccccacaagacccgtgggcttggagctggcaggctgccgacctcactactggaaaagccctcccgcatgattgcggatgctcccaatctgacaaaatggttttaaaagccccctggcctggcaagacggtgggtttttggaagaattttgccccaagggggggggtaataacaaacctttccaccaaaatcttgggggggactccttgggga

SEQ ID NO: 14003 - DNA, 708 bp, Zea mays
  misc_feature: Ceres CLONE 1375203-F
  misc_feature: SWISSPROT Homolog: EC 2.7.2.3 Phosphoglycerate kinase
  misc_feature (521)..(521): n is a, c, t, g, unknown, or other
tccccgcggggggggccgctctagaactaggggatcccccgggctgcaggaattcgcacgagaccattacctagaacatcctaatcgaaaagttgctggcttcctcatgcagaaggaacttgactaccttgttggagctgttgccaacccaaagaagccatttgccgttattgttggtggatccaaggtctcaagtaagattggtgtcattgaggcgttgctggcgaaggtcaatatcctcatccttggtgctgcgtatgatctacacatttctacaaggcacaaggatattctgttgcaaaatctctcgaggaagaggataaacttgagctcgcaacttctcttattgagaaggcgaacgcaaaggaggtttctcttttgcttcccactgatattgtagtagcggacaagtttgcagccgatgctgagagcaagattgtccctgccactgctatccctgatgactggatgggtcttgatgttgagccctgatgccacgaagaccttcaacgaagcattgnacaccaccaagactgttatttggaacgcccccatgggaggtgttgagttcgagaagtttgcagctggaactgtagcgattgccaagaagctagctgagcttacagccacgaggggtgtcactaccatcattcgcgggagaggactctgtcgctgctgtcgagcaggctggactgttggactagataa

SEQ ID NO: 14004 - DNA, 685 bp, Zea mays
  misc_feature: Ceres CLONE 1375204-F
  misc_feature: Encodes the peptide sequence at SEQ ID NO. 14005
  misc_feature (413)..(413): n is a, c, t, g, unknown, or other
tggagctccccgcggtggcggccgctctagaactagtggatcccccgggctgcaggaattcgcacgagaccattacctagaacatcctaatcgaaaaatcatcatccaatccagatcatcatagcggcagtgcgtaaagaggatcgtcgaacagaacagcatgaagatggacatcgctctcggcgtgtgcctgggtctgacagctgccagcgcctctgcaatgcagatgccctgcccctgcgcggtgctgcacggcttgtacggcgctggcgccggactgacgaccatgatgggcgccggaggactgtacccctacgcggagcacctgaggcagacttagtgcagcccgctggcggcgtcgccctactacgccgggtgtgggcagacgatcgccatgtaccagccgctccggnaacagtgctgcctgcagcaatgatggatgatggacgtgtactccgtcgcgcaccagctgcagatgatgatgcagcttgagcgtgccgctgccgccagcatcaccctgtacgagccagctctgatgcaccagcagcagcagctgctggcacaccagggtctcatccccatgggcatgatgatggcgccagacatgcccggcatgggtggactctaccagtaccagtccagctgcgcagctaccgcacaaacccctggggcgtctcccctggca

SEQ ID NO: 14005 - protein, 59 aa, Zea mays
  misc_feature: Ceres CLONE 1375204-F
MKMDIALGVCLGLTAASASAMQMPCPCAVLHGLYGAGAGLTTMMGAGGLYPYAEHLRQT

SEQ ID NO: 14006 - DNA, 675 bp, Zea mays
  misc_feature: Ceres CLONE 1375208-F
gctctagaactagtggatcccccgggctgcaggaattcgcacgagaccattacctagaacatcctaatcgaaaaatctaccccgtcactttgtttgcaaagctcctcctcgatacaacgatcactgcaccgaccggcggcaccgagctagctggctctagccaacgacacggtatcaatgccgcaccgtgacacgcaacgaatctacggtggtactccacgctacctatcggcattcagacatcatctgggaggattctcacgaccaatgggagagcctgagaatgatatgcttcacgacagcgctgccaccgactctcaggctctcgaatgggagactctcctcactatgtctgggctgctgctgcagctgacatagactgagcctcaccggcatcgtgctgttactggcgattctactgcatggtactgatctatagcccaggatctgacagctgcattctcatggggacggccttttgcgatcccccctggagccccaggggctagtactctggcatcgctcacggcctcgcaatccgctccacatggaaccattaaccccggacaagcggaggagggaacccttttatgggaagggggccggttcccgggttccgaacaaggcctggggggccccccctccagtgccagccgaaaaaggcccgacccattg

SEQ ID NO: 14007 - DNA, 699 bp, Zea mays
  misc_feature: Ceres CLONE 1375209-F
  misc_feature: Encodes the peptide sequence at SEQ ID NO. 14008
  misc_feature (608)..(608): n is a, c, t, g, unknown, or other
  misc_feature (658)..(658): n is a, c, t, g, unknown, or other
tggagctccccgcggtggcggccgctctagaactagtggatcccccgggctgcaggaattcgcacgagaccattacctagaacatcctaatcgaaaaacacataaccagcacacagctctcgccttctctctcccatcggcacacccgagctcgctccctccttccacgtcgaggtccgagtcctgctttgatggcgaccgacgtggctgagactcccgcgccgttggtggatgcggccccagaggcgcccgccgacgccccggcggcgcctgctgccgacgcgaagccggccaaggccaagaaggccaccgcgccgaagaagcgcgccagcccgacccacccgccgtacgccgagatggtctcggaggcgatcacgtcgctcaaggagaggacggggtccagcagctatgcgattgccaagttcgtggaggacaagcacaaggacaagctcccgcccaacttccgcaagcttctgaacgttcagctcaagaagctcgtcgccggcggcaagctgaccaaggtgaagaactcgtacaagctgtcgtccgccgccaccaagccgaatcccaagcccaaggccgccccgaagaaagcccagaccggcgcntagaggcccaaggccgctgccaagaccaaagctaagacccccggcaaggncgagcccccgcacaagcccaagccccgcgcgaagccgaaag

SEQ ID NO: 14008 - protein, 139 aa, Zea mays
  misc_feature: Ceres CLONE 1375209-F
  misc_feature (49)..(119): Pfam Name: Linker_histone Pfam Description: linker histone H1 and H5 family
MATDVAETPAPLVDAAPEAPADAPAAPAADAKPAKAKKATAPKKRASPTHPPYAEMVSEAITSLKERTGSSSYAIAKFVEDKHKDKLPPNFRKLLNVQLKKLVAGGKLTKVKNSYKLSSAATKPNPKPKAAPKKAQTGA

SEQ ID NO: 14009 - DNA, 720 bp, Zea mays
  misc_feature: Ceres CLONE 1375210-F
  misc_feature: Encodes the peptide sequence at SEQ ID NO. 14010
  misc_feature (665)..(665): n is a, c, t, g, unknown, or other
tccccgcggtggcggccgctctagaactagtggatcccccgggctgcaggaattcgcacgagaccattacctagaacatcctaatcgaaaaatacctcctcaaggcacgttcaccacagtcctctctttccccggcaccaccaccaccacccaggctaacaggactggaccgagtgtggaacaagactgcagtgagcgacgggagacatggtgcagtcgtgaaaatttgcacctggtgctgaacccggcgcctctgggcgcgtcttggtccgacccgtccgccgcagagatcccgccgcagctcctcgacgcgttgagagagtacctctccatcgcccgaggcaacttacagacatcaggccttggtcgagcacatgacgcacgacctattagagcagttacctttgcgccatttgatgccacacagcatcgggggacaacaactacaacagcttgagctagcaaaccttgctgcatactctcagcaacatcagtttcttccattcaaccaactggctgcattgaactctgctgcttatttgcaacaacaattaccattcagccaggtagttgctgcctacccccagctactgcttccaatcaaccaactagcagcattgaactctgctgcttatttacaggagccacaactactaccattcagncagctagctgatgggagccctgctgccttcctgacacaacacaggtgctgccggt

SEQ ID NO: 14010 - protein, 115 aa, Zea mays
  misc_feature: Ceres CLONE 1375210-F
  misc_feature (97)..(97): Xaa is any aa, unknown, or other
MTHDLLEQLPLRHLMPHSIGGQQLQQLELANLAAYSQQHQFLPFNQLAALNSAAYLQQQLPFSQVVAAYPQLLLPINQLAALNSAAYLQEPQLLPFXQLADGSPAAFLTQHRCCR

SEQ ID NO: 14011 - DNA, 679 bp, Zea mays
  misc_feature: Ceres CLONE 1375211-F
  misc_feature: Encodes the peptide sequence at SEQ ID NO. 14012
  misc_feature (280)..(280): n is a, c, t, g, unknown, or other
  misc_feature (337)..(337): n is a, c, t, g, unknown, or other
  misc_feature (362)..(362): n is a, c, t, g, unknown, or other
ggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggncgcccgatgggtgagcaggtgaagggcatgctccacgacaaggggccgacggcgtcncaggcgctgacggtggtgacgctgntcccgctgggcggcctgctgctggtgctgtcggggctggcgctgacggcctcggggtggggctgcccgggccacgccgggggtcctgatcttcagcccgtggtcgtccccgcggcgtggtcatcggaaaggcggaagggggtccctcccgccgggcgggttggggtccgggggccggccccccttcaggggcctgcccaaaaggggggggagggggttccaggcccccccggaaataggggggggggcgccccccaaaggggggggagggccgggggacaccggcccaaaaaaacccccgggggggggccggccccc

SEQ ID NO: 14012 - protein, 160 aa, Zea mays
  misc_feature: Ceres CLONE 1375211-F
  misc_feature (55)..(55): Xaa is any aa, unknown, or other
MADRDRSGIYGGAHATYGQQQQQGGGGRPMGEQVKGMLHDKGPTASQALTVVTLXPLGGLLLVLSGLALTASGWGCPGHAGGPDLQPVVVPAAWSSERRKGVPPAGRVGVRGPAPLQGPAQKGGEGVPGPPGNRGGGAPQRGGRAGGHRPKKTPGGGPAP

SEQ ID NO: 14013 - DNA, 670 bp, Zea mays
  misc_feature: Ceres CLONE 1375212-F
  misc_feature: Encodes the peptide sequence at SEQ ID NO. 14014
ggagctccccgcggtggcggccgctctagaactagtggatcccccgggctgcaggaattcgcacgagaccattacctagaacatcctaatcgaaaaattttttcttccccatcttggagaagaagaaggcccgacgccctcgccgctgccaccaaaatcgcacgcgagccccaaagatccccaaaccctacacccgcccgccggcgcactcggggaccgtcgaatcgagcaggttgacggaggagaggaagcctcgaagatgttccggaaccagtacgacaccgacgtgacgacatggagcccccaggggcggctgttccaggtggagtacgccatggaggccgtcaagcagggctcagcctgcgtcgggctgcggtcagcactcacgccgtcctcgccggcgtcaacagcccgcctccgaggtctcctcctaccagggggagggggttcggcgtcgctgaccaccgcgggggtcgcgctcgccggcctcaccggccgaggggcgggttctctccggccttcctccggaaacagggggatcaaccaactccttcggctaagaaggggccggttcccggtttcccgggttcggggtcaaggttccccgaaaagggggcaggtttgcacccaggggccttgggaaaagggccctaaggggggtggcccccca

SEQ ID NO: 14014 - protein, 137 aa, Zea mays
  misc_feature: Ceres CLONE 1375212-F
  misc_feature: SWISSPROT Homolog: EC 3.4.25.1 Proteasome endopeptidase complex
MFRNQYDTDVTTWSPQGRLFQVEYAMEAVKQGSACVGLRSALTPSSPASTARLRGLLLPGGGGSASLTTAGVALAGLTGRGAGSLRPSSGNRGINQLLRLRRGRFPVSRVRGQGSPKRGQVCTQGPWEKGPKGGGPP

SEQ ID NO: 14015 - DNA, 695 bp, Zea mays
  misc_feature: Ceres CLONE 1375213-F
  misc_feature: Encodes the peptide sequence at SEQ ID NO. 14016
  misc_feature (363)..(363): n is a, c, t, g, unknown, or other
ggagctccccgcggtggcggccgctctagaactagtggatcccccgggctgcaggaattcgcacgagaccattacctagaacatcctaatcgaaaaaccgctgctccacacgggcacacctttgcctcgcccaaccgctgcctcgctcgcgtccgccattccccagacctcgagagctaccgtctggtccgatcggacggaccccttcgcgcgccccagagatttcaggtaaggtgctgtaacagaagatgcaagggggaagaggtgggaggcagggcttattcggtttcggggacccttctggtggttccggtggctttggacaaccagggagccttatgcctggtttttttggtggcgcanatccctttgacgaccctttcttcacaaacccctttggtagcatgatgcagactagtttctcagcccctttcagcggcatgatgcaacctagcttcatgaaccccttcggcagcatggtgcaacctagcttgcttggaccaagtatgtttgcgccccatgggcaatctcatgggaggcatggttggaaagcagacacatctcagtcaagggatcagcaatgggcagggggtttcatttcagcagggcccctggaaccaaggggggctaaaggggccatttttcaggggggtttctttcagagggggggggggtgtgtgtaaaattatgagtaa

SEQ ID NO: 14016 - protein, 144 aa, Zea mays
  misc_feature: Ceres CLONE 1375213-F
  misc_feature (39)..(39): Xaa is any aa, unknown, or other
MQGGRGGRQGLFGFGDPSGGSGGFGQPGSLMPGFFGGAXPFDDPFFTNPFGSMMQTSFSAPFSGMMQPSFMNPFGSMVQPSLLGPSMFAPHGQSHGRHGWKADTSQSRDQQWAGGFISAGPLEPRGAKGAIFQGGFFQRGGGCV

SEQ ID NO: 14017 - DNA, 647 bp, Zea mays
  misc_feature: Ceres CLONE 1375222-F
  misc_feature: Encodes the peptide sequence at SEQ ID NO. 14018
aagctggagctccccgcggtggcggccgctctagaactagtggatcccccgggctgcaggaattcgcacgagaccattacctagaacatcctaatcgaaaaatcagtagtaaccactcctcgtcgtctctctcgcggtctcgcctcctgcagctagcgctcgccagaaagggaaaccgcatctgctccagcctcccgtcccgtctcggcgccgccgcctgatcgaccagagcccagcgcggggcgtcgaggccgtccggggcgggtccggcgctcagatctgaggcgagtagcaagcgaagaacatgcagatgcaggtcggaggaggcgcggccgacagcccgggcgctgcggcggcggcgggcgcggaggcgccgcgcccgagccgctacgagtcacagaagcggcgccactgtcacacgttcgggtagtaactgcgcaacccccggccgccgttggagctgtcgcgatgcagcgcatcgcacgtgctaaagttgctgtgttacctctagcagctccggaagagcaaggtccccgcgacggtggaggcccttgctggtgcaatcgaatgctgcccgtgccttggccctgctgcgttgttggaagacctgcggtctgtcctgaacggcgtttttcgaacatcccgag

SEQ ID NO: 14018 - protein, 39 aa, Zea mays
  misc_feature: Ceres CLONE 1375222-F
MQVGGGAADSPGAAAAAGAEAPRPSRYESQKRRHCHTFG

SEQ ID NO: 14019 - DNA, 588 bp, Zea mays
  misc_feature: Ceres CLONE 1375225-F
  misc_feature: Encodes the peptide sequence at SEQ ID NO. 14020
  misc_feature (296)..(296): n is a, c, t, g, unknown, or other
  misc_feature (305)..(305): n is a, c, t, g, unknown, or other
  misc_feature (495)..(495): n is a, c, t, g, unknown, or other
  misc_feature (509)..(509): n is a, c, t, g, unknown, or other
  misc_feature (526)..(526): n is a, c, t, g, unknown, or other
  misc_feature (566)..(566): n is a, c, t, g, unknown, or other
  misc_feature (569)..(569): n is a, c, t, g, unknown, or other
aaactggagctccccgcggtggcggccgctctagaactagtggatcccccgggctgcaggaattcgcacgagaccattacctagaacatcctaatcgaaaagttccgtgtccgcgtccagtgtgtccgctccccctcagtcctagcggtagcgtgcgcgcgggagacgtagatggcggcttcggcggcggcggcggcggcggcggcgacaccggtggcgccgacagaggggacggtgatcgcgatccacagcctggaggagtggagcatccagatcgaggtgacctacacgctccnggtgcgccnggcaaggaggtggcgtccggcaccatgccggaccccggctggatcgccgccagcggctccaccgcgctggagatccccgccaaggtgccctacgacttcctcgtctccctcgtcagggacgtcggccgggactgggacatcgactacgagctccaggtcggactcaccgtcgacctccccatcgtcgggnatttcaccatcccngctctccacctccgggngagttcagctccccaccctcaggacttggtctgatctagnagnagctcgcttgccttctgtt

SEQ ID NO: 14020 - protein, 185 aa, Zea mays
  misc_feature: Ceres CLONE 1375225-F
  misc_feature (16)..(185): Pfam Name: LEA_2 Pfam Description: Late embryogenesis abundant protein
  misc_feature (165)..(165): Xaa is any aa, unknown, or other
  misc_feature (175)..(175): Xaa is any aa, unknown, or other
TGAPRGGGRSRTSGSPGLQEFARDHYLEHPNRKVPCPRPVCPLPLSPSGSVRAGDVDGGFGGGGGGGGDTGGADRGDGDRDPQPGGVEHPDRGDLHAPGAPGKEVASGTMPDPGWIAASGSTALEIPAKVPYDFLVSLVRDVGRDWDIDYELQVGLTVDLPIVGXFTIPALHLRXSSAPHPQDLV

SEQ ID NO: 14021 - DNA, 779 bp, Zea mays
  misc_feature: Ceres CLONE 1375225-R
  misc_feature (1)..(1): n is a, c, t, g, unknown, or other
  misc_feature (2)..(2): n is a, c, t, g, unknown, or other
nnaaataatcggctcttttttattaaccatccatccccttagcttaggcattcactgagatatatagaacagaggagctgcgtcgtttatttgcaaaagctcgtcgtacagatcgctggtgcgcgcccgcacagaacagaaggcaagcgagctactactagatcagaacaagtccttgagggtggggagcttgaactcgccggaggtggagagcgggatggtgaagttgccgacgatggggaggtcgacggtgagtccgacctggagctcgtagtcgatgtcccagtcccggccgacgtccctgacgagggagacgaggaagtcgtagggcaccttggcggggatctccagcgcggtggagccgctggcggcgatccagccggggtccggcatggtgccggacgccacctccttgccggcgcaccggagcgtgtaggtcacctcgatctggatgctccactcctccaggctgtggatcgcgatcaccgtcccctctgtcggcgccaccggtgtcgccgccgccgccgccgccgccgccgaagccgccatctacgtctcccgcgcgcacgctaccgctaggactgagggggagcggacacactggacgcggacacggaacttttcgattaggatgttctaggtaatggtctcgtgcgaattcctgcagcccgggggatccactagttctagagcggccgccaccgcggtggagctccagcttttgttccctttagtgaggggtaattgcgcgcttggcgtaatcatggtcatagctgtta

SEQ ID NO: 14022 - DNA, 622 bp, Zea mays
  misc_feature: Ceres CLONE 1375240-F
  misc_feature: Encodes the peptide sequence at SEQ ID NO. 14023
  misc_feature (204)..(204): n is a, c, t, g, unknown, or other
  misc_feature (205)..(205): n is a, c, t, g, unknown, or other
  misc_feature (214)..(214): n is a, c, t, g, unknown, or other
  misc_feature (215)..(215): n is a, c, t, g, unknown, or other
  misc_feature (227)..(227): n is a, c, t, g, unknown, or other
  misc_feature (233)..(233): n is a, c, t, g, unknown, or other
  misc_feature (258)..(258): n is a, c, t, g, unknown, or other
  misc_feature (259)..(259): n is a, c, t, g, unknown, or other
  misc_feature (273)..(273): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (293)..(293): n is a, c, t, g, unknown, or other
  misc_feature (294)..(294): n is a, c, t, g, unknown, or other
  misc_feature (297)..(297): n is a, c, t, g, unknown, or other
ggagctccccgcggtggcggccgctctagaactagtggatcccccgggctgcaggaattcgcacgagaccattacctagaacatcctaacgaaaaaatcaattctccagaccctccccggcaaccgcgtccggccgtccgcttccgtctccttggataaccacgacgcccgccggcaagcgaaagcgaagcgagccaaccccanngccatgggnnagaaaggggcgnaatcgnaaaatcggcagcgggtcctcctggnngacctctccctccntctcgnnncgctctcggagnntantttggggggtcggtgggcgcgcccgggaaacaccccccccaaacacaagagggctcccccccccttttcggggaaaaaaaacaccccgcccccccccgccacaaggggggcccaattttggggggcccccggggggggggttttttttttgggcccccccccccccccggggagggcccccccccgacggggggggggtgttttttaaaaaggggtttttggtttggagggaaacaaaaaaaaaaaaaacccacccctcgtggggggggggggggggccccccttccggggggggggaggggttttttctttttttttttccctt

SEQ ID NO: 14023 - protein, 98 aa, Zea mays
  misc_feature: Ceres CLONE 1375240-F
  misc_feature (3)..(3): Xaa is any aa, unknown, or other
  misc_feature (7)..(7): Xaa is any aa, unknown, or other
  misc_feature (9)..(9): Xaa is any aa, unknown, or other
  misc_feature (17)..(17): Xaa is any aa, unknown, or other
  misc_feature (22)..(22): Xaa is any aa, unknown, or other
  misc_feature (24)..(24): Xaa is any aa, unknown, or other
  misc_feature (25)..(25): Xaa is any aa, unknown, or other
  misc_feature (29)..(29): Xaa is any aa, unknown, or other
  misc_feature (30)..(30): Xaa is any aa, unknown, or other
MGXKGAXSXNRQRVLLXDLSLXLXXLSEXXLGGRWARPGNTPPKHKRAPPPFSGKKNTPPPPATRGAQFWGAPGGGVFFLGPPPPPGRAPPRRGGGVF

SEQ ID NO: 14024 - DNA, 645 bp, Zea mays
  misc_feature: Ceres CLONE 1375241-F
  misc_feature: Encodes the peptide sequence at SEQ ID NO. 14025
tggagctccccgcggtggcggccgctctagaactagtggatcccccgggctgcaggaattcgcacgagaccattacctagaacatcctaatcgaaaaactcctcatcgccacaagtgaagtcaccgacgcacgcacggctgcagcgcgctcctactctcccgcgaccgccaccggggaggggcaatagaatatagcgaggacagccaatgcaggccgccgtcaacaccaccactgtcggcgctcacccgcacccaacaaagtcctcgttcctccgtccatcccctccttgccgcgtctacttccacgcttctccacgcccgaaccatagggcgatcgccatggccagcaagtcgcagctgcaggagcaactgatcatcactcgccccaacgactggcacctccatcttcgcgaaggcggtgtcctcgaggctgtagtgccacacagcgcgaggcattttgggagggccatcatcatgcccaacctgaagccgccggtgaccacaacggcgcgggccatggagtacagggaggagataatgagggcgctgccgccagggagtagcttcgagccgctcatgacactatacctcacagacaacacaagcccagaggagatcaagctcgcaagaaagagtggtataatc

SEQ ID NO: 14025 - protein, 102 aa, Zea mays
  misc_feature: Ceres CLONE 1375241-F
  misc_feature: SWISSPROT Homolog: EC 3.5.2.3 Dihydroorotase
MASKSQLQEQLIITRPNDWHLHLREGGVLEAVVPHSARHFGRAIIMPNLKPPVTTTARAMEYREEIMRALPPGSSFEPLMTLYLTDNTSPEEIKLARKSGII

SEQ ID NO: 14026 - DNA, 637 bp, Zea mays
  misc_feature: Ceres CLONE 1375242-F
  misc_feature: Encodes the peptide sequence at SEQ ID NO. 14027
  misc_feature (225)..(225): n is a, c, t, g, unknown, or other
  misc_feature (322)..(322): n is a, c, t, g, unknown, or other
  misc_feature (579)..(579): n is a, c, t, g, unknown, or other
  misc_feature (580)..(580): n is a, c, t, g, unknown, or other
  misc_feature (595)..(595): n is a, c, t, g, unknown, or other
  misc_feature (600)..(600): n is a, c, t, g, unknown, or other
ggagctccccgcggtggcggccgctctagaactagtggatcccccgggctgcaggaattcgcacgagaccattacctagaacatcctaatcgaaaaactgccgcatgagaagatagcagtatagcaccgcccgcttgcaatgaaccgcgcttcttggttgctccttgttctggtgcagcttctcttgcttgcacttgctactcagccacccaccatggcggcggncggaagcacggacgcccactaataaccgcgcccgccaacgtcgtcgtcggctccgttggcgtcgtccacttcggcagctccgaagctaccaccacgnccgtttctcaggtgcgcatgccactattggctgcttccaacgtggtggttactttgggccttccatgtgtgcctgctgcctccaaccgttacctagctaacacagtctcaggcaccctggtcgggtccgctgccacgacgggaacggcccggacgtgtccgagaaaaagcggttttttgtgagaacccaaacggaaaggttttcccgcgtgcaccttcgcgcacggggccaagcagcggcagcagcagagcaacagnntcccggtccgcagtncctgntttttggtggggggggggggccccccccccccccccc

SEQ ID NO: 14027 - protein, 54 aa, Zea mays
  misc_feature: Ceres CLONE 1375242-F
MPLLAASNVVVTLGLPCVPAASNRYLANTVSGTLVGSAATTGTARTCPRKSGFL

SEQ ID NO: 14028 - DNA, 677 bp, Zea mays
  misc_feature: Ceres CLONE 1375251-F
  misc_feature: Translation starting site: 146
  misc_feature (466)..(466): n is a, c, t, g, unknown, or other
  misc_feature (578)..(578): n is a, c, t, g, unknown, or other
  misc_feature (663)..(663): n is a, c, t, g, unknown, or other
tccccgcggtggcggccgctctagaactagtggatcccccgggctgcaggaattcgcacgagaccattacctagaacatcctaatcgaaaaatcctctcgctcgccaggagaagcagccgccgttgctgctgccgcgtccacagaatggggggtttcgtgaagacccataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatattggtcttgaagttggtctgaccaactatgcaactgcctactgcactggacttctgttggnctcgccgtgtgtaaaagaaatccgtggtttgggataaggagtatgagggccaatgttgaggccactgggtgagagactttctctgttgagccagtgaaatgagagaaggggncattccggttcctcctctttgggatggtgggccttatcaggactacacagggggaaccccggggggcttggtgccctcaaggagntttttgtttttgtg

SEQ ID NO: 14029 - DNA, 618 bp, Zea mays
  misc_feature: Ceres CLONE 1375258-F
  misc_feature (193)..(193): n is a, c, t, g, unknown, or other
  misc_feature (204)..(204): n is a, c, t, g, unknown, or other
tccccgcggtggcggccgctctagaactagtggatcccccgggctgcaggaattcgcacgagaccattacctagaacatcctaatcgaaaaacgtcgaccagtacgtcgaaaaggaacacgtcgcccccatttcccacccgctttctccccctttggcctccccccctctctctctctcatctcctggcgatnagaagcttcgncggcgtctcctccttttctcgtctagcaaaatcttcccgtattgaaaagcaaagaagaaaaaaaaacaaaggcaggaggccggcgaactacgcgaggaaaaatttccttccccggaggctcgggagtcggaacgccacaaggttttggcaaaaacctttccggtgtaaagcgggtgttgttgcccctttttttcggggcaacaaaaagggaacgaacaagtttggcacctcaaaaaaaaggggacggggagggagacccgggaaaaaaccccgaaacccccggaaaagacccccccgaaaaaaaggggggaaaccaaatctagaaaatgggactcggaaacctggatttccccccctgggcccccccaaaagggttataacggggggaattttcggcggcgtaaaaaaagggcc

SEQ ID NO: 14030 - DNA, 616 bp, Zea mays
  misc_feature: Ceres CLONE 1375261-F
  misc_feature: Translation starting site: 330
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (323)..(323): n is a, c, t, g, unknown, or other
  misc_feature (324)..(324): n is a, c, t, g, unknown, or other
  misc_feature (334)..(334): n is a, c, t, g, unknown, or other
  misc_feature (340)..(340): n is a, c, t, g, unknown, or other
  misc_feature (355)..(355): n is a, c, t, g, unknown, or other
  misc_feature (361)..(361): n is a, c, t, g, unknown, or other
  misc_feature (379)..(379): n is a, c, t, g, unknown, or other
  misc_feature (399)..(399): n is a, c, t, g, unknown, or other
  misc_feature (403)..(403): n is a, c, t, g, unknown, or other
  misc_feature (581)..(581): n is a, c, t, g, unknown, or other
ggagctccccgcggtggcggccgctctagaactagtggatcccccgggctgcaggaattcgcacgagaccattacctagaacatcctaatcgaaaaagagactcaccagtcaccaccccaggccagccgccacgtttagccgggctaaacaaacacgggcgcacaatcggaactcgctgcactgcttggaatccaacgagccaatcattcaaatcctccccggaaccgcgttgagcagggcacggtcgattggatctagggtgagggtccgtcgccgaagaaactcgcaggcggcacannnaaagccgcggnnngaaggccgnnggaagatggncctcgnaagagatgaacggcnacggangtgggctgcgctgctggnacttgaaagccgcaccgcgnaggncggcttctacacccgagaccttcccgcgacggctccatcacgcttcaccacgtcccagctcccgccccactacaaggtaaaaccgtgctgttagcaccgcaatctatttcctacttcccggcagggagtgtttcccgtctccaccgcattccctgtgctgaaacctggcacttctacnagggagagcctctcacggtcttcgagcttcacgaa

SEQ ID NO: 14031 - DNA, 664 bp, Zea mays
  misc_feature: Ceres CLONE 1375264-F
  misc_feature: Translation starting site: 189
  misc_feature: SWISSPROT Homolog: EC 1.2.1.12 Glyceraldehyde-3-phosphate dehydrogenase (phosphorylating)
  misc_feature (455)..(455): n is a, c, t, g, unknown, or other
  misc_feature (456)..(456): n is a, c, t, g, unknown, or other
  misc_feature (485)..(485): n is a, c, t, g, unknown, or other
tgaagctccccgcggtggcggccgctctagaactagtggatcccccgggctgcaggaattcgcacgagaccattacctagaacatcctaatcgaaaaatcacagatcacacacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgagagatcccatggnngttcggttggcgctgaatatgttgttgangtctactggtgttttcactgaccaggagaaggctgcagctcactttgaagggtgtgcccaagaaggttgtcatttctgctcctagcaagatgccccaatgtgtccctttgttgtgtcaaccgaaaaggagtacaagtctgacatcaacattgtctctaatgctagctgcacaccaactg

SEQ ID NO: 14032 - DNA, 542 bp, Zea mays
  misc_feature: Ceres CLONE 1375270-F
  misc_feature: Encodes the peptide sequence at SEQ ID NO. 14033
  misc_feature (371)..(371): n is a, c, t, g, unknown, or other
tccccgcggtggcggccgctctagaactagtggatcccccgggctgcaggaattcgcacgagaccattacctagaacatcctaatcgaaaagattatatcgaaaatctggacggcggcggactcgattgtagcagcagccgccgggaacaagatggcggcggcgttgtcgcagctggacgacgagatcgtccgcggcatggccatcggcgctgtcttcaccgactatgccgggaagataaactgcctcgatttccaccgcaaggaagatctcctcgtcacttccagcgaggacgactccatcgcatgtacacatcacagcgcgacgttgtaagactactatcacagaacatgtgctgacgggtctgtttancatcatccagtctatctatgctctcacgatacacctagagctgcagatcactcgtatctggcatgaatgacacccgtgctagaatactcaaggacccaaggacgggtcgttcccttatgatgcccccggcacggtagctttatgcccgggtaccttggtccaggggcagaa

SEQ ID NO: 14033 - protein, 59 aa, Zea mays
  misc_feature: Ceres CLONE 1375270-F
MAAALSQLDDEIVRGMAIGAVFTDYAGKINCLDFHRKEDLLVTSSEDDSIACTHHSATL

SEQ ID NO: 14034 - DNA, 605 bp, Zea mays
  misc_feature: Ceres CLONE 1375273-F
  misc_feature: Encodes the peptide sequence at SEQ ID NO. 14035
  misc_feature (169)..(169): n is a, c, t, g, unknown, or other
  misc_feature (253)..(253): n is a, c, t, g, unknown, or other
  misc_feature (271)..(271): n is a, c, t, g, unknown, or other
  misc_feature (397)..(397): n is a, c, t, g, unknown, or other
  misc_feature (467)..(467): n is a, c, t, g, unknown, or other
ggagctccccgcggtggcggccgctctagaactagtggatcccccgggctgcaggaattcgcacgagaccattacctagaacatcctaatcgaaaaaacactcccccgatctccgccactccaaaatgtggcgccgccaccacctcctccggctacttccacctccggncaccgccgccaccgccgcggccccttctcatttcctgcgccacctctctacctcaagcaccccgaccccgggcgcctccctggnctcgtccctcgcgtcggngctcaccgcgctctccacgaacccgccccccggcaccaccccggacgcttacttctccctccacttctccgacgtgcgggctaccaacgcgctcctcgctgaggggctcgcgctctccccgcccgncaccctcccgcgcgcttgcgatctcttccgcttcctcgtccgccgccgctcgctccacccctccgacggngcgctcgcgcccatcgttcgccacctcgcccgccgccgcgacttccccgccgtgcgcgcgctcatccaggagtttccaaccgctctcgggcccgccacgctcgacgcctatctccagcagctcaccagagccgggcgc

SEQ ID NO: 14035 - protein, 160 aa, Zea mays
  misc_feature: Ceres CLONE 1375273-F
  misc_feature (15)..(15): Xaa is any aa, unknown, or other
  misc_feature (43)..(43): Xaa is any aa, unknown, or other
  misc_feature (49)..(49): Xaa is any aa, unknown, or other
  misc_feature (91)..(91): Xaa is any aa, unknown, or other
MWRRHHLLRLLPPPXTAATAAAPSHFLRHLSTSSTPTPGASLXSSLASXLTALSTNPPPGTTPDAYFSLHFSDVRATNALLAEGLALSPPXTLPRACDLFRFLVRRRSLHPSDGALAPIVRHLARRRDFPAVRALIQEFPTALGPATLDAYLQQLTRAGR

SEQ ID NO: 14036 - DNA, 643 bp, Zea mays
  misc_feature: Ceres CLONE 1375276-F
  misc_feature: Encodes the peptide sequence at SEQ ID NO. 14037
ggagctccccgcggtggcggccgctctagaactagtggatcccccgggctgcaggaattcgcacgagaccattacctagaacatcctaatcgaaaaagcaccagttgcttcacggcttcatcatcactccactagccagtcagctactggcctacagctagccgcctcctctcctctcatcccatcccatctcatctccgacaagcgaagcagagcactggcatgagcatggaccgcatggcgcggcgttccgtgtccttgctcctcgctctggctctcctggccgccgcggcgtcggcggactcgtggctgtacgagaagttcacgacggagggcaacgtgcgcgcggactacaacgcgcaggggcagcaggtgacgtctctgatcctgacgcagcagtccggcggcgccttcagctcgcggcagaagtacctgtacggggagttcagcatccagatgaggctgatcccgggcaactccgcgggcaccgtgacctccttctacctgtcgtcgggcgacgggcccgggcacgacgagatcgacatggagttcatgggcaacgccagcgggcagcccgtggtgctgaacaccaacgtgtgggccaacggcgacggcaagaaggagcaccagttctacctgtggt

SEQ ID NO: 14037 - protein, 140 aa, Zea mays
  misc_feature: Ceres CLONE 1375276-F
  misc_feature (30)..(140): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MSMDRMARRSVSLLLALALLAAAASADSWLYEKFTTEGNVRADYNAQGQQVTSLILTQQSGGAFSSRQKYLYGEFSIQMRLIPGNSAGTVTSFYLSSGDGPGHDEIDMEFMGNASGQPVVLNTNVWANGDGKKEHQFYLW

SEQ ID NO: 14038 - DNA, 673 bp, Zea mays
  misc_feature: Ceres CLONE 1375293-F
  misc_feature: Translation starting site: 275
  misc_feature (347)..(347): n is a, c, t, g, unknown, or other
  misc_feature (348)..(348): n is a, c, t, g, unknown, or other
  misc_feature (360)..(360): n is a, c, t, g, unknown, or other
  misc_feature (366)..(366): n is a, c, t, g, unknown, or other
  misc_feature (367)..(367): n is a, c, t, g, unknown, or other
  misc_feature (370)..(370): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (472)..(472): n is a, c, t, g, unknown, or other
  misc_feature (502)..(502): n is a, c, t, g, unknown, or other
  misc_feature (505)..(505): n is a, c, t, g, unknown, or other
  misc_feature (540)..(540): n is a, c, t, g, unknown, or other
  misc_feature (541)..(541): n is a, c, t, g, unknown, or other
  misc_feature (566)..(566): n is a, c, t, g, unknown, or other
  misc_feature (588)..(588): n is a, c, t, g, unknown, or other
  misc_feature (643)..(643): n is a, c, t, g, unknown, or other
ggagctccccgcggtggcggccgctctagaactagtggatcccccgggctgcaggaattcgcacgagaccattacctagaacatcctaatcgaaaaattattgccccctcttcccttcccaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtgganngggagccgcgcnttttgnncgncgaggggaggagctcttcctccgcctccggcaagaggggcttcgccgagaccatcgacctgaagctgaagctggagccagcgcgcccctcnnnnnnngcggnaagaaggaggaggaggaccacggcttgtgntgncccccctttgaaaagggaaggaggaggccgggaannaatgaagcggtccccgagccagagnaagcgtcgccgccgcccgccgnccgccgtgcttggctgacccccgccgagaagccgcgcgccgccagggcttcaggntggtgtgatggccaccccgggtccgttcgt

SEQ ID NO: 14039 - DNA, 640 bp, Zea mays
  misc_feature: Ceres CLONE 1375303-F
  misc_feature: Encodes the peptide sequence at SEQ ID NO. 14040
  misc_feature (464)..(464): n is a, c, t, g, unknown, or other
  misc_feature (533)..(533): n is a, c, t, g, unknown, or other
  misc_feature (537)..(537): n is a, c, t, g, unknown, or other
  misc_feature (547)..(547): n is a, c, t, g, unknown, or other
  misc_feature (548)..(548): n is a, c, t, g, unknown, or other
tccccgcggtggcggccgctctagaactagtggatcccccgggctgcaggaattcgcacgagaccattacctagaacatcctaatcgaaaaacaaacacctccgatccgtccccgatcatcgcaccacctgtagcccacctcgctctcgagtctcgacccagcgacgagatggccgcggtggatctgaccccaaggacgcccaagaaggcctacggcggcgacggcggcgcctactacgagtggagccccgccgacctgcctatgctcgccgtcgcctccatcggcgccgccaagctctcgctcgccgccggcggcctctccctccccagctactccgactccgccaaggtcgcctacgtcctacaaggcgtcggtacctgcggcctcgtcctccccgaggcgacgaaggagaaggtggtggcggtgaaggagggcgacgcgctggcgctgccccttcgcgcgntgacgtggtggcacaacggccccgccgcgcaggccgacctcacggtgctcttccctcgcgacacctccnaggncacaaggcgnnggcagttcaccaacttcaggctcacgggggtcgcgggcatcttcacgggctggcccccccgaggtcgtgcccgggggcgtggggatctggcg

SEQ ID NO: 14040 - protein, 157 aa, Zea mays
  misc_feature: Ceres CLONE 1375303-F
  misc_feature (6)..(151): Pfam Name: Cupin_1 Pfam Description: Cupin
  misc_feature (99)..(99): Xaa is any aa, unknown, or other
  misc_feature (122)..(122): Xaa is any aa, unknown, or other
  misc_feature (123)..(123): Xaa is any aa, unknown, or other
  misc_feature (127)..(127): Xaa is any aa, unknown, or other
MAAVDLTPRTPKKAYGGDGGAYYEWSPADLPMLAVASIGAAKLSLAAGGLSLPSYSDSAKVAYVLQGVGTCGLVLPEATKEKVVAVKEGDALALPLRAXTWWHNGPAAQADLTVLFPRDTSXXTRRXQFTNFRLTGVAGIFTGWPPRGRARGRGDLA

SEQ ID NO: 14041 - DNA, 654 bp, Zea mays
  misc_feature: Ceres CLONE 1375313-F
  misc_feature: Encodes the peptide sequence at SEQ ID NO. 14042
  misc_feature (592)..(592): n is a, c, t, g, unknown, or other
  misc_feature (620)..(620): n is a, c, t, g, unknown, or other
aaagctggagctccccgcggtggcggccgctctagaactagtggatcccccgggctgcaggaattcgcacgagaccattacctagaacatcctaatcgaaaaataatattttcagcattcaaaaacacaccaagggaagcgcactagcaacgacctaacaccaatggctaccaagatattagccctccttgcgcttcttgcccttttagtgagcgcaacaaatgcgttcattattccacagtgctcacttgctcctagtgccagtattccacagttcctcccaccagttacttcaatgggcttcgaacatccagccgtgcaagcctacaggctacaactagcgcttgcggcgagcgccttacaacaaccaattgcccaattgcaacaacagtccttggcacatctaaccctactaaccattgcaacgcaacaacaacaacaacagtttctgccatcactgagccacctagcagcggtgaaccctgtcaccctactgcaacagcagctgcttgcatcctacccacttgatctgccgaacgtagctgcataccagcaacaacaacagctggcacgagtttatgcaagtgctcanccaactacccatggagaacccctgccgnctaactacaattactttgcatctaccccgcgtgg

SEQ ID NO: 14042 - protein, 163 aa, Zea mays
  misc_feature: Ceres CLONE 1375313-F
  misc_feature (1)..(161): Pfam Name: Zein Pfam Description: Zein seed storage protein
  misc_feature (143)..(143): Xaa is any aa, unknown, or other
  misc_feature (153)..(153): Xaa is any aa, unknown, or other
MATKILALLALLALLVSATNAFIIPQCSLAPSASIPQFLPPVTSMGFEHPAVQAYRLQLALAASALQQPIAQLQQQSLAHLTLLTIATQQQQQQFLPSLSHLAAVNPVTLLQQQLLASYPLDLPNVAAYQQQQQLARVYASAXPTTHGEPLPXNYNYFASTPR

SEQ ID NO: 14043 - DNA, 630 bp, Zea mays
  misc_feature: Ceres CLONE 1375316-F
  misc_feature: Encodes the peptide sequence at SEQ ID NO. 14044
aaagctggagctccccgcggtggcggccgctctagaactagtggatcccccgggctgcaggaattcgcacgagaccattacctagaacatcctaatcgaaaaaagatccgatctccctctctctccccaatcctccccgcctccccgcctccccctaccaaatcagcaccacccaaggggcatccaagccacgggcgcgcaatgccgccctctgtcgatgcaatgccgggccccggagacgccgcgggcggcgacgacgtgcgcatgatctcctccaaggagctccgctctcacgcgtccgtcgacgacctctggatctccatctccggcgacgtgtacgacgtcacgccctggctcccccaccacccgggcggcgacctcccgcttctcaccctggagggggaggacgccaccgacgacttcgccgcctaccacccgccctcggcgcgcccgctcctccgccgcttcttcgttgagcgcctctccgactacgccgtctcccccgcgtccgccgactaccgccgcctcctcgcgcagctatcctccgcgggcctcttcgaacgcgtcggccccacccccaaggtccagctcgtcctgatggccgtcctcttctacgccgcgctctacctc

SEQ ID NO: 14044 - protein, 143 aa, Zea mays
  misc_feature: Ceres CLONE 1375316-F
  misc_feature (22)..(95): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MPPSVDAMPGPGDAAGGDDVRMISSKELRSHASVDDLWISISGDVYDVTPWLPHHPGGDLPLLTLEGEDATDDFAAYHPPSARPLLRRFFVERLSDYAVSPASADYRRLLAQLSSAGLFERVGPTPKVQLVLMAVLFYAALYL

SEQ ID NO: 14045 - DNA, 682 bp, Zea mays
  misc_feature: Ceres CLONE 1375319-F
  misc_feature: Encodes the peptide sequence at SEQ ID NO. 14046
tggagctccccgcggtggcggccgctctagaactagtggatcccccgggctgcaggaattcgcacgagaccattacctagaacatcctaatcgaaaaaagtccagaacctcgcttccaatctgccctcccgtgtccccctccctgtccgattccccacagtagcgcctcgccctcgtcctcctcctccagtccggatcgccatttcccaccgatccgtcccggcatcggcatggctgcgcccaagccaaaggcgccggcgcccagtgcttcggcagcctagcgtttgtttgcctccgaggatttccgcctatcgcgttaccggatcttcggtgggccggggaccctctacgccactatgagctccgacgggcgcctccgccgggcgctggccgcgttcggcggcgaggtgtgggacctcctgaacgcggggctcgccgccgccccgcgggaacggccccggcaacctgcgggcgccgccgcgacggtatcgtcccagcgcctctacgcagggtgctggcccgttggcgcaacttgcaaaggcggaaatcaccccccggcggcctgcttcacccggaggaaaggccaattgaaccccgacaattgctggaaggcttcccacctgagggggggggggctccgggattttccagcccccccccctgaaaacggaaaggacaaaca

SEQ ID NO: 14046 - protein, 108 aa, Zea mays
  misc_feature: Ceres CLONE 1375319-F
MSSDGRLRRALAAFGGEVWDLLNAGLAAAPRERPRQPAGAAATVSSQRLYAGCWPVGATCKGGNHPPAACFTRRKGQLNPDNCWKASHLRGGGLRDFPAPPPENGKDK

SEQ ID NO: 14047 - DNA, 608 bp, Zea mays
  misc_feature: Ceres CLONE 1375322-F
  misc_feature: Encodes the peptide sequence at SEQ ID NO. 14048
  misc_feature (396)..(396): n is a, c, t, g, unknown, or other
  misc_feature (480)..(480): n is a, c, t, g, unknown, or other
  misc_feature (481)..(481): n is a, c, t, g, unknown, or other
  misc_feature (543)..(543): n is a, c, t, g, unknown, or other
  misc_feature (582)..(582): n is a, c, t, g, unknown, or other
  misc_feature (608)..(608): n is a, c, t, g, unknown, or other
tggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtgctgcaagcaggcgtgcgagtggcattacggaaaggacaccccgcgtaagagggatgcnagagcgagtgccgcgagcggcaccagcaagctgacgcgggcgaggaacgcgacagcggcgtgtacgcctacgtctcccgctccnnggagggcgagtgccggcgccagtgcctgcgccgacacgagggccagccgtgggagacccagnagtgcatgaggccgtgccgccgtcgcggactgggcgtcnacatgaacaagagtacggtcgctgcn

SEQ ID NO: 14048 - protein, 114 aa, Zea mays
  misc_feature: Ceres CLONE 1375322-F
  misc_feature (92)..(92): Xaa is any aa, unknown, or other
  misc_feature (112)..(112): Xaa is any aa, unknown, or other
MGKGSVGASWWAFLLLAGVLLVVAATAGAEDGVVERDRKEDLRCCKQACEWHYGKDTPRKRDARASAASGTSKLTRARNATAACTPTSPAPXRASAGASACADTRASRGRPXSA

SEQ ID NO: 14049 - DNA, 656 bp, Zea mays
  misc_feature: Ceres CLONE 1375323-F
  misc_feature: Encodes the peptide sequence at SEQ ID NO. 14050
aagctggagctccccgcggtggcggccgctctagaactagtggatcccccgggctgcaggaattcgcacgagaccattacctagaacatcctaatcgaaaaagtctgcacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaacttctaggaagatgatccgatctacggaaggctgtgcaaagagcattactttggagaggaacaacaaatcagacgatgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtgccaccatgttccaacccggaaataggagcatcaaacatacaaggaccaactttgccatgagagtcaacagtttcttgcgtcagctacgcactcatcctactcttaataagtttgttattaagttcgggctgcgcaggaagcacactc

SEQ ID NO: 14050 - protein, 134 aa, Zea mays
  misc_feature: Ceres CLONE 1375323-F
  misc_feature (38)..(85): Pfam Name: F-box Pfam Description: F-box domain
MAKQKEGVDKRTSRKMIRSTEGCAKSITLERNNKSDDVQLHDLPNDILGSILSRLTFRESSQMGLVSHTWRRLWRSCCRKLVFTSATMFQPGNRSIKHTRTNFAMRVNSFLRQLRTHPTLNKFVIKFGLRRKHT

SEQ ID NO: 14051 - DNA, 665 bp, Zea mays
  misc_feature: Ceres CLONE 1375327-F
  misc_feature: Translation starting site: 440
  misc_feature (410)..(410): n is a, c, t, g, unknown, or other
aaagctggagctcaccgcggtggcggccgctctagaactagtggatcccccgggctgcaggaattcgcacgagaccattacctagaacatcctaatcgaaaaaaccaaaacaatcaataaactatcagaagtcagcgcctccctcctccgcccgtttcctcaagcgacaagaacccaaccactccgcgtcgtcttctgctgccaatggaggaggagcgctgcttcaacaactgagatctggacgccgtcgagcgcttgggctgccgccgcctcctctccccgtgcgccgtaaccagacccgttcgcttcgtttctcccgccgccgccgcataaggagaagcccgtggcgccagcgccgtttaaagagccatagccacataccgcgtgacgcttccctgaccttgatgctnctgtcgagacagacgtttaacagctcctcatgaacctgatagccgaccagcctctcctgaatcagactctgcacaggacagcggcaacgacaatgtcaacggcaatgttaacgcctcgctcactatctgaatgacaccatctacaaccaactgctacagccgtagaacgggtctcctctccaagatgcgccacgctccggataggtcacatgcgacgaggctggaaagcagaccgacggcatggccatgatccaa

SEQ ID NO: 14052 - DNA, 673 bp, Zea mays
  misc_feature: Ceres CLONE 1375339-F
  misc_feature: Encodes the peptide sequence at SEQ ID NO. 14053
aaagctggagctccccgcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtctatccaaaccaccaaaagcaatgccgccgtcgtacggaaacggcgccaccgccgccgccgccgtcgcgagggacgacatgtccccggcggaggacaggctgtcgataatggaactggcgaacatggtgtcggtgccaatggcgctggcgaccgtgatccggctgggcgtgccggccgtggtgtgggcggacggcgccaacgcgcccatgtgcagcggtcgacctcctcccgccggatcacccggacccgtccgtcctggagcgactgctccgcctgctggcgtcccgcgacgttttctccgagtccaccgagtccacgcccaccacgtggcggcggctattcactctcaccgcggtgagccgcaccctggatgccgggacccagcctcgggcgcgtcctacggccgactacgtgctgcagaccacattgacgcgtttgtttaaacggatttggcctcaactgccacgaggacgtgtttttgacccctacgtgggcctgatgacgttcgg

SEQ ID NO: 14053 - protein, 140 aa, Zea mays
  misc_feature: Ceres CLONE 1375339-F
MPPSYGNGATAAAAVARDDMSPAEDRLSIMELANMVSVPMALATVIRLGVPAVVWADGANAPMCSGRPPPAGSPGPVRPGATAPPAGVPRRFLRVHRVHAHHVAAAIHSHRGEPHPGCRDPASGASYGRLRAADHIDAFV

SEQ ID NO: 14054 - DNA, 657 bp, Zea mays
  misc_feature: Ceres CLONE 1375342-F
  misc_feature: Encodes the peptide sequence at SEQ ID NO. 14055
aaagctggagctccccgcggtggcggccgctctagaactagtggatcccccgggctgcaggaattcgcacgagaccattacctagaacatcctaatcgaaaaatcaaccatattattgagaccaacaagcaacatagaatgcggaatccagcaccaacaatagagcaacaatggcgaccaatatattttccctccttatgctccttgctctttctacatgtgctgctaacgcgacaattttccctcaatgctcacaagctcctatagcttcccttcttcccccataccttccatcaattatagcttcaatatgtgaaaacccagctcttcaaccatataggcttccacaagcaatcgcagcaagcaacatacctttatcgcccttgttgattcaacaatcgccagccctatctttggtggagtcattggcacaaaccatcagggcacaacagatgcagcaactcgtgctacctctgatcaaccaagtagctctgacaaacctttctccctactctcagcaacaacaatttcttccattcaaccaactgtctacactgaaccctgctgcttatttgcagcaacaactattaccatttagccagctagctactgcctactctcagcaacaacaacttcttccatttaaccaattggacg

SEQ ID NO: 14055 - protein, 162 aa, Zea mays
  misc_feature: Ceres CLONE 1375342-F
MATNIFSLLMLLALSTCAANATIFPQCSQAPIASLLPPYLPSIIASICENPALQPYRLPQAIAASNIPLSPLLIQQSPALSLVESLAQTIRAQQMQQLVLPLINQVALTNLSPYSQQQQFLPFNQLSTLNPAAYLQQQLLPFSQLATAYSQQQQLLPFNQLD

SEQ ID NO: 14056 - DNA, 646 bp, Zea mays
  misc_feature: Ceres CLONE 1375346-F
  misc_feature: Encodes the peptide sequence at SEQ ID NO. 14057
  misc_feature (483)..(483): n is a, c, t, g, unknown, or other
  misc_feature (484)..(484): n is a, c, t, g, unknown, or other
  misc_feature (498)..(498): n is a, c, t, g, unknown, or other
  misc_feature (499)..(499): n is a, c, t, g, unknown, or other
  misc_feature (545)..(545): n is a, c, t, g, unknown, or other
  misc_feature (555)..(555): n is a, c, t, g, unknown, or other
tggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccggnnaggggcgagtgccnngcgcagtgcctgcgccgccacgaagggcagccgtgggagaaccagnagtgcatgangcggtgccgccgccgcggactgggcgtcaactggagcaagaagtacgtcgcggcaccaaaccggggcaagtccccggaaaggggcaacccc

SEQ ID NO: 14057 - protein, 146 aa, Zea mays
  misc_feature: Ceres CLONE 1375346-F
  misc_feature (93)..(93): Xaa is any aa, unknown, or other
  misc_feature (98)..(98): Xaa is any aa, unknown, or other
  misc_feature (113)..(113): Xaa is any aa, unknown, or other
  misc_feature (116)..(116): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGXGRVPXAVPAPPRRAAVGEPXVHXAVPPPRTGRQLEQEVRRGTKPGQVPGKGQP

SEQ ID NO: 14058 - DNA, 648 bp, Zea mays
  misc_feature: Ceres CLONE 1375347-F
  misc_feature (565)..(565): n is a, c, t, g, unknown, or other
  misc_feature (570)..(570): n is a, c, t, g, unknown, or other
  misc_feature (606)..(606): n is a, c, t, g, unknown, or other
aagctggagctcaccgcggtggcggccgctctagaactagtggatcccccgggctgcaggaattcgcacgagaccattacctagaacatcctaatcgaaaaacatcgacccaggcatctcctcaccctcgttcaccacacagtacgccactcctttagaagattgtgatttgtacgtcgacgagatcactggtcgggaggtgaacgacgacacatggtgaagggtagtgtgagtgcatcatgatgagcgttcctcctgctcgccggcgtgctgctggtcatagtacccacggccggagcggatgacggagtggacgaacgggaccgcaaggaggacctgcgtgggtgcaagcaggctggagagtgtcactacggaaaggacaccccgcgaaatagtgaatgccagagcgagtgacgcgagcgacaccagcaagctgactcgtgcgatgacgtcgacagcggaatggacgactacatctcccgctccgggaggtgcgagtgccggaaacagtgcctgagtctgcacgagggacagacgtagcagaactaggagtgcatgagcaggntgcgncagcgctgactgtacgtcgaatgaagcaagagtacngtcgcgacacctagagcgcaggacagtgccggcatagttgca

SEQ ID NO: 14059 - DNA, 557 bp, Zea mays
  misc_feature: Ceres CLONE 1375348-F
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
tggagctccccgcggtggcggccgctctagaactagtggatcccccgggctgcaggaattcgcacgagaccattacctagaacatcctaatcgaaaaatcaaccatattattgagaccaacaagcaacatataaagtggaatacagtagcaacaatagagcaacaatggcgaccaagatattttccctccttatgctccttgctctttctacatgtgttgctaacgcgacaattttcccccataccttccatcaattatagctttcatatgtgaaaaacccagctcctcaaacatatagggcttccaacaagaaaatccccgaaaaaagaaaataaacccctttttttcccccccctgttgtgtgttttaaaaaaaannncccccccccctttgggggggggggggttaaaaaacaaaaaaaaaaaccgggggggggcttttttttttttttttaaaaacaaaaagagggggggggaaattttcctcccctttctccctaaaaaaaaaaaaatttttcttttttttccacaaaacgggggggggggaaacaaccccc

SEQ ID NO: 14060 - DNA, 651 bp, Zea mays
  misc_feature: Ceres CLONE 1375351-F
  misc_feature: Encodes the peptide sequence at SEQ ID NO. 14061
tggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaagatcagggcacaacaactacaacaacttgtgctagcaaaccttgctgcctactctcagcaacagcagtttcttccattcaaccaactagctgcattgaactctgcttcttatttgcaacaacaacaactaccattcaggtggcaaacctttctccctactctcagcaacaacaattttcttccattcaaccaactgtctacacttgaccctgctgctta

SEQ ID NO: 14061 - protein, 165 aa, Zea mays
  misc_feature: Ceres CLONE 1375351-F
MAAKIFCLLMLLGLSASAATATIFPQCSQAPIASLLPPYLSPAVSSVCENPILQPYRIQQAITAGILPLSPLFLQQSSALLHQLPLVHLLAQKIRAQQLQQLVLANLAAYSQQQQFLPFNQLAALNSASYLQQQQLPFRWQTFLPTLSNNNFLPFNQLSTLDPAA

SEQ ID NO: 14062 - DNA, 655 bp, Zea mays
  misc_feature: Ceres CLONE 1375363-F
  misc_feature: Encodes the peptide sequence at SEQ ID NO. 14063
  misc_feature (480)..(480): n is a, c, t, g, unknown, or other
tggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggagcctctgccgccgtcgccgccctccggagacgccatcccggtggtggacctctcggtgacgcggcgcgacgacctagtcgagctagtgaggcacgcgtccgggacggtgggcttcttctggctggtgaaccacggagtgccgaaggagctgatgggcgncatgctccccggggtggcgcagttcaacgagggcccctggaaggcaagccagcgctctactccgaggacctccgtcgaacctgggcttcccctccaatttcgaccccttaaggttggtgcggccaatgcgccaaaccctctttgggagggggtccaaaccccgccggggaaagaa

SEQ ID NO: 14063 - protein, 171 aa, Zea mays
  misc_feature: Ceres CLONE 1375363-F
  misc_feature: SWISSPROT Homolog: EC 1.14.11.20 Desacetoxyvindoline 4-hydroxylase
  misc_feature (113)..(113): Xaa is any aa, unknown, or other
MAPTTATKDDSGYGDERRRELQAFDDTKLGVKGLVDSGVKSIPSIFHHPPEALSDIISPEPLPPSPPSGDAIPVVDLSVTRRDDLVELVRHASGTVGFFWLVNHGVPKELMGXMLPGVAQFNEGPWKASQRSTPRTSVEPGLPLQFRPLKVGAANAPNPLWEGVQTPPGKE

SEQ ID NO: 14064 - DNA, 684 bp, Zea mays
  misc_feature: Ceres CLONE 1375365-F
  misc_feature: Encodes the peptide sequence at SEQ ID NO. 14065
ccgggctggagctcaccgcggtggcggccgctctatactagtggatcccccgggctgcaggaattcgcacgagaccattacctagaacatcctaatcaaaaaaagcagagtctgcccctccccgcgccgttctttttggttccccactccccagtccccgccgccgccgaaacccgcagatggaggtcgtcgtcgccgtgaagcagaaggcgaagaaacacatacacctcttctactgctcagaatgcgaggagctcgccctcaagatcgccgccagctccgacgccatcgagctccaatccatcaactggcggagcttcgacgacgggttcccgaacctgctcatcaacaaggcgcacgacatctgtgggcaccacgcggcgttactggactgcttcagctccccgtcggccctactcgagcagatctccggcatctctccgctgcccaagccatcccttgcctccttcactctcctcgccgtcctccttccccacgggactataccagtgcgttcgacgatgagggctatagtctcccccgccgcttcccctccggctgcaatcctctcccacgcaccccaccgccgccgggccctggcctacccaagcctcctcctcctctccgcacctccgcagacgccagatagccactaccgccctaaccacatacgctaccccctct

SEQ ID NO: 14065 - protein, 168 aa, Zea mays
  misc_feature: Ceres CLONE 1375365-F
  misc_feature: SWISSPROT Homolog: EC 2.7.6.1 Ribose-phosphate diphosphokinase
MEVVVAVKQKAKKHIHLFYCSECEELALKIAASSDAIELQSINWRSFDDGFPNLLINKAHDICGHHAALLDCFSSPSALLEQISGISPLPKPSLASFTLLAVLLPHGTIPVRSTMRAIVSPAASPPAAILSHAPHRRRALAYPSLLLLSAPPQTPDSHYRPNHIRYPL

SEQ ID NO: 14066 - DNA, 672 bp, Zea mays
  misc_feature: Ceres CLONE 1375376-F
  misc_feature: Encodes the peptide sequence at SEQ ID NO. 14067
cccagctgaagctcaccgcggtggcggccgctctagtactagtggatcccccgggctgcaggaattcgcacgagaccattacctagaacatcctaatcgaaaacctttcctcgcccctacccccgccaccgccgccgccgtcgccgcagccatggcgtcgcggcgctgtctcctccgcttcctctcgatccgcctcgttcctcagagatctcaacctcttgcgccgatctcgactgcgacccggaccctaacctctttgtccgaggccctcggctccccagctccccgggccctcgcctccccccggctgtactacccctcgcgctgccacttcgcgacccgctcctccggggacgaggacgacggagaagacgaagaagagcactacgacgattgagggagcgatggggaatgttgcgactacgacgagcggctgccgctcctcccccctaccctgtgttgtgagcccatcgccgcgcgggccttggatgcttcctccggcgcgtcctcccgcgatctccggcgctatggcccgctctattctgtctattggcccgttcttggggctccgcttccctgccccccctctcctcttccgtctcgcgcggcttgctccgttctcgcgcgccgcctgcccctccccgcgccggtctcccctcttctcgcccacct

SEQ ID NO: 14067 - protein, 81 aa, Zea mays
  misc_feature: Ceres CLONE 1375376-F
MASRRCLLRFLSIRLVPQRSQPLAPISTATRTLTSLSEALGSPAPRALASPRLYYPSRCHFATRSSGDEDDGEDEEEHYDD

SEQ ID NO: 14068 - DNA, 718 bp, Zea mays
  misc_feature: Ceres CLONE 1375379-F
  misc_feature: Encodes the peptide sequence at SEQ ID NO. 14069
  misc_feature (718)..(718): n is a, c, t, g, unknown, or other
caagctggagctccccgcggtggcggccgctctacaactagtggatcccccgggctgcaggaattcgcacgagaccattacctagaacatcctaatcgaagaacatccaaaattcccagtccgcgatacaagaccaatccaatcccagcggaagtggaagcagtttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcaaatcctctccttcatgccgcctcctctgtccacggccgccgccgattgatgttgtagacactaccaccccgagtctgactattgcattctttctacccccgagctccctccccactgcaggtcatggaccgcccacccccctaccccgcccctcgcccccccctacccccacccctccgccattgtgtccccccgccccccacccacgttgctcgccttcttctcctgtcgctccctccctcgactcctctccccactacctcgctacttccactcacacgccgcgacccccctctatcttccctccccactcgccccacacaaccacacgcactccgcagcaaccccacccacgccccgtgtacccgcccccccctcctcgccctcctctctcccccccctcn

SEQ ID NO: 14069 - protein, 56 aa, Zea mays
  misc_feature: Ceres CLONE 1375379-F
MILVAIVAELLEEYTALVARVLEQLLNDAPFPRRMRFLMLQILSFMPPPLSTAAAD

SEQ ID NO: 14070 - DNA, 708 bp, Zea mays
  misc_feature: Ceres CLONE 1375381-F
  misc_feature (34)..(34): n is a, c, t, g, unknown, or other
gccggctggagctcaccgcggtggcggccgctcnatacactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgctgaacccttcgccgtaacgagatcagatggctgggtatatgacaagagagtcccaaaacggctctgtgagtgtttgagacctacctcccgcacctgatgcacacacgtttggctgcacattttgccaccaaaggatttgcaccccccccctctctcctcccccccccccccatcattgctcccttcttccccctcctgcacgctccccctcccccccaccgtgtttaccgccgccccatggtccgccccagcctccccccccgcgcttccctctcaacctcaccccgcctcgcccccccctcttgcacgccgccccccgcaccccccccctcgccactcttccttcacctccacaccccactcagcgggaccaccgtcctcgcactccccccccccccccctcccttcctcccccttccgtctctccttttgttctgcagcagtccctcc

SEQ ID NO: 14071 - DNA, 653 bp, Zea mays
  misc_feature: Ceres CLONE 1375382-F
  misc_feature: Translation starting site: 213
  misc_feature: Pfam Name: NUDIX Pfam Description: NUDIX domain
  misc_feature (217)..(217): n is a, c, t, g, unknown, or other
ccagctggagctccccgcggtggcggccgctctagactagtggatcccccgggctgcaggaattcgcacgagaccattacctagaacatcctaatcgaaaaaacgcctccccagcaacctctgctccgccgcctccggcgaccgccggaacccgtggtggaggaggacgtggagagggaagatctcgccagatccaaggaggtggggacaagatggngagctcctcgtcgtcggtggttaacgtgtacccgctcgccaactacacgttcggcaccaaggagcccaagatggagaaggacacctccgtcgccgaccgcctcgctcgcatgaaggtcaactacatgaaagaaggaatgcgtacaagtgttgaagccaatcctattggtgcaagagcacaaccaccctcacatactgctcctgcaaatcggaaatacattctgcaaacttcctggtggacggctgaagcctgcagaaaatgaaatcgaagcgttccaacgaaaagcgggcagaaaacttggttgggcaattcgactttttttccacctaattggcaagtttggagacggtgctttcctctattgttatagcgctaacctcttcctcatcaccgatttactatttcgtcgctctctcagtatctcccagtttactct

SEQ ID NO: 14072 - DNA, 652 bp, Zea mays
  misc_feature: Ceres CLONE 1375383-F
  misc_feature: Encodes the peptide sequence at SEQ ID NO. 14073
aaagctggagctccccgcggtggcggccgctctagaactagtggatcccccgggctgcaggaattcgcacgagaccattacctagaacatcctaatcgaaaaattccccgccgcctcgcgcccccgctcgcttcacttctctaggtgcgcaccgatcagaagagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgcccaacattggttatggttctgacaagtcgaccaggcactacctccccagcaagttcaagaagtttgtggtccacaacgtttctgagctgcagttgctcatgatgcacaacaggacctactgcgcctgaaattgctcacaacgtgtccacccacgaattgatgggacatcccgcaccgcgctgcccccctcgacatggctggcatcatctacgtttgtctgggcttccccgccatgaggccccaccaaccctgccttttcgcccttaacctccaccctggctatattcacctccctttttccccacggcacccctctggccctgcctca

SEQ ID NO: 14073 - protein, 95 aa, Zea mays
  misc_feature: Ceres CLONE 1375383-F
  misc_feature (14)..(96): Pfam Name: Ribosomal_L32e Pfam Description: Ribosomal protein L32
MAVPLLTKKIVKKRVKQFKRPHLDRYKCLKPSWRRPKGIDSRVRRKFKGCTLMPNIGYGSDKSTRHYLPSKFKKFVVHNVSELQLLMMHNRTYCA

SEQ ID NO: 14074 - DNA, 789 bp, Zea mays
  misc_feature: Ceres CLONE 1375385-F
  misc_feature (1)..(1): n is a, c, t, g, unknown, or other
  misc_feature (21)..(21): n is a, c, t, g, unknown, or other
ncccgctgtagctcaccgcgntggcggccgctcttacaactagtggatcccccgggctgcaggtattcgcacgagaccattacctagaacatcctaatcgaaaactcctgaacacaccacccctcgtctccccacggaggccgtcctctcctctcctctgcccccgccactgcccaccgctcgcccgtgtgtggtgcattaccatcggcgacaacgccccaccctttccacacccccctgcagctaacactagcatcgcctcacaacactccccagctgacttctctctccactctcatccgtatccccccccgcgctccttaagtatcaccatctccctacttccccaccccgccccgcagccccgcctcgccgcgggcggggcccgccccagcccccccccacttcgccccctaataacgcgactccgccaggccctatcgccccccccactagtaatatatatttctaacacaccccttcgctgctcctatacctcgctgggttcagagatagcgccatcaccgtatatacacccccctctgaaatggcccgcacacccaacacaaaaactcacgcagccactacaatagccacatcaacgccctatggcaaacgccctccctcctcacactcaggcgtccttgctgcccaacaccacacaccttttactgcctcctccccctcccgccttctacccagacaacactatatctaacccatccccccaccccaacaccctcttctaccaccatttctgcccgcctgtctaacccgtaacgctaatat

SEQ ID NO: 14075 - DNA, 647 bp, Zea mays
  misc_feature: Ceres CLONE 1375389-F
  misc_feature: Encodes the peptide sequence at SEQ ID NO. 14076
  misc_feature (438)..(438): n is a, c, t, g, unknown, or other
  misc_feature (443)..(443): n is a, c, t, g, unknown, or other
  misc_feature (509)..(509): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtgggggggctgcccgngtgcncgccgcggctcccgccctgcggccccgtgctcgtccccgccgcgctgctcgtcgggccggccggcntgggggtcccttccctcgggggcgccggggcttccttttcggtcccccctcccctgcggcgcgctcccggggccggccggctgtcccctccgcccctgggccccccgccgcttgggcgtcgcttctctgttggcccct

SEQ ID NO: 14076 - protein, 147 aa, Zea mays
  misc_feature: Ceres CLONE 1375389-F
  misc_feature (78)..(78): Xaa is any aa, unknown, or other
  misc_feature (80)..(80): Xaa is any aa, unknown, or other
  misc_feature (102)..(102): Xaa is any aa, unknown, or other
MADRDRSGIYGGAHATYGQQQQQGGGGRPMGEQVKGMLHDKGPTASQALTVVTLFPLGGLLLVLSGLALTASVGGLPXCXPRLPPCGPVLVPAALLVGPAGXGVPSLGGAGASFSVPPPLRRAPGAGRLSPPPLGPPPLGRRFSVGP

SEQ ID NO: 14077 - DNA, 658 bp, Zea mays
  misc_feature: Ceres CLONE 1375390-F
  misc_feature (321)..(321): n is a, c, t, g, unknown, or other
  misc_feature (329)..(329): n is a, c, t, g, unknown, or other
  misc_feature (330)..(330): n is a, c, t, g, unknown, or other
  misc_feature (332)..(332): n is a, c, t, g, unknown, or other
  misc_feature (338)..(338): n is a, c, t, g, unknown, or other
  misc_feature (342)..(342): n is a, c, t, g, unknown, or other
  misc_feature (372)..(372): n is a, c, t, g, unknown, or other
  misc_feature (374)..(374): n is a, c, t, g, unknown, or other
  misc_feature (378)..(378): n is a, c, t, g, unknown, or other
  misc_feature (421)..(421): n is a, c, t, g, unknown, or other
  misc_feature (423)..(423): n is a, c, t, g, unknown, or other
  misc_feature (447)..(447): n is a, c, t, g, unknown, or other
  misc_feature (448)..(448): n is a, c, t, g, unknown, or other
  misc_feature (450)..(450): n is a, c, t, g, unknown, or other
  misc_feature (496)..(496): n is a, c, t, g, unknown, or other
  misc_feature (598)..(598): n is a, c, t, g, unknown, or other
  misc_feature (599)..(599): n is a, c, t, g, unknown, or other
  misc_feature (628)..(628): n is a, c, t, g, unknown, or other
  misc_feature (630)..(630): n is a, c, t, g, unknown, or other
aaagctggagctccccgcggtggcggccgctctagaactagtggatcccccgggctgcaggaattcgcacgagaccattacctagaacatcctaatcgaaaactccactcctcctcctctctctctccacatttcctctcccgataagagtgaggcctcggctaagcttgagcttcccctccctcccctccagcgctccagctcccctccatcctcggccaaaaattctgcggcgagctccgatccggtccgactactaacccacgccgcagaagccgcgcgacctgatcgcgcgggggtcgaggagaggggaagcgcggngccgcggnngnctgccnccgnaccgccgcaggagaaggaagaggagcccgnancccnccgccccgcggcccgccggaccgagggaccccgagcacgggancncgcgccgggccgccgcgaagcgcnncnacgcggcgcagcccggccacagcgaccgggccgggagggacgagcnggagacggaccacgagggcagggcggaagcccccggcccccacggcgacgagggacacgaccgccggacccccccgcccccccccggaggaggagcccccgnngggacccccccgccgcggccccgcccggncnggcccaaagaagggccgccaacgccccc

SEQ ID NO: 14078 - DNA, 670 bp, Zea mays
  misc_feature: Ceres CLONE 1375391-F
  misc_feature: Encodes the peptide sequence at SEQ ID NO. 14079
  misc_feature (345)..(345): n is a, c, t, g, unknown, or other
cccgctggagctcaccgcggtggcggccgctctagaactagtggatcccccgggctgcaggaattcgcacgagaccattacctagaacatcctaatcgaaaaatcacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggcccctacctcaaagactggtaagnatggccatgccaaatgccactttgttgccataaacatactcgacgccaccaacgtcccccacatcggggggcggcccaccacccgggacatccgcccagggcaccgcacctgacgaccacaccgccggatcagcgacccggcggggaagggcgccacctccccccacccacgtccccacgcgcgcctcccgcccgcggcctagcccccaggacaacacaagcagaccgcgctgcggccctctcctcgcatcccccaagcaacctccctcccgcctggccagccgcgcccacacccgcaacccacctccggcgcctcgccaccacg

SEQ ID NO: 14079 - protein, 90 aa, Zea mays
  misc_feature: Ceres CLONE 1375391-F
  misc_feature (54)..(54): Xaa is any aa, unknown, or other
MSDSEEHHFESKADAGASKTYPQQAGTVRKNGFIVIKNRPCKVVEAPTSKTGKXGHAKCHFVAINILDATNVPHIGGRPTTRDIRPGHRT

SEQ ID NO: 14080 - DNA, 694 bp, Zea mays
  misc_feature: Ceres CLONE 1375393-F
  misc_feature: Encodes the peptide sequence at SEQ ID NO. 14081
  misc_feature (694)..(694): n is a, c, t, g, unknown, or other
cccgctgtagctcaccgcggtggcggccgctcatacctagtggatcccccgggctgcaggtattcccacgagaccattacctagaacatcctaatcgaaaaatcgcacatattattgttaccaactagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccaccggcgtcttcaatgtgtgaaaacccaattgttcaaccctaccggacccaccagccaatcgcaacaggcatcttaccattatccccccttgcacctccaacaacccgccacccctactaccgcacccaccccctggcccctttgccggtcaccacaactcacgctcactccaacttacactctacccggtgctcaccaaacctagcctacatcactcccacgcccaatccgcctctccccctccaaccctactgacctccccccgtcctcctgctcccctcactccccccgcccccccacccatccctcacatccttaccccgcccgccctaccccccacaaattacgctcacacttccccccaacttaggagcaactggaacccccgcaccactacttacccgcccccn

SEQ ID NO: 14081 - protein, 126 aa, Zea mays
  misc_feature: Ceres CLONE 1375393-F
MAAKIFCFLMLLGLSASVATATIFPQCSQAPIASLLPPYLSPPASSMCENPIVQPYRTHQPIATGILPLSPLAPPTTRHPYYRTHPLAPLPVTTTHAHSNLHSTRCSPNLAYITPTPNPPLPLQPY

SEQ ID NO: 14082 - DNA, 629 bp, Zea mays
  misc_feature: Ceres CLONE 1375396-F
  misc_feature: Encodes the peptide sequence at SEQ ID NO. 14083
  misc_feature (472)..(472): n is a, c, t, g, unknown, or other
ccaagctggagctccccgcggtggcggccgctctataactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcccgagctggaacctgaaccattcatcaacgggcaaaccaactaccccggngtgggggcaaccgcgcgacgttctactccctggggcccccccccccgcccgacacgcgcgccccccccccccaacctaacatcccccccccccccccgcccttctctccaccccccccgcccagccacctcccaaccccccctctttccttgctccc

SEQ ID NO: 14083 - protein, 68 aa, Zea mays
  misc_feature: Ceres CLONE 1375396-F
  misc_feature (43)..(43): Xaa is any aa, unknown, or other
MAGIGRNMVAPLLVLNLIMYIIVIGFPSWNLNHSSTGKPTTPXWGQPRDVLLPGAPPPARHARPPPPT

SEQ ID NO: 14084 - DNA, 697 bp, Zea mays
  misc_feature: Ceres CLONE 1375398-F
  misc_feature (296)..(296): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (308)..(308): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
ccaagtggagctcaccgcggtggcggccgctctagtactagtggatcccccgggctgcaggaattcgcacgagaccattacctagaacatcctaatcgaaaactaccgagttttccttccccacctccccgccccacccgtcgccgaatcggagtcccgctcgcgtccacccttgccagagctcaagagctacctcctggtccggttggacagatcccttcgggcgctgcgtccaccgggattcaggcaaagtggtgtaacataagatgcaagggggaagaggtgggaggcagggnttgtnnnnnncngnnnnagcggcccgtcgccccgcgggcgctggccgggcagcggaccgcctgcggctggttctctgctcgcgccccaacaccatgatcacccccccctgcccgcacccccttgcctggcccggccgcaacgctatcgccgccgcccccgccccacaccgcacgcaggcccgctgcggcgcctccgcttcccttgggccacccgcgcccacgcctaccccccgcccccgatcacaatacagcgtgcgttcccccagccacagcctcccccgcgcaagcccacgacgcgcccccacagacaactgatcgcccacacgacatccccgccgacgccccgccgccggaccgccgcaccgccgcggaccgcgtacaggtggaaaggtcgtattccc

SEQ ID NO: 14085 - DNA, 677 bp, Zea mays
  misc_feature: Ceres CLONE 1375400-F
  misc_feature: Encodes the peptide sequence at SEQ ID NO. 14086
aaagctggagctcaccgcggtggcggccgctctagaactagtggatcccccgggctgcaggaattcgcacgagaccattacctagaacatcctaatcgaaaatctatcatcatccaatccagatcagcaaagcggtagtgcgtagagaggatcgtcgaacagaacagcatgaagatggtcatcgttctcgtcgtgtgcctggctctgtcagctgccagcgcctctgcaatgcagatgccctgcccctgcgcggggctgcaggccttgtacggcgctggcgccggcctgacgacgcatgatgggctcttaccatgtctacgtgtttgcttagcaactgacgcccccgcatcccatgcttcccgcctctgtttccctactaccgccaagagcgaccccaccacacccttgtgccccccccctccttccgctgtgctgccacccactccaccgcatgttgtacctcccttcctccccccccaccctctgacacatgatgccccccccccccccgtcgtcttctagtctaagacttcctcccccgcccccccctcaagctcccccgccctccgcgccctgccctgcctcgtcccctcccccccaccgccaccctccacctccttccccacccgccccccctatttctactctccgtcccttctccacctcttctttcttct

SEQ ID NO: 14086 - protein, 117 aa, Zea mays
  misc_feature: Ceres CLONE 1375400-F
MKMVIVLVVCLALSAASASAMQMPCPCAGLQALYGAGAGLTTHDGLLPCLRVCLATDAPASHASRLCFPTTAKSDPTTPLCPPPPSAVLPPTPPHVVPPFLPPHPLTHDAPPPPVVF

SEQ ID NO: 14087 - DNA, 860 bp, Zea mays
  misc_feature: Ceres CLONE 1375402-F
  misc_feature (16)..(16): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ttgttggccctcctcntttttctccccctcccgctgggggcncnnnnntcaaagctggagctccaccgcggtggcggccgctcttcaactagtggatcccccgggctgcaggaattcgcacgagaccattacctagaacatcctaatcgaaaaactgggtcttcagaccattagctttatctactccagagcgcagaagaacccgatcgacaccatgagggtgtcgcctctcggtcgtcgcactccttggctctccctgccccgcgcgcccccaggcctacccggggccggtgtggttgcggcgtctctcctgctaggcggtgctgcccccccccacccgcacccccccgctaaaggaataaacgcgaacgctatagcccccctcccccccgttgcagtggtggagcccgctcgccccacgggctccccccgcgtcggctagcggggcaccccctcatccccgaaaacacgttccggggggtttggcccgcgcgtcgcccccccgccgccggtcgcgcgtgttcgactcgccgccgtccgttttccttctctaacttgtccctccagccacccacccccaagcctcgcccgctcgcccacccatcccccccgccgtccgcaccgccttgcccccatgggcccccacccgccactgcggctgtctaaccaacgaaaaccgcgcctccacccccatgccgcggatcaacaccacaaaaattcgaccgtcctcgctttctcgagcgggggacgtgcccgccgccctccccacattggcgctccgacgccacccagcccacgtcccgacgcgccacgacccacaattcgtgcgctggctcaccacccccccccccctgccgccc

SEQ ID NO: 14088 - DNA, 637 bp, Zea mays
  misc_feature: Ceres CLONE 1375404-F
  misc_feature: Encodes the peptide sequence at SEQ ID NO. 14089
  misc_feature (390)..(390): n is a, c, t, g, unknown, or other
  misc_feature (392)..(392): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
ctggctgtagctcaccgcggtggcggccgctctagaactagtggatcccccgggctgcaggaattcgcacgagaccattacctagaacatcctaatcgaaaaatgctctcactcccactcccgtccctaccaccccgctccccgccatggcagcactcctcctcctcccgctcgtcctcgccgccagcctaggcttgggcaatgccgacccggctccggccaccatcgtgcacaaggacggcacgacctgcaccctctgcgcgtcgtgcgacaacccctgcaacccgtcctactactacccgccgccgtcccctcccccggcgccggtcaccacgccctgcccgcccaccacgccgtcctacccttccccctccggcggaggcggaggangncnnncccccgccctctactcggccccgcgcccccctgccgcttccggtggccgcgcccccgtcggtgtacggtcccccaccccgcccccccccaccctacggggggcccgggagaagtcggctgttggccgcgccctgccccgctgccccccgctcgcatcccctccccgccgcagcccgcccacggacaccctcccgctgcccactctgccctcccccccgacgcctcccgctttgcgttttcg

SEQ ID NO: 14089 - protein, 163 aa, Zea mays
  misc_feature: Ceres CLONE 1375404-F
  misc_feature (82)..(82): Xaa is any aa, unknown, or other
  misc_feature (83)..(83): Xaa is any aa, unknown, or other
  misc_feature (84)..(84): Xaa is any aa, unknown, or other
MAALLLLPLVLAASLGLGNADPAPATIVHKDGTTCTLCASCDNPCNPSYYYPPPSPPPAPVTTPCPPTTPSYPSPSGGGGGXXXPALYSAPRPPAASGGRAPVGVRSPTPPPPTLRGAREKSAVGRALPRCPPLASPPRRSPPTDTLPLPTLPSPPTPPALRF

SEQ ID NO: 14090 - DNA, 645 bp, Zea mays
  misc_feature: Ceres CLONE 1375407-F
  misc_feature: Encodes the peptide sequence at SEQ ID NO. 14091
ccagctggagctccccgcggtggcggccgctctataactagtggatcccccgggctgcaggaattcgcacgagaccattacctagaacatcctaatcgaaaattccaccatcgcacccacccggagcgcctcctcttctccagcgtccgatccccattccccacctctcctccctccgccgccagctcccgcccccttctctcccctcctcgcctccccgcgcgcgcgtttttataagggtttcggcggaggcgcccggtcgctggcgatggccgacgacggcgggagccacgagggcagcggcggcggcggaggcgtccgggagcaggaccggctcctgcccatcgccaacatcagccggatcatgaagaaggccgtcccggccaacggcgagatccgcaaggacgctaaggagaccctgcaggagggcgccctcgagttcatatgattcgccgaccagcgaggccagggcacactgcccgacggacaagcgcaagacaaccgagcggggacgatttgctctggccggagggcactctaggggctcgagggcgacccccggccccccccgcctcacccacccgagcccccgcccagagcgaggggggcacggggtcgcgccgccggggctggcggcggcgctcg

SEQ ID NO: 14091 - protein, 59 aa, Zea mays
  misc_feature: Ceres CLONE 1375407-F
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 791 in the 10/374,780 US patent application
  misc_feature: The sequence is a functional homolog of SEQ ID NO 44 in the 10/675,852 US patent application
  misc_feature: The sequence is a functional homolog of SEQ ID NO 60 in the 10/675,852 US patent application
  misc_feature: The sequence is a functional homolog of SEQ ID NO 38 in the 10/675,852 US patent application
  misc_feature: The sequence is a functional homolog of SEQ ID NO 64 in the 10/675,852 US patent application
  misc_feature: The sequence is a functional homolog of SEQ ID NO 12 in the 10/675,852 US patent application
  misc_feature: The sequence is a functional homolog of SEQ ID NO 10 in the 10/675,852 US patent application
  misc_feature: The sequence is a functional homolog of SEQ ID NO 1502 in the 10/666,642 US patent application
  misc_feature: The sequence is a functional homolog of SEQ ID NO 1910 in the 10/412,699 US patent application
  misc_feature: The sequence is a functional homolog of SEQ ID NO 2172 in the 10/374,780 US patent application
  misc_feature: The sequence is a functional homolog of SEQ ID NO 320 in the 11/435,388 US patent application
  misc_feature: The sequence is a functional homolog of SEQ ID NO 322 in the 10/714,887 US patent application
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 66 in the 10/675,852 US patent application
  misc_feature: The sequence is a functional homolog of SEQ ID NO 42 in the 10/675,852 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 22 in US patent 7166765
  misc_feature: The sequence is a functional homolog of SEQ ID NO 134 in US patent 7294759
  misc_feature: The sequence is a functional homolog of SEQ ID NO 2 in US patent 7220894
MADDGGSHEGSGGGGGVREQDRLLPIANISRIMKKAVPANGEIRKDAKETLQEGALEFI

SEQ ID NO: 14092 - DNA, 724 bp, Zea mays
  misc_feature: Ceres CLONE 1375408-F
  misc_feature: Encodes the peptide sequence at SEQ ID NO. 14093
cccgctggagctcaccgcggtggcggccgctctatactagtggatcccccgggctgcaggaattcccacgagaccattacctagaacatcctaatcgaaaaacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggccggaaacgcgcgctgggagctgtactgcctcgagcatggcattcaggctgatcgccagatgtccggtgacaagaccattgggggcagtgatcgatccttccaacccctcactcccgtgccaccgcgcgctcggtcagcactccccccccgccatggctctacccactccctcggatccctacctaccccatccgcccgaaaccgcagcacccacccaccccacctacaatgacccgtgccggtaccccccccccccctcccgtctgctcccgccagcgctgtctccgcttccccagtccccggcccgcgggcccacccacacacctagccgcaacgccatccccgtctcgccgcctccccctcgctctccaccgaccaccccccccctcccccgatccccctctcccccccctcctccctccctccccctcctcgacaccacaccgcctcca

SEQ ID NO: 14093 - protein, 92 aa, Zea mays
  misc_feature: Ceres CLONE 1375408-F
MRECISIHIGQAGIQAGNARWELYCLEHGIQADRQMSGDKTIGGSDRSFQPLTPVPPRARSALPPRHGSTHSLGSLPTPSARNRSTHPPHLQ

SEQ ID NO: 14094 - DNA, 862 bp, Zea mays
  misc_feature: Ceres CLONE 1375409-F
  misc_feature (22)..(22): n is a, c, t, g, unknown, or other
  misc_feature (40)..(40): n is a, c, t, g, unknown, or other
  misc_feature (41)..(41): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (85)..(85): n is a, c, t, g, unknown, or other
  misc_feature (88)..(88): n is a, c, t, g, unknown, or other
  misc_feature (91)..(91): n is a, c, t, g, unknown, or other
  misc_feature (862)..(862): n is a, c, t, g, unknown, or other
ggggggggggggcccccccccngcaggcgcccattcaaannaaatgtggtgacaannnnccacgctggagctccaccgcggtggnggncgntcttccatagaggatcccccgggctgcaggaattcccacgagaccattacctagaacatcctcaatcgaaaagtcacccacgagcccaacaaaccactcccacccggtggctcgtcctcggacgccaagccactccgcgccccaatccggaagcgccgccgccgccgatcgaccgggcggcgacccatgctccgctcggagctcttctggtaagccacagggctccgcccgactcccggtgaagaaaaaaattacccatcggcgatagttatatttaaaaagagacgctgttccaccgttccttccccccaacaccgtcgcagaagaggaggaccgccagccgcaccgacaatgcccagtacaacgccggacatacgaaaagaacacactcagcttggcgcggacccccccccccgccccaggcagcccgcggcgtcccgcgcttagcatgccgtccaactaccgccgcgctcactccctctgatagtcgtcccctcccagcgtagtgcagctgggggccttccccgccgccggccccacccccccgactacactatatagaaggagatttgtaagctatagaagctcccgtcccaacctgtaccgataggacaaccccccccccccccccaccgggggggtggggcccccgccgatgagcccccccctccccctcgccgtgaagtggcgccgcccccgcacctcggctcccctcatagccgccactcttcacgttacctcctcccggatacatgcctctaccagaaacan

SEQ ID NO: 14095 - DNA, 692 bp, Zea mays
  misc_feature: Ceres CLONE 1375413-F
  misc_feature: Encodes the peptide sequence at SEQ ID NO. 14096
  misc_feature (386)..(386): n is a, c, t, g, unknown, or other
aaagctggagctccccgcggtggcggccgctctacaactagtggatcccccgggctgcaggaattcgcacgagaccattacctagaacatcctaatcgaaaagaggaggcgcatccctccatcctctgcgactgcgtgcgtctctcgagctcgagtcgattgatgattcatcttcctagtctcgtctccgcgccattctccaaatccatctatcgtcaccatcccgatcccagccccagacccgatgcagcaacagcaggacccagcacccgccgatcccgacccactgccgccccccgacctcggtgatgccgccgcctcgtccgcaacgcagacgatcccttcccgcaacgcctcctccaagtacgatttcgtcagggtcaggntctgggctcggggagaacgccgaccactactacgtccctctccaggttcctcctcagaaggatgttcacagttacccaggatccctaattatggcccccatcagattggcccttggactcaaaaagcttgtttggccaaaaacaccctggttgttggacccccaaaggggcttaagggtatactgtgtccagcttttgggaaaaacggggaaaccgggggggagggtataaaaccccgcctacaaaagggggaaaagggtcccttcttccacgggtgcccccaaaaaaatttgggggggggcgaaa

SEQ ID NO: 14096 - protein, 149 aa, Zea mays
  misc_feature: Ceres CLONE 1375413-F
  misc_feature (48)..(48): Xaa is any aa, unknown, or other
MQQQQDPAPADPDPLPPPDLGDAAASSATQTIPSRNASSKYDFVRVRXWARGERRPLLRPSPGSSSEGCSQLPRIPNYGPHQIGPWTQKACLAKNTLVVGPPKGLKGILCPAFGKNGETGGEGIKPRLQKGEKGPFFHGCPQKNLGGGE

SEQ ID NO: 14097 - DNA, 782 bp, Zea mays
  misc_feature: Ceres CLONE 1375414-F
cccagctggagctccacgcggtggcggccgctcttgaactagtggatcccccgggctgcaggtaattcgcacgagaccattacctagaacatcctaatcgaaaaatcagttgcgggcgcgcgtccctgtttcgctcgtgccgttgcgctgcgccaagcctccccacctctctcgtctcttctccacccgccgccctcgtgggagtgaaatcccaccccagccacctccaagaaaaagagtagctctccatcccccgcccccgaacccctctacactggctgggcccaccacccccccccccccctcgcttcgccccctcccgggaaaaatccacacacccccccctacataaaaaaaacaccacccccccctcttttttcctacctcccagtcgccgagggagagaaggatgtcaaacacatactacatataaataaacacccaccccatgagccaccccccaccccccaactccccccaccatcgccaaccatcccagacgcacgagcgcagcacccagagatcaaaatcttctcattccctgctccccccccccaccaccacgtcccccccagctgtccccgtcgttcctcacccactccaatactacacaagcgcaccccacccgcgagccccgcacggcgcctcccatacaccccgcccacatcacccggacaccgccccaatctcaatccttcaccgcccccacaccgtccacgctatttcgctcaccctcatccacctacctacgcccaccccacacatcacacctaaccaaccag

SEQ ID NO: 14098 - DNA, 638 bp, Zea mays
  misc_feature: Ceres CLONE 1375423-F
  misc_feature: Translation starting site: 344
  misc_feature (448)..(448): n is a, c, t, g, unknown, or other
  misc_feature (520)..(520): n is a, c, t, g, unknown, or other
  misc_feature (529)..(529): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatncacgggcagaccaactaccccggcgtggccggcaacggcgcgacgttctacttccctgtgtcgccatcctgncccgcgtgntgggcgccgcgtccaagctagcgggcgtgcaccacgtgcgcgcctggcgccacgacagcctggccaccaacgccgggtcgtcgctcatcgcctgggccatcacggggtt

SEQ ID NO: 14099 - DNA, 710 bp, Zea mays
  misc_feature: Ceres CLONE 1375424-F
  misc_feature: Encodes the peptide sequence at SEQ ID NO. 14100
acagctggagctccccgcggtggcggccgctctccaactagtggatcccccgggctgcaggtattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccggcatcggcgagaatgagatccgcatcaccactcagggcctcgtccgcaactacgtcacctacgccacctccttcgtcaggaaaaacaagggaaggaaattgtgttgaaggctatgggaacaggttataaaaaaggcagtggctattggctgaaaacctaaaagaaaaagcttccccgggttggctccaaaaacaaaaaaacccgcttttggcagcattcacgggggtgtgggaacccctttgggagaagggattggacccattggaaaaaacccccccaagtgttccaaaggaatacaaatttcctctggcccccctgggggcgtttaacaaaaattcaaacgcgggggaaaaagaacccccccaca

SEQ ID NO: 14100 - protein, 50 aa, Zea mays
  misc_feature: Ceres CLONE 1375424-F
MDRYQRVEKPPPEAAGIGENEIRITTQGLVRNYVTYATSFVRKNKGRKLC

SEQ ID NO: 14101 - DNA, 640 bp, Zea mays
  misc_feature: Ceres CLONE 1375425-F
  misc_feature: Encodes the peptide sequence at SEQ ID NO. 14102
aaagctggagctccccgcggtggcggccgctctagaactagtggatcccccgggctgcaggaattcgcacgagaccattacctagaacatcctaatcgaaaagttccgcaccccacggcaggcgcttgagagtacttgactactaccctcccacctgcgagactgcaacgccgttgcttcaactcgactccagcatccctcgtccccgcatcaccgcgccgccgacactccgctcgctttcgctcccgagacccgggcctgccgagccgccgccatggacgaggagtacgacgtgatcgttctgggcacggggctcaaggagtgcatcctcagcggtctcctctctgtcgacggcctcaaggttctacacatggatagaaatgattactacggaggagattccacctcccctaacctgaaccagctctggaagaagtttaggggggaagacaagccaccggcacatctaggtgcaagcagagattaccatgtagacatggttccaaagtttatgatgggcaacggggactttggttcgcactctcattcccactgatgggacaaaaaattggtcattcaaagctggtgatggaagctatgtcttcagcaaacggaaaaattcccaagggtcctggcaccc

SEQ ID NO: 14102 - protein, 93 aa, Zea mays
  misc_feature: Ceres CLONE 1375425-F
MDEEYDVIVLGTGLKECILSGLLSVDGLKVLHMDRNDYYGGDSTSPNLNQLWKKFRGEDKPPAHLGASRDYHVDMVPKFMMGNGDFGSHSHSH

SEQ ID NO: 14103 - DNA, 632 bp, Zea mays
  misc_feature: Ceres CLONE 1375438-F
  misc_feature: Encodes the peptide sequence at SEQ ID NO. 14104
  misc_feature (603)..(603): n is a, c, t, g, unknown, or other
  misc_feature (632)..(632): n is a, c, t, g, unknown, or other
aaagctggagctccccgcggtggcggccgctctagaactagtggatcccccgggctgcaggaattcgcacgagaccattacctagaacatcctaatcgaaaaaacagcagcagaagcaaaagccgcaggccgcaactactccgatctgagtatcacagtcacagctaatagctagccagcagcccagcacccagcaactacccgtacgtacgaacgtgcgcttccgatggcgaccacggtgatggcctccgcgaccgcgagctcccccgccttctccgcccccggcgcgcgcgccaggcgcgccgcccggcttccggcggggttccgcggccgtgtcgccgcgccgccgcgccgcctcgcgctgctcgccagggcctcccagcaggccgatgacgctgccgccgacacgagcgcgagcgcggcgccggctgctcggaagctggggctctgggacgcgctggcgttcagcgggcccgcgccggagcggatcaagggcgggctgggcaaggggggggtttttggggcccccccttccccccccaagggccccccccggggggggagggattctctcttttccaggggggggaaaaaaagaggggncgcacactcctctttggggggggggttcn

SEQ ID NO: 14104 - protein, 135 aa, Zea mays
  misc_feature: Ceres CLONE 1375438-F
  misc_feature (126)..(126): Xaa is any aa, unknown, or other
MATTVMASATASSPAFSAPGARARRAARLPAGFRGRVAAPPRRLALLARASQQADDAAADTSASAAPAARKLGLWDALAFSGPAPERIKGGLGKGGVFGAPPSPPKGPPRGGRDSLFSRGGKKRGXAHSSLGGGF

SEQ ID NO: 14105 - DNA, 664 bp, Zea mays
  misc_feature: Ceres CLONE 1375448-F
  misc_feature: Encodes the peptide sequence at SEQ ID NO. 14106
  misc_feature (642)..(642): n is a, c, t, g, unknown, or other
aaagctggagctccccgcggtggcggccgctctagaactagtggatcccccgggctgcaggaattcgcacgagaccattacctagaacatcctaatcaaaaaaaaaaagtcttcacttccattccaccggctccgatcccaactgccatggcgctctccatctacacgcccacctcctcctccctcgtcccgccctccattcaggaggtcaggctgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgtgttcgatgatttcgagaggttcgcacccacgacggccacagtgagctcgtcgctgctgcttgggatcactgggctcccagacactaagttcaagagtgcgatagatactgcactggcagatggtgagtgcaacgcactggagaaggctgaggacaggatgtcctgttacctcaccaaggctcttgcaaatgttggcgctgaactggctcatcaagtccctgggagagtttcgacggaaatagatgctcggttagcttatgacacccanggcataatccacagggtacatg

SEQ ID NO: 14106 - protein, 172 aa, Zea mays
  misc_feature: Ceres CLONE 1375448-F
  misc_feature: SWISSPROT Homolog: EC 2.2.1.2 Transaldolase
  misc_feature (165)..(165): Xaa is any aa, unknown, or other
MALSIYTPTSSSLVPPSIQEVRLTSRPPKPATFSLRRPHLAARAAAGNAPTSPVREVVTELDAVAGFSEIVPDTVVFDDFERFAPTTATVSSSLLLGITGLPDTKFKSAIDTALADGECNALEKAEDRMSCYLTKALANVGAELAHQVPGRVSTEIDARLAYDTXGIIHRVH

SEQ ID NO: 14107 - DNA, 622 bp, Zea mays
  misc_feature: Ceres CLONE 1375449-F
  misc_feature: Encodes the peptide sequence at SEQ ID NO. 14108
  misc_feature (325)..(325): n is a, c, t, g, unknown, or other
  misc_feature (377)..(377): n is a, c, t, g, unknown, or other
  misc_feature (378)..(378): n is a, c, t, g, unknown, or other
  misc_feature (382)..(382): n is a, c, t, g, unknown, or other
  misc_feature (436)..(436): n is a, c, t, g, unknown, or other
  misc_feature (460)..(460): n is a, c, t, g, unknown, or other
  misc_feature (475)..(475): n is a, c, t, g, unknown, or other
  misc_feature (500)..(500): n is a, c, t, g, unknown, or other
  misc_feature (521)..(521): n is a, c, t, g, unknown, or other
aaagctggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcgnagtacctgaggcagccgcagtgcagcccgctgggcgcggcgccctactacgnncggntgtgggcagacgagcgccatgtaccagccgctcccggcacagtgctgccagcancaaatggagatgatggacgtgcanttcgtcgcgcaacanctgaaaatgatgatgccaactgganggtggcgctgccgccagcaanaagccttggacaaccagtttctgatggaaaacaaaaacaattgttggaaacccagggttccacccccctgggcctgaaaaatgggccaaaaaatgctggcg

SEQ ID NO: 14108 - protein, 152 aa, Zea mays
  misc_feature: Ceres CLONE 1375449-F
  misc_feature (54)..(54): Xaa is any aa, unknown, or other
  misc_feature (71)..(71): Xaa is any aa, unknown, or other
  misc_feature (73)..(73): Xaa is any aa, unknown, or other
  misc_feature (91)..(91): Xaa is any aa, unknown, or other
  misc_feature (99)..(99): Xaa is any aa, unknown, or other
  misc_feature (104)..(104): Xaa is any aa, unknown, or other
  misc_feature (112)..(112): Xaa is any aa, unknown, or other
  misc_feature (119)..(119): Xaa is any aa, unknown, or other
MKMVIVLVVCLALSAASASAMQMPCPCAGLQGLYGAGAGLTTMMGAGGLYPYAXYLRQPQCSPLGAAPYYXRXWADERHVPAAPGTVLPAXNGDDGRAXRRATXENDDANWXVALPPAXSLGQPVSDGKQKQLLETQGSTPLGLKNGPKNAG

SEQ ID NO: 14109 - DNA, 671 bp, Zea mays
  misc_feature: Ceres CLONE 1375451-F
  misc_feature: Translation starting site: 265
  misc_feature: Pfam Name: SUI1 Pfam Description: Translation initiation factor SUI1
  misc_feature (510)..(510): n is a, c, t, g, unknown, or other
  misc_feature (527)..(527): n is a, c, t, g, unknown, or other
  misc_feature (611)..(611): n is a, c, t, g, unknown, or other
  misc_feature (633)..(633): n is a, c, t, g, unknown, or other
  misc_feature (635)..(635): n is a, c, t, g, unknown, or other
aaagctggagctccccgcggtggcggccgctctagaactagtggatcccccgggctgcaggaattcgcacgagaccattacctagaacatcctaatcgaaaaatataggggccatcagatccaagaagagggaagagcaccaaggaccttcggcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtcccagggattgaagaaggagttcagctacagcaagatcctcaaagatctcaagaaaagagtctgctgcaatggtacagtggtccaggacccagaacttgnacaggctgcccgctatnagtcattcagctcccaggtgatcagaagaagaacgtctcgaatttcctcgtccaggccggcattgtgaagaaggagcacatcangattcatggtttctgagcaccngncgggtccatagcaaacaaccctgcatgcagggccac

SEQ ID NO: 14110 - DNA, 650 bp, Zea mays
  misc_feature: Ceres CLONE 1375464-F
  misc_feature: Encodes the peptide sequence at SEQ ID NO. 14111
  misc_feature (455)..(455): n is a, c, t, g, unknown, or other
  misc_feature (472)..(472): n is a, c, t, g, unknown, or other
  misc_feature (502)..(502): n is a, c, t, g, unknown, or other
  misc_feature (505)..(505): n is a, c, t, g, unknown, or other
  misc_feature (529)..(529): n is a, c, t, g, unknown, or other
  misc_feature (568)..(568): n is a, c, t, g, unknown, or other
  misc_feature (569)..(569): n is a, c, t, g, unknown, or other
  misc_feature (644)..(644): n is a, c, t, g, unknown, or other
tggagctccccgcggtggcggccgctctagaactagtggatcccccgggctgcaggaattcgcacgagaccattacctagaacatcctaatcgaaaagtacccatcgctcactacgcgaccgctagctactccgatcggatcctgaccacgcccgcctaccaggccaccaccaccaccaccacccacaaatccccaatggcgaggcgcatcgccgtggcggcagcgttcctggcgctggccgtggtggctcccgccgcgctggcgcaggctcccgggcccgcggcgacgcctagcgggccgccgaacgtgacggcgatcctggagaagggcgggcagttcaccatgttcatgcggctgatgaaggagacgcagcaggacacgcagctgaacagccagctgaacagctcgtacgccagcagcggcggcgggtacacggtgttcgcgcccaccgacnacgccttcaacaacctncagcccggcacgctcaactcgctgacgcancancagcaggtggcgctggtgcagggncacgtcctgccccagttctacagcatggactccttccanngacgcagcaaccccgtccgcacccaggcctccggccgcgacgggccctacacgctcaacatcaccgccaccgccnacaaca

SEQ ID NO: 14111 - protein, 151 aa, Zea mays
  misc_feature: Ceres CLONE 1375464-F
  misc_feature (47)..(147): Pfam Name: Fasciclin Pfam Description: Fasciclin domain
  misc_feature (87)..(87): Xaa is any aa, unknown, or other
  misc_feature (102)..(102): Xaa is any aa, unknown, or other
  misc_feature (103)..(103): Xaa is any aa, unknown, or other
  misc_feature (124)..(124): Xaa is any aa, unknown, or other
  misc_feature (125)..(125): Xaa is any aa, unknown, or other
  misc_feature (150)..(150): Xaa is any aa, unknown, or other
MARRIAVAAAFLALAVVAPAALAQAPGPAATPSGPPNVTAILEKGGQFTMFMRLMKETQQDTQLNSQLNSSYASSGGGYTVFAPTDXAFNNLQPGTLNSLTXXQQVALVQGHVLPQFYSMDSFXXRSNPVRTQASGRDGPYTLNITATAXN

SEQ ID NO: 14112 - DNA, 643 bp, Zea mays
  misc_feature: Ceres CLONE 1375465-F
  misc_feature: Encodes the peptide sequence at SEQ ID NO. 14113
aaagctggagctcaccgcggtggcggccgctctagaactagtggatcccccgggctgcaggaattcgcacgagaccattacctagaacatcctaatcgaaaaaccaacactccgatggatgttttcaccaagcaactcctccccatgcctcaccagcgggaccccaactacccttcctcttccacctcttcctcctcgtcgtcgtcctcctccacgcccccatctcgccctcaccaccgtgcgcaaccccaaccccaaccccacaacctcccccagtcccccagacccgtcccgcgcaccatcgacaccaccccgttccccaccaccttcgtccaggccgacaccacctcgttcaaacaggtcgtccagatgctcaccggcgccgagcagccggccaacaacgacgcgacgacggcgggcgcagccgctgccgctgccgccaacggcggcggcgccggggcccaggcgggcagcggcggaccgtgctgccggcccaagaagccgtcgttcaagctgtacgagcggcggagcagcctgaagaacctgaagatgatcgcgccgctggcgatgggctcgccgccgtcgccgtcgccgtcgccgcggagggcggcgccggagatcctgtcgccgagcgtgctggact

SEQ ID NO: 14113 - protein, 176 aa, Zea mays
  misc_feature: Ceres CLONE 1375465-F
  misc_feature (66)..(96): Pfam Name: VQ Pfam Description: VQ motif
MDVFTKQLLPMPHQRDPNYPSSSTSSSSSSSSSTPPSRPHHRAQPQPQPHNLPQSPRPVPRTIDTTPFPTTFVQADTTSFKQVVQMLTGAEQPANNDATTAGAAAAAAANGGGAGAQAGSGGPCCRPKKPSFKLYERRSSLKNLKMIAPLAMGSPPSPSPSPRRAAPEILSPSVLD

SEQ ID NO: 14114 - DNA, 653 bp, Zea mays
  misc_feature: Ceres CLONE 1375466-F
  misc_feature: Encodes the peptide sequence at SEQ ID NO. 14115
  misc_feature (384)..(384): n is a, c, t, g, unknown, or other
  misc_feature (448)..(448): n is a, c, t, g, unknown, or other
  misc_feature (452)..(452): n is a, c, t, g, unknown, or other
  misc_feature (466)..(466): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaaatttacacgcgcacactccacttcatcaccggatcaccagcctacagctcgtcacatctctctctccgcccggccggcctctagactcactctagccatatggccacggtgcacggcagcaggctcatcttcctcttcgaggccacgctcttctcggcgctgctgctcgtcccggcacgccctgcttccgccacagacggcagcgcgtacccggccggcgactgcccctacccgtgcctgccgccgcccgccgtcaccgccaactgcccgccgcctccgccnggctgcggcgtcgtactcgtacccgccaccgccgggggcttacattccctacttccagctgcgncggntggcggtgtggggntatnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14115 - protein, 88 aa, Zea mays
  misc_feature: Ceres CLONE 1375466-F
  misc_feature (83)..(83): Xaa is any aa, unknown, or other
  misc_feature (84)..(84): Xaa is any aa, unknown, or other
MATVHGSRLIFLFEATLFSALLLVPARPASATDGSAYPAGDCPYPCLPPPAVTANCPPPPPGCGVVLVPATAGGLHSLLPAAXXGGVG

SEQ ID NO: 14116 - DNA, 666 bp, Zea mays
  misc_feature: Ceres CLONE 1375470-F
  misc_feature: Encodes the peptide sequence at SEQ ID NO. 14117
  misc_feature (368)..(368): n is a, c, t, g, unknown, or other
  misc_feature (414)..(414): n is a, c, t, g, unknown, or other
  misc_feature (546)..(546): n is a, c, t, g, unknown, or other
  misc_feature (581)..(581): n is a, c, t, g, unknown, or other
  misc_feature (591)..(591): n is a, c, t, g, unknown, or other
  misc_feature (605)..(605): n is a, c, t, g, unknown, or other
  misc_feature (606)..(606): n is a, c, t, g, unknown, or other
tggagctccccgcggtggcggccgctctagaactagtggatcccccgggctgcaggaattcgcacgagaccattacctagaacatcctaatcgaaaagagcgctctaagccgtttttcctcgtcctcgatccagccccctgccgcttccagctccgatcgatctgatccctccccaccaccacgcccatggcggaccaactcaccgacgaccagatcgccgagttcaaggaggccttcagcctcttcgacaaggacggggatggttgcatcacgaccaaggagctgggaactgtcatgcgttcactggggcaaaaccctacagaggctgagctccaggacatgatcaatgaggtcgatgccgacggcnacggcaccatcgattttccagagtttctcaaccttatggctcgcangatgaaggacaccgactctgaggaagagctcaaggaggcctttcgtgtgtttgacaaggaccagaacggcttcatctctgcccgcgagctccgccatgtcatgacaaaatcttgggagaaagctactgatgnagaggtagacgagatgatcccgtgagctgatgtcnatggtgatgnccaaattaactacnnagagtttgtccaggtcatgatggccaagtgagccacaaaccataagctcaaggcgtgcat

SEQ ID NO: 14117 - protein, 127 aa, Zea mays
  misc_feature: Ceres CLONE 1375470-F
  misc_feature (12)..(40): Pfam Name: efhand Pfam Description: EF hand
  misc_feature (85)..(113): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature (61)..(61): Xaa is any aa, unknown, or other
  misc_feature (76)..(76): Xaa is any aa, unknown, or other
  misc_feature (120)..(120): Xaa is any aa, unknown, or other
MADQLTDDQIAEFKEAFSLFDKDGDGCITTKELGTVMRSLGQNPTEAELQDMINEVDADGXGTIDFPEFLNLMARXMKDTDSEEELKEAFRVFDKDQNGFISARELRHVMTKSWEKATDXEVDEMIP

SEQ ID NO: 14118 - DNA, 673 bp, Zea mays
  misc_feature: Ceres CLONE 1375471-F
  misc_feature: Encodes the peptide sequence at SEQ ID NO. 14119
  misc_feature (339)..(339): n is a, c, t, g, unknown, or other
  misc_feature (345)..(345): n is a, c, t, g, unknown, or other
  misc_feature (349)..(349): n is a, c, t, g, unknown, or other
  misc_feature (431)..(431): n is a, c, t, g, unknown, or other
  misc_feature (502)..(502): n is a, c, t, g, unknown, or other
aagctggagctccccgcggtggcggccgctctagaactagtggatcccccgggctgcaggaattcgcacgagaccattacctagaacatcctaatcgaaaaattccactgtttctctctcgaaatcggccgtctctctcccgtccggcacttcctccgatcgactagcctgcggcggcgccggcgccggcgaccagcggccatgcgggtggcacccagggtgctcttcctcgtccgcgacgccgcgggctacggcgctgccctcgccgacgcgctccgcccgccgcccgggctaactagggagtcctcgcccttcgagctcccccttggaaagtacggnctcgancganagaaggcgtgcgccgagctcctgagcttttcccgatccagtggctctccacaggtggaccatttttggtctggcagactatnagccaccctctgcagcgtgtggtgtaaaatgggtcttgggactgatttcttcggaagctacttccactgangggactctatttgcccatacctcccaagatcgcccaggttttccccgtggaagggaaatggcacaaggggctccccgggcctttgggggggagaaaagggggaaaaaggggatttcccccggtgggggggggggggcccataaaccccaaacattttgaaaaaaagaggga

SEQ ID NO: 14119 - protein, 99 aa, Zea mays
  misc_feature: Ceres CLONE 1375471-F
  misc_feature (48)..(48): Xaa is any aa, unknown, or other
  misc_feature (50)..(50): Xaa is any aa, unknown, or other
  misc_feature (77)..(77): Xaa is any aa, unknown, or other
MRVAPRVLFLVRDAAGYGAALADALRPPPGLTRESSPFELPLGKYGLXRXKACAELLSFSRSSGSPQVDHFWSGRLXATLCSVWCKMGLGTDFFGSYFH

SEQ ID NO: 14120 - DNA, 653 bp, Zea mays
  misc_feature: Ceres CLONE 1375472-F
  misc_feature: Encodes the peptide sequence at SEQ ID NO. 14121
ggagctccccgcggtggcggccgctctagaactagtggatcccccgggctgcaggaattcgcacgagaccattacctagaacatcctaatcgaaaaacaaaacacatccctcctcgctagctcgctctctcttgcaactcccgtgcttctcactgccactgcctgcaggccgagctgctccgcatgtctgctttgctgctgcacctgcaagtctgcaaccgcgcacagagatatcgacgactgtgagccgtgcgtccctcgaccagaaactcgccctcgccaagcgctgctcccgagaggcgaccctcgccggagccaaggcgacagccgtgtcgactatcgcctccacgatccccaccctgaccagcgtgcggatgctgccatggaccaaggacaacatcaaccccaccggccaggcgctcatcgtctccacggtggctgggatggcctacttcatcgccaccgataagaatatcctgtcgctaggcgagacgccactcgttcgaccaagcccctgagcacctcacgaacacctccataccgggcaccggatcgtccccacccggctttcttcaggtcgtgagacgagacctccatcgagctagctagctacctgcctctttcagttcgtcagtgcaaattaagcaccacac

SEQ ID NO: 14121 - protein, 47 aa, Zea mays
  misc_feature: Ceres CLONE 1375472-F
  misc_feature (1)..(40): Pfam Name: ENOD93 Pfam Description: Early nodulin 93 ENOD93 protein
MLPWTKDNINPTGQALIVSTVAGMAYFIATDKNILSLGETPLVRPSP

SEQ ID NO: 14122 - DNA, 660 bp, Zea mays
  misc_feature: Ceres CLONE 1375473-F
  misc_feature: Encodes the peptide sequence at SEQ ID NO. 14123
  misc_feature (660)..(660): n is a, c, t, g, unknown, or other
aaagctggagctccccgcggtggcggccgctctagaactagtggatcccccgggctgcaggaattcgcacgagaccattacctagaacatcctaatcgaaaaattttttttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcggcggcagtttcgtcgccgtcgcctccatgacgtccgccgccgtctccaccagggtggagaacaagaagccatttgctcctccgagggaggtacatgtccaggttacacattcaatgccatctcacaagattgaaattttcaagtcacttgatgattgggctagagataatatcttgacacatctcaagccagtcgagaagtgttggcagccacaggatttcctccctgacccagcatctgaaggatttcatgatgaagttaaggagctcagagaacgtgccaaggagatccctgatgattattttgtttgtttggttggagacatgattactgaggaagctctaccaacataccagactatgcttaaccn

SEQ ID NO: 14123 - protein, 145 aa, Zea mays
  misc_feature: Ceres CLONE 1375473-F
  misc_feature: SWISSPROT Homolog: EC 1.14.19.2 Acyl-[acyl-carrier-protein] desaturase
MALRLHDVALCLSPPLAARRRSGGSFVAVASMTSAAVSTRVENKKPFAPPREVHVQVTHSMPSHKIEIFKSLDDWARDNILTHLKPVEKCWQPQDFLPDPASEGFHDEVKELRERAKEIPDDYFVCLVGDMITEEALPTYQTMLN

SEQ ID NO: 14124 - DNA, 662 bp, Zea mays
  misc_feature: Ceres CLONE 1375476-F
  misc_feature: Encodes the peptide sequence at SEQ ID NO. 14125
  misc_feature (212)..(212): n is a, c, t, g, unknown, or other
  misc_feature (376)..(376): n is a, c, t, g, unknown, or other
  misc_feature (403)..(403): n is a, c, t, g, unknown, or other
  misc_feature (454)..(454): n is a, c, t, g, unknown, or other
  misc_feature (475)..(475): n is a, c, t, g, unknown, or other
  misc_feature (487)..(487): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacncatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacgganaggacaccccgcggaagagggaatgcnagagcgagtgccgcgagcggcaccagcaagctgacgcgggcgaggacggcnacagcggcgtggacgcctacntctccgctcggnaaaggggcgagtgcccggcgcagtgcctgcgcccgcacgagggccagccgtggggagaccccagagtgcatgaggcggtgccgcccgcgcggactgggcgtcgacatggagccaagagtacggtcgcggcagcgagagcgcgggcaagtggcccgggagaagtgcgagcgccacc

SEQ ID NO: 14125 - protein, 149 aa, Zea mays
  misc_feature: Ceres CLONE 1375476-F
  misc_feature (55)..(55): Xaa is any aa, unknown, or other
  misc_feature (64)..(64): Xaa is any aa, unknown, or other
  misc_feature (81)..(81): Xaa is any aa, unknown, or other
  misc_feature (88)..(88): Xaa is any aa, unknown, or other
  misc_feature (92)..(92): Xaa is any aa, unknown, or other
MGKGSVGASWWAFLLLAGVLLVVAATAGAEDGVVERDRKEDLRWCKQACEWQYGXDTPRKRECXSECRERHQQADAGEDGXSGVDAYXSARXRGECPAQCLRPHEGQPWGDPRVHEAVPPARTGRRHGAKSTVAAARARASGPGEVRAP

SEQ ID NO: 14126 - DNA, 660 bp, Zea mays
  misc_feature: Ceres CLONE 1375477-F
  misc_feature: Encodes the peptide sequence at SEQ ID NO. 14127
  misc_feature (318)..(318): n is a, c, t, g, unknown, or other
  misc_feature (369)..(369): n is a, c, t, g, unknown, or other
  misc_feature (489)..(489): n is a, c, t, g, unknown, or other
  misc_feature (622)..(622): n is a, c, t, g, unknown, or other
aaagctggagctccccgcggtggcggccgctctagaactagtggatcccccgggctgcaggaattcgcacgagaccattacctagaacatcctaatcgaaaaaccatctccagcggcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccnagctcgagtccatggagccctgctccagcgtcaaggataggattggctacngcatgatcacggacgcagaggagaaagggctgattactccaggcgtgagtgttctgattgaaccaactagcggcaacacaggcattggactggcctttatggctgctgccaagggctacnaacttacactcacaatgcctgcctccatgagcatggagaggaggatcatattgaaggcttttggtgctgaacttgtccttactgacccactcctgggaatgaaaggagctgtcaagaaagcggaagagatacnagcaaagacacccaactcttacatccttcaacaatttg

SEQ ID NO: 14127 - protein, 151 aa, Zea mays
  misc_feature: Ceres CLONE 1375477-F
  misc_feature (12)..(150): Pfam Name: PALP Pfam Description: Pyridoxal-phosphate dependent enzyme
  misc_feature: SWISSPROT Homolog: EC 2.5.1.47 Cysteine synthase
  misc_feature (38)..(38): Xaa is any aa, unknown, or other
  misc_feature (55)..(55): Xaa is any aa, unknown, or other
  misc_feature (95)..(95): Xaa is any aa, unknown, or other
  misc_feature (139)..(139): Xaa is any aa, unknown, or other
MGEASPSIAKDVTELIGNTPLVYLNKVTEGCVGRVAAXLESMEPCSSVKDRIGYXMITDAEEKGLITPGVSVLIEPTSGNTGIGLAFMAAAKGYXLTLTMPASMSMERRIILKAFGAELVLTDPLLGMKGAVKKAEEIXAKTPNSYILQQF

SEQ ID NO: 14128 - DNA, 669 bp, Zea mays
  misc_feature: Ceres CLONE 1375483-F
  misc_feature: Translation starting site: 184
  misc_feature: Pfam Name: Redoxin Pfam Description: Redoxin
  misc_feature: SWISSPROT Homolog: EC 1.11.1.15 Peroxiredoxin
  misc_feature (393)..(393): n is a, c, t, g, unknown, or other
  misc_feature (401)..(401): n is a, c, t, g, unknown, or other
gctggagctccccgcggtggcggccgctctagaactagtggatcccccgggctgcaggaattcgcacgagaccattacctagaacatcctaatcgaaaaaccccacccattcactcgcctgcgctccctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgcccagcttcatcacacaggctgagcagctcaaagccaagggntgtagacnagatcctgcttatcagcgttaacgaccccttcgtcatgaaggcgtgggcgaagaccaaccccgagaacagcacgttgagttcctcgcccacggatctggaaggtaacccaggccctcgacctccagctcgatttacggacaaagggcttgggcgggccctcaaaaaggtttgttttcctggccaaaaaactcacgggacccggtaaaaaaataaggaagggggggatttccccattcccgggcttaaagaatccctgaagggcctata

SEQ ID NO: 14129 - DNA, 661 bp, Zea mays
  misc_feature: Ceres CLONE 1375484-F
  misc_feature: Encodes the peptide sequence at SEQ ID NO. 14130
  misc_feature (253)..(253): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (489)..(489): n is a, c, t, g, unknown, or other
  misc_feature (490)..(490): n is a, c, t, g, unknown, or other
  misc_feature (614)..(614): n is a, c, t, g, unknown, or other
  misc_feature (616)..(616): n is a, c, t, g, unknown, or other
  misc_feature (620)..(620): n is a, c, t, g, unknown, or other
tggagctccccgcggtggcggccgctctagaactagtggatcccccgggctgcaggaattcgcacgagaccattacctagaacatcctaatcgaaaaaagcgaaggtggcgatcgagcaccgccatggggcaaccaagaacagagctcctcgccctcgcattccttctcgtcgccctcgccgccgccgtggccgccgcggcgacagaggtggtagacgcggcgccggcaccagcgaggacgaggacgacgacngcggggtgccggcgcggcgacctggtggtgcggcagcgcgcgacggggcgcgtggtggaggggaagcccgagtacgcggtgggaggtgcggaacgcgtgccggtgcgcgcagtcccgcgtgctgctgcgctgctacgggctcagcagcgtggaggccgtggacccgcgcgccatccgcgccgtcgacggcgagcgctgcctgctccgcggcgnnncgggcgctggcgccgcgcggnnggcgccgtgcgcttcacctacgcctggatgacgccgcaggacttcccgctcctcagctcgcgcccgcactgctagccgttccagtaccttactttagctctgggctgggctgttctgtattacnantggntgttggtacgcactgattcatcagcaaggaagatgatgatg

SEQ ID NO: 14130 - protein, 146 aa, Zea mays
  misc_feature: Ceres CLONE 1375484-F
  misc_feature (115)..(115): Xaa is any aa, unknown, or other
  misc_feature (122)..(122): Xaa is any aa, unknown, or other
MGQPRTELLALAFLLVALAAAVAAAATEVVDAAPAPARTRTTTAGCRRGDLVVRQRATGRVVEGKPEYAVGGAERVPVRAVPRAAALLRAQQRGGRGPARHPRRRRRALPAPRRXGRWRRAXGAVRFTYAWMTPQDFPLLSSRPHC

SEQ ID NO: 14131 - DNA, 663 bp, Zea mays
  misc_feature: Ceres CLONE 1375490-F
  misc_feature: Encodes the peptide sequence at SEQ ID NO. 14132
  misc_feature (142)..(142): n is a, c, t, g, unknown, or other
  misc_feature (151)..(151): n is a, c, t, g, unknown, or other
  misc_feature (457)..(457): n is a, c, t, g, unknown, or other
  misc_feature (492)..(492): n is a, c, t, g, unknown, or other
  misc_feature (493)..(493): n is a, c, t, g, unknown, or other
  misc_feature (512)..(512): n is a, c, t, g, unknown, or other
  misc_feature (571)..(571): n is a, c, t, g, unknown, or other
  misc_feature (582)..(582): n is a, c, t, g, unknown, or other
  misc_feature (610)..(610): n is a, c, t, g, unknown, or other
tggagctccccgcggtggcggccgctctagaactagtggatcccccgggctgcaggaattcgcacgagaccattacctagaacatcctaatcgaaaaacatcccaattggaagggcagctaataaggtaaggggcgacgaanatggctccnacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggcccgggacggtgggcttcttctggctggtgaaccacgnagtgccggaggagctgatgggcgcatgctccgcgnngtgcgccagtcacgaaggncccccgggggagggggaagcaggcgcttctactcgagggacctcggtcgcaaactgcgncttcgcctccnacttcgacctcttcaaggctgctgcggncgactggcgcgacacgctccttctggcgaggtggctccgaaccccgccgccgg

SEQ ID NO: 14132 - protein, 173 aa, Zea mays
  misc_feature: Ceres CLONE 1375490-F
  misc_feature: SWISSPROT Homolog: EC 1.14.11.20 Desacetoxyvindoline 4-hydroxylase
  misc_feature (117)..(117): Xaa is any aa, unknown, or other
  misc_feature (124)..(124): Xaa is any aa, unknown, or other
  misc_feature (147)..(147): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAARDGGLLLAGEPRSAGGADGRMLRXVRQSRRXPGGGGSRRFYSRDLGRKLRLRLXLRPLQGCCGRLARHAPSGEVAPNPAA

SEQ ID NO: 14133 - DNA, 727 bp, Zea mays
  misc_feature: Ceres CLONE 1375492-R
  misc_feature (1)..(1): n is a, c, t, g, unknown, or other
ncaattgggtaccgggccccccctcgaggtcgacggtatcgataagcttttttttttttttttttcattttttttttttttttttttttttttttttttttttttttttttttttttttttttttttttgaagcccgcacaaaaatctttttatatctgtttcattcaaatatttcccttgtattgaacaacgcaaatgggatttgtgtaccacctgaacccttaaaaaaggatctttaaaaacggaagaaaatttttttctttaaaaaaaacccgaccgcgtttaaaccggaaatcttttaaaaacgggccgggcaaaaagtgaccaagaatttagcccctttacaagggaaggaaccccccccggcatcataggcataactataagcgctaggggaagggttcttaaacatattcaaacactgcgccggaaaacaagtttgcggcgtcccgggagcaccattacaacaaaactccgggaagttaaacgccccggaggggctcttacacgccgccacgaaaccaccgttctgcggatccaagatccgaagctcgctaggacaaatctcgttgatgtcgaagacacatcctggataacgacaatctccggatcccccctgtggtctaatccccatcttgacgttgtaaccttcaacgaagctcacctcgtaaaaatccatgccggagttgcttgatccgacggtgaactccgcaagagtggctgggg

SEQ ID NO: 14134 - DNA, 657 bp, Zea mays
  misc_feature: Ceres CLONE 1375493-F
  misc_feature: Encodes the peptide sequence at SEQ ID NO. 14135
  misc_feature (436)..(436): n is a, c, t, g, unknown, or other
  misc_feature (523)..(523): n is a, c, t, g, unknown, or other
  misc_feature (577)..(577): n is a, c, t, g, unknown, or other
tggagctccccgcggtggcggccgctctagaactagtggatcccccgggctgcaggaattcgcacgagaccattacctagaacatcctaatcgaaaagccaatcagccccatcactcttccgtcgtgtcttctcgcgctttccactcccaacgagatccatcacccccaacctctgtaagcttcccttgacgtcgtcgtcgtcatccatggagagcaaggacggtacccacgatcccgccacgacggccgcgccaccggccggcgcgccgcagcccgcgatgccttccgcggagacggcgcggtggggcacgcggcagatgggcccgccggcggcccccggggcgcacccggagaaccaagaaggcggcgcggtggacggccgcgcgcggggaccaggagctgccgccgtacgtcatcatcggtgagccccgtggncggcgccgccgccgccacagcataggggcaagggggaccagcccatggagcacatcctcgacttcttcacacctggagccgcaaggncgaggagctgccctcccacatctgggtcaatctgaaggccgcgccatccatgtncgacgccgggatggggaagctaaccctcgccgcgaggcgctgtccgaaggccgctttcagaaagtgaacagcagacgttc

SEQ ID NO: 14135 - protein, 72 aa, Zea mays
  misc_feature: Ceres CLONE 1375493-F
MESKDGTHDPATTAAPPAGAPQPAMPSAETARWGTRQMGPPAAPGAHPENQEGGAVDGRARGPGAAAVRHHR

SEQ ID NO: 14136 - DNA, 660 bp, Zea mays
  misc_feature: Ceres CLONE 1375494-F
  misc_feature: Encodes the peptide sequence at SEQ ID NO. 14137
  misc_feature (372)..(372): n is a, c, t, g, unknown, or other
  misc_feature (595)..(595): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacgganaggacaccccgcggaagagggaatgcgagagcgagtgccgcgagcggcaccagcaagctgacgcgggcgaggacggcgacagcggcgtggacgcctacgtctccgctcggaaaaggggcgagtgccggcgccagtgcctgcgccgccacgagggccagccgtgggagaccccagagtgcatgaggcggtgccgccgccgcggactggccgtcgactggagcangagtacggtcgcggcagcaagagcgcgggcagtggcccgggagaagtgcgagcgccacaccgcgg

SEQ ID NO: 14137 - protein, 150 aa, Zea mays
  misc_feature: Ceres CLONE 1375494-F
  misc_feature (55)..(55): Xaa is any aa, unknown, or other
  misc_feature (129)..(129): Xaa is any aa, unknown, or other
MGKGSVGASWWAFLLLAGVLLVVAATAGAEDGVVERDRKEDLRWCKQACEWQYGXDTPRKRECESECRERHQQADAGEDGDSGVDAYVSARKRGECRRQCLRRHEGQPWETPECMRRCRRRGLAVDWSXSTVAAARARAVAREKCERHTA

SEQ ID NO: 14138 - DNA, 677 bp, Zea mays
  misc_feature: Ceres CLONE 1375498-F
  misc_feature: Encodes the peptide sequence at SEQ ID NO. 14139
  misc_feature (387)..(387): n is a, c, t, g, unknown, or other
  misc_feature (400)..(400): n is a, c, t, g, unknown, or other
  misc_feature (438)..(438): n is a, c, t, g, unknown, or other
  misc_feature (449)..(449): n is a, c, t, g, unknown, or other
  misc_feature (457)..(457): n is a, c, t, g, unknown, or other
  misc_feature (484)..(484): n is a, c, t, g, unknown, or other
  misc_feature (500)..(500): n is a, c, t, g, unknown, or other
  misc_feature (502)..(502): n is a, c, t, g, unknown, or other
  misc_feature (503)..(503): n is a, c, t, g, unknown, or other
aagctggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacacacatggggaagggtagtgtgggtgcatcatggtgggcgttcctcctgctcgccggcgtgctgctggtcgtagcagccacggccggggcggaggacggagtggtcgaacgggacccgcaggaggacctgcggtggtgcaagcaggcgtgcgagtggcagtacggaaaggacaccccgcgnaagagggaatgcnagagcgagtgccgagcggcaccagcaagctgacgcggncgaggacggcnaccgcggngtggacgcctacgtctcccgcttcggnaaaggggcgagtggcngnngccagtgcctgccccgccccgaggccagccgggggaaaccccagagggatggaggggtggcccccccggggaattgggctccaaaatggaacaaaatacggtcccggaaacaaaaacgggggaaaagccccggaaaagggggaacggcccccccccgggatatgggggaaaaaa

SEQ ID NO: 14139 - protein, 73 aa, Zea mays
  misc_feature: Ceres CLONE 1375498-F
  misc_feature (64)..(64): Xaa is any aa, unknown, or other
MGKGSVGASWWAFLLLAGVLLVVAATAGAEDGVVERDPQEDLRWCKQACEWQYGKDTPRKRECXSECRAAPAS

SEQ ID NO: 14140 - DNA, 653 bp, Zea mays
  misc_feature: Ceres CLONE 1375500-F
  misc_feature: Pfam Name: Ribosomal_L10 Pfam Description: Ribosomal protein L10
  misc_feature (489)..(489): n is a, c, t, g, unknown, or other
aagctggagctccccgcggtggcggccgctctagaactagtggatcccccgggctgcaggaattcgcacgagaccattacctagaacatcctaatcgaaaaatccgattcactccaatacagattcatcgccttaaacccctctttaaatccattaactacgatctacccttcaattcgagtttctcatctgcaaggcggtctatctgcgattagccttcctccaataaaattcatcttcccagttcgttaaaacaacaaagtaaatttatttaccgacaaatggctgatttcaaagttcttctttctgatttgaagtcaatcgcggttgggaacttatatgctcttactagatgcaaagttgctttgttgatgacatagaagaaaagaagggagggagcagaaggagagtattgttaatggtatcagagagactgtcaaaaatataactctgtccatgtttctcttttgaaaacatgaaaaatatcanattcaaggagtttagacaacagtttagacacaacgaaaggttcttcctcggctagaacaaattgatgcagtttgctcttggtccttctgcttgggatgaaatcatcctgccatctttaaagcttcaagaatcttcatggtgagatgactgcttattacagatat

SEQ ID NO: 14141 - DNA, 668 bp, Zea mays
  misc_feature: Ceres CLONE 1375507-F
aaagctggagctccccgcggtggcggccgctctagaactagtggatcccccgggctgcaggaattcgcacgagaccattacctagaacatcctaatcgaaaaatacttttcctccttcagtttttatcacacgtcaatgcagtgcggctaccaatggcatgctaacttttccagtctttttgaattagaggagacatcctaatgaaatcgattactacgcgaggacgctcgacggcgatgggtacaggctctgggcctcgatcacgatcagatccaatccatggccgcgccccactccgggcttatggattcggccgtcgtggccatcatgacgatgctgatcccgggggcatggccaccatgacccagtgctgcacctgtccctgctcgtggcatcgggggggcttgctgtccacttcgcgcggcggagccacatctcggggaggccgcgcccccctgccaggctgggggccctaccccggggcgaagttctccgggtccctggacttcccgaaccagattccccctccccgggaccatcctcccccgttcctgggggaactgctaccccctggtcgaggactttctgcccccggcgttccgggccctcactaagcccgccctcctggggaggaaattgggccccattaaaaaccccccaggacctt

SEQ ID NO: 14142 - DNA, 683 bp, Zea mays
  misc_feature: Ceres CLONE 1375510-F
  misc_feature: Encodes the peptide sequence at SEQ ID NO. 14143
caaaagctggagctccccgcggtggcggccgctctagaactagtggatcccccgggctgcaggaattcgcacgagaccattacctagaacatcctaatcgaaaaccggtcctccacactccactgtctctcacactcacacagtctcacaaaggctcgtgggctcgtggcctggcctctataaacccccgcccagccggtcacccccaccccatcgcaaatcctcgctcgggcaagaagagccaactgaaaagtattcatccaagaacaccaccccacccgctccaagcacaagtttcgtcttgaagagagccgccaccaccaatggtttgttacaacactgcatcttttagcgcgactctgctggcgttcgcgctgacgtttcaggcctgcctcgccgggaggagctcaccgcgctggtgcaggagccggccataaccatgaggtaccaaagggcggggtcctggcgggccccatcgccgtcaactttatcttggaaggggaacttctcggggccgaaggggggggggattaaccgacttcctgttcgtcgctggaagggggggggccccggccggggggagaacccgaaacccgccctggggccccgtgggttcaaaaagggcgcgcaataaaccacccccagcttccaagggggccctttccccggggtttggcaccctc

SEQ ID NO: 14143 - protein, 64 aa, Zea mays
  misc_feature: Ceres CLONE 1375510-F
MRYQRAGSWRAPSPSTLSWKGNFSGPKGGGINRLPVRRWKGGGPGRGENPKPALGPRGFKKGAQ

SEQ ID NO: 14144 - DNA, 655 bp, Zea mays
  misc_feature: Ceres CLONE 1375517-F
  misc_feature: Encodes the peptide sequence at SEQ ID NO. 14145
  misc_feature (587)..(587): n is a, c, t, g, unknown, or other
  misc_feature (626)..(626): n is a, c, t, g, unknown, or other
aaagctggagctcaccgcggtggcggccgctctagaactagtggatcccccgggctgcaggaattcgcacgagaccattacctagaacatcctaatcgaaaatcgcacgagacaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcaaccaactaggttcattgaactctgcttcttatttgcaaacacacaactaccattcagncagctacctgctgcctacccccagcaatttcttccattncaccaactagcagcattgaactctcctgc

SEQ ID NO: 14145 - protein, 154 aa, Zea mays
  misc_feature: Ceres CLONE 1375517-F
  misc_feature (139)..(139): Xaa is any aa, unknown, or other
  misc_feature (152)..(152): Xaa is any aa, unknown, or other
MAAKIFCLLMLLGLSASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLGSLNSASYLQTHNYHSXSYLLPTPSNFFHXTN

SEQ ID NO: 14146 - DNA, 666 bp, Zea mays
  misc_feature: Ceres CLONE 1375518-F
  misc_feature: Encodes the peptide sequence at SEQ ID NO. 14147
  misc_feature (442)..(442): n is a, c, t, g, unknown, or other
  misc_feature (534)..(534): n is a, c, t, g, unknown, or other
  misc_feature (612)..(612): n is a, c, t, g, unknown, or other
aagctggagctccccgcggtggcggccgctctagaactagtggatcccccgggctgcaggaattcgcacgagaccattacctagaacatcctaatcgaaaaatccacaatgggtcgtgtcatcagagctcaacgtaagggagcaggttccgtcttcaaatcccacactcaccaccgtaaaggccccgccaagttccgcagcctcgactacggcgagagaaatggatacctcaagggcgtcgtgacggagatcatccacgatcccggccgtggtgcgccgctcgctcgcgtcgccttccgtcatcctttccgttacaagaagcagaaggagctcttcgtcgccgccgaaggcatgtacaccggacagttcttgtactgcggtaagaaagcgacgctcgttgtcggaaatgttctcccgcttagagctatccctgaaggagctngtgtctgtaacgtcgagcatcatgtcggtgaccgtggtgtgctcgctagagcttctggcgattacgccatcgtgatttcgcacaaccctgancacgacactactaggatcaagttgccatctgggtcgaaagagatttgtccgagtggatgcagggccatgattggtcangtcgctggtggtggaagaacggaaaagccgatgctcaagcggggaacgcgtaca

SEQ ID NO: 14147 - protein, 186 aa, Zea mays
  misc_feature: Ceres CLONE 1375518-F
  misc_feature (11)..(90): Pfam Name: Ribosomal_L2 Pfam Description: Ribosomal Proteins L2, RNA binding domain
  misc_feature (96)..(186): Pfam Name: Ribosomal_L2_C Pfam Description: Ribosomal Proteins L2, C-terminal domain
  misc_feature (112)..(112): Xaa is any aa, unknown, or other
  misc_feature (142)..(142): Xaa is any aa, unknown, or other
  misc_feature (168)..(168): Xaa is any aa, unknown, or other
MGRVIRAQRKGAGSVFKSHTHHRKGPAKFRSLDYGERNGYLKGVVTEIIHDPGRGAPLARVAFRHPFRYKKQKELFVAAEGMYTGQFLYCGKKATLVVGNVLPLRAIPEGAXVCNVEHHVGDRGVLARASGDYAIVISHNPXHDTTRIKLPSGSKEICPSGCRAMIGXVAGGGRTEKPMLKRGTRT

SEQ ID NO: 14148 - DNA, 651 bp, Zea mays
  misc_feature: Ceres CLONE 1375523-F
  misc_feature: Encodes the peptide sequence at SEQ ID NO. 14149
  misc_feature (482)..(482): n is a, c, t, g, unknown, or other
aaagctggagctccccgcggtggcggccgctctagaactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctccctatccaagcccatgtcacctccttcttctcctccttcccccgggcgctcccgccgccgccgccctgggcgcgcatcacctcgccagcctccacctccggggccctacctacctctgagatcgaggagcggctcgccggggtgcccgtgtacgcgctcgccaacgccgcccnagagttcgtgcttgtgtcgtccacacgcgtgggagggcaagggggcgagagcgtgagtccaacgccggcgctcgggctgctctgcttccggaagaagatgctgacgcgctgctggagcagatggatggcgatatgcgcgccggctctggtgtcgttcctgtcgcgctga

SEQ ID NO: 14149 - protein, 148 aa, Zea mays
  misc_feature: Ceres CLONE 1375523-F
  misc_feature (93)..(93): Xaa is any aa, unknown, or other
MPFRFQFPWLKNPTTNGGTSNIDTNPSPRFPNPFLPIQAHVTSFFSSFPRALPPPPPWARITSPASTSGALPTSEIEERLAGVPVYALANAAXEFVLVSSTRVGGQGGESVSPTPALGLLCFRKKMLTRCWSRWMAICAPALVSFLSR

SEQ ID NO: 14150 - DNA, 608 bp, Zea mays
  misc_feature: Ceres CLONE 1375525-F
  misc_feature: Encodes the peptide sequence at SEQ ID NO. 14151
  misc_feature (303)..(303): n is a, c, t, g, unknown, or other
gctggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcatgcagatgccctgcccctgcgcggggctgcagggcttgtacggcgctggcgccggcctgacgacgatgatgggcgccggcnggctgtacccctacgcggagtacctgaggcagccgcagtgcagcccgctggcggcggcgcccctactacgcgggtgtgggcagccgagcgccatgttccagccgctccggcaacagtgctgccagcagcagaatgaggatgatggacgtgcagtccgtcgcgcagcagctgcagatgatgatgcagcttgagcgtgccgctgcccgcagcagcagcctgtacgaggcagctctgatgcagcagcagcagcagctgctggcagcccaaggtctcaccccatgcccatgatgatggcgcaaaacatg

SEQ ID NO: 14151 - protein, 90 aa, Zea mays
  misc_feature: Ceres CLONE 1375525-F
  misc_feature (28)..(28): Xaa is any aa, unknown, or other
MQMPCPCAGLQGLYGAGAGLTTMMGAGXLYPYAEYLRQPQCSPLAAAPLLRGCGQPSAMFQPLRQQCCQQQNEDDGRAVRRAAAADDDAA

SEQ ID NO: 14152 - DNA, 541 bp, Zea mays
  misc_feature: Ceres CLONE 1375527-F
tggagctcaccgcggtggcggccgctctagaactagtggatcccccgggctgcaggattcgcacgagaccattacctagaacatcctaatcgaaactaatcgagcatcgcagagataggcgtcttcgtactcgcctacctccgcggctcaaacctttcccccttctccaattccctccgtcggcgccgctccatccgtacgacgacacatgagggaggcattcgatcacatcgccaggcgtatcagtcgaaacgcgtgctggagctgactgcctgagatgcatcagctgacgggcagatgcccggtgacagacattgggggaggggaggatgctttcaaaactttctcagtgaactggggttggaagcaccgggcccggggtggtttggtgaccctgaaccccctggcattaatgggggggggggatgggacctaacggcggttttccccccgggggaggttcaacggggggaaggggggggcgcccaaaaattttgcccgggggccacaaccccttggggggggaatttgtggacccttc

SEQ ID NO: 14153 - DNA, 656 bp, Zea mays
  misc_feature: Ceres CLONE 1375528-F
  misc_feature: Encodes the peptide sequence at SEQ ID NO. 14154
aagctggagctccccgcggtggcggccgctctagaactagtggatcccccgggctgcaggaattcgcacgagaccattacctagaacatcctaatcgaaaaatgcccacgggctcgcctatctcatagtccttccccattccgcctctctagctggcctgtagaggaccctcgccatcctccccaggcggaccaccaaacggtccaaacccccagcggcggcgctaggatttgagtctcagagcgccggcaccgtcaccgtcaccgagggtgatggcagaccatgatcgtatgacaatcgatctggagaaggtatgactgtttatgcagaagggaatcaccaagctgaagaacatcctcgaggtcaagcccgagcctcagttcgctccgaggactacatgatgctctacacgacgatatacaacatgtgcacgcagaagccgccgcacgactactcgcagcagctctacgacaagtatcgggagtcgttcagagagtatatcacctccatggtactaccttcgctaaggtagaaacatgatgagtttatgctgagagagctagtgcaaaggtggtcagaccataaagtcatggttcgttgcctctcgcgtttctttcattaccgtgaccggtacttcatatgatggagtcacttac

SEQ ID NO: 14154 - protein, 72 aa, Zea mays
  misc_feature: Ceres CLONE 1375528-F
MTVYAEGNHQAEEHPRGQARASVRSEDYMMLYTTIYNMCTQKPPHDYSQQLYDKYRESFREYITSMVLPSLR

SEQ ID NO: 14155 - DNA, 656 bp, Zea mays
  misc_feature: Ceres CLONE 1375530-F
  misc_feature: Encodes the peptide sequence at SEQ ID NO. 14156
  misc_feature (587)..(587): n is a, c, t, g, unknown, or other
aaagctggagctccccgcggtggcggccgctctagaactagtggatcccccgggctgcaggaattcgcacgagaccattacctagaacatcctaatcgaaaaatatgagtcgttgcctcgcagtttatatccctactgtttcggactttcgggttttggccgacacccgacaatcttaacatcaaactcgtcgtccacgcctcctcggcaaggttgcgtacggcgtggccctaaggcataccagcgggatcaagctattttgctggccaaccgaacggtcaagccgacgatgacgctcggatcggcggcacacaagatcccgctggaggttgcgcacaccctcgtcgagatcgccgaggtcgcgcgctacgcctaccaccaccgccccggccgccctgcaacccacgagggggacccgactgcgccgcccgcaggggctgatagcagcgggggcaccaacgaggatgccgcgcggctgctggaggagaacgccatgctccgcgcccgactcgcagatgacctcgcgctcctgcgtgagctccacggcgcgccctgcgtctccaaggagtgccctcctgatctatacnaccgatggatgggcgcggtcaacatgttagcttctttgctcatctcgagaaatacaggatgagtcagcc

SEQ ID NO: 14156 - protein, 119 aa, Zea mays
  misc_feature: Ceres CLONE 1375530-F
  misc_feature (100)..(100): Xaa is any aa, unknown, or other
MTLGSAAHKIPLEVAHTLVEIAEVARYAYHHRPGRPATHEGDPTAPPAGADSSGGTNEDAARLLEENAMLRARLADDLALLRELHGAPCVSKECPPDLYXRWMGAVNMLASLLISRNTG

SEQ ID NO: 14157 - DNA, 653 bp, Zea mays
  misc_feature: Ceres CLONE 1375540-F
  misc_feature: Encodes the peptide sequence at SEQ ID NO. 14158
  misc_feature (479)..(479): n is a, c, t, g, unknown, or other
aagctggagctccccgcggtggcggccgctctagaactagtggatcccccgggctgcaggaattcgcacgagaccattacctagaacatcctaatcgaaaaaactagtccgtcactttgtttgtaaagctcctcctcgatccatcgatcactgcaccggccggcggcaccgcgctcgcaggggctattctacgagacggaagcaatgacggaccgtgaccgcagcggaatctacggcggtgcccacgccacctacggctaacagcaccatcatggaggaggcgcgcgcccaatggatgagcaggtgaagggaatgttccacgacaaggcaccgactgcgtgccacgcgataaaggtgcccacacttatcccgctgcacggactgctgctgtagcatgaggtcctgacgctgacgacatccgtggacagctgtacgtggcacgctcgagtatctgatctgcagcctcgtgctgagtcccnacgcgctgctcatcgcgacgcctggatgcaactcctcacgtctgcggttctggggctcgtacgactgtcttctctcacatgactcgctaaacagcgtcgacatgggtcgcagcgcaactgagactacctgtaggagactgacgaagaatagcagatggccgccactgaagcagc

SEQ ID NO: 14158 - protein, 33 aa, Zea mays
  misc_feature: Ceres CLONE 1375540-F
MDEQVKGMFHDKAPTACHAIKVPTLIPLHGLLL

SEQ ID NO: 14159 - DNA, 622 bp, Zea mays
  misc_feature: Ceres CLONE 1375544-F
  misc_feature: Encodes the peptide sequence at SEQ ID NO. 14160
aagctggagctccccgcggtggcggccgctctagaactagtggatcccccgggctgcaggaattcgcacgagaccattacctagaacatcctaatcgaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccctaaggggaggcatgcaaatctttgtcaagaccttgactggaaagacaatcacccctagaggggcagtcctcagacaccattgacaatgtcaaggcaaaagatccaggaccaggagggcatcccacctgaacagcaacgtctcatctttgcgggaaagaattgaagggatggaggacccttggtgactacacatccaga

SEQ ID NO: 14160 - protein, 91 aa, Zea mays
  misc_feature: Ceres CLONE 1375544-F
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRPKGRHANLCQDLDWKDNHP

SEQ ID NO: 14161 - DNA, 655 bp, Zea mays
  misc_feature: Ceres CLONE 1375546-F
  misc_feature: Encodes the peptide sequence at SEQ ID NO. 14162
  misc_feature (567)..(567): n is a, c, t, g, unknown, or other
  misc_feature (609)..(609): n is a, c, t, g, unknown, or other
  misc_feature (653)..(653): n is a, c, t, g, unknown, or other
gctggagctccccgcggtggcggccgctctagaactagtggatcccccgggctgcaggaattcgcacgagaccattacctagaacatcctaatcgaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattngtgaccctgtgcttgaccgcatcaggaagcttgcagatattngcactggtctccagggcttcctcgtcttcaacgctggtggtggnag

SEQ ID NO: 14162 - protein, 143 aa, Zea mays
  misc_feature: Ceres CLONE 1375546-F
  misc_feature (49)..(141): Pfam Name: Tubulin Pfam Description: Tubulin/FtsZ family, GTPase domain
  misc_feature (115)..(115): Xaa is any aa, unknown, or other
  misc_feature (129)..(129): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIXDPVLDRIRKLADIXTGLQGFLVFNAGGG

SEQ ID NO: 14163 - DNA, 676 bp, Zea mays
  misc_feature: Ceres CLONE 1375550-F
  misc_feature: Encodes the peptide sequence at SEQ ID NO. 14164
  misc_feature (366)..(366): n is a, c, t, g, unknown, or other
  misc_feature (437)..(437): n is a, c, t, g, unknown, or other
  misc_feature (525)..(525): n is a, c, t, g, unknown, or other
aagctggagctccccgcggtggcggccgctctagaactagtggatcccccgggctgcaggaattcgcacgagaccattacctagaacatcctaatcgaaaaaacaaccatttcttcttcctttttctatatcgcgttacgtccctacccagcgatctaggccgccgcctctcctactgcatctccctcgctctcgtcgcctcgttcgcttcgcctccgccccgccccgccccgagcagagcgcagccctatccggagctgggatggcggacgcgaagcagcagcagcagcagcagcagcagcagccacagcaggcggcagcggcagccaccggcgtgtggaagaacgtcaagcccttcgttaacgncggggcctctgggatgctcgcgacctgcgtcatccagcctatcgacagggtcaggtgaggatcccagtggntgagggctctgctggtcaggtcacaaggaactgcttgcaatgagggggtccgttcttctacaaggttttgtcccccgattgcttgggnaagggaattaaccgatgccccttttggaacctttaggggctaaaataacaaaagctttgaaaaaaaagggggggaaaccttttccccttttttcaaaaaatttttttggcccccaccggcgggggaaaaatggggcgttgggggtggaacc

SEQ ID NO: 14164 - protein, 53 aa, Zea mays
  misc_feature: Ceres CLONE 1375550-F
  misc_feature (35)..(35): Xaa is any aa, unknown, or other
MADAKQQQQQQQQQPQQAAAAATGVWKNVKPFVNXGASGMLATCVIQPIDRVR

SEQ ID NO: 14165 - DNA, 776 bp, Zea mays
  misc_feature: Ceres CLONE 1375558-F
  misc_feature: Encodes the peptide sequence at SEQ ID NO. 14166
  misc_feature (7)..(7): n is a, c, t, g, unknown, or other
  misc_feature (20)..(20): n is a, c, t, g, unknown, or other
  misc_feature (776)..(776): n is a, c, t, g, unknown, or other
cgcacgngattatgacctcnactccgctcattctgcctgactcactcaccaacatgtagctccccgcggtggcggccgctctagaatagtggatcccccgggctgcaggaattcgcacgagaccattacctagaacatcctaatcgaaaacactcacccggttcttcctcctcccgagtcgcgaagtctcgatccactcatccgctgagggcgtcgggcttctggcccttctccccccggccgacctcgcccctccggggctccggccgcttcctgaactcgtctccctcacggacgttctcctccctccgctcgccgcgccgcaacccggagaggagaccgccgctcggtcgagcaccacctggggcccagcgtcctcgcgaccagctctagcgcggcgtccgccctctgcagccctggtgtccccgcgactggattcggccggcacacaactccacagtcaggactcccgtctgcacagcgcggggatcttctgtctccttcgcggcctctggagtccatcccagaccctctccggctggttgattctgctccaacctcacacaaccctcgctatgaacatggcattacgcacccaaagcgcgttgcagctgtatgctagaacccctactctgcctccggcttctttcatcgccctaagtatggggcgcaacccccgctcaccaatggacgggcccgggccgccgccctccggcctggcttcggcaaccgcaaaccttggggtggaggatgagcaccacgtaggtattcccctn

SEQ ID NO: 14166 - protein, 67 aa, Zea mays
  misc_feature: Ceres CLONE 1375558-F
MNMALRTQSALQLYARTPTLPPASFIALSMGRNPRSPMDGPGPPPSGLASATANLGVEDEHHVGIPL

SEQ ID NO: 14167 - DNA, 1035 bp, Zea mays
  misc_feature: Ceres CLONE 1375559-R
  misc_feature (1002)..(1002): n is a, c, t, g, unknown, or other
ggtccggcgcccccctcgaggtcgacggtatcgataagcttttttttttttttttttggaaatgtaactacttatttctggtaggccacatacatcatccaaaaaactttattattgaattacaactaatcagcaatctaaaagagggcaccaccaatgatgtgttgttggtaagaagctgctgggtttgtcaaaacaacttcgacaaaggtcaacaatttttttatttttaagagggttgcgggggtagccacaaaatgctggtataaaagcccaactgttgctttgtcgggaaagaagaactgcttgcttctgctagatcgcttaatggtaataggatttgcctactgcaaataaacaacaggggttcagtgcgggtcaattagttaaatgtaagaaaattcccccccccggagaggtagggcgtggctccgctggcgggaaatggtaataaacgtgttcgctcccccacaaaacagacccaatttcaaatggaagaaaaaggtgcgttggaactggagggaaaatttgttggtttcgctgcagagatcatggcatataaattgtgttggtgccgcacaccctcctttgtatttgtattccaccagcgttgtcgtgcaaaatttgaattggcgacatgtggtctgttagcccccccggcatttgcggtttctgttcgcccccgccagggacgagttgtggccgaagagtatcaaccggccctcgggcggaaatttgttttgtataaataaatagttgtgaatcaaaaaagtgaattgtcgtggccttggccttgtgaccattgtttcttttcttgtggagccccctctattagagtgttggaaaaacacgccctgacgaatcctctcatcactgccctggtgcccctcgctgtttgtgtaatgcagacttccattgtctgtgggataaaaagggaattgttcttatagcaatcccgtggcgacatttatattaataatataaaatctgttttgactgttnctcctcaacttattgctatcgatactgtgtggg

SEQ ID NO: 14168 - DNA, 704 bp, Zea mays
  misc_feature: Ceres CLONE 1375559-F
  misc_feature: Translation starting site: 179
  misc_feature: SWISSPROT Homolog: EC 6.3.2.19 Ubiquitin--protein ligase
cgcggtggcggccgctctagaactagtggatcccccgggctgcaggaattcgcacgagaccattacctagaacatcctaatcgaaaacttagctgctctcgcccccttatctacagcaggtcctccggtggtgttgaactactcctcccaccctaaatcctaaccctggttctttgccatggcgagcagcgctacctcccggagcctcctgctccacaagcagcttcaggatcttgcgaacaagcccggggatgggtgctccgacgatcttggaaacgacagcaacatcttccagcggcaggcctgcactcatcccaccgcctgacaccctatatgatggaggctactgcattggaatactggccttcccccagaactatcccaacagaccgtcatcatgaagatttacttctgatatgaggcatcctaatggatatcctgaaggacgtggttgcatttctattcgtcctactcctgcagaagatcccagtggatatgagcttgccagcgaatgagggactccaatgcaccctccataaaagtatagttctgagcatcatttcgatgctctctagactcaatgacgagtctccagcgaatatacgagctgacatggattggagagaagagcgtcatgagttccagaacaaggtaaggcaatgtgacctcgaatctcatgacatgctctgaaggagaaacatatg

SEQ ID NO: 14169 - DNA, 694 bp, Zea mays
  misc_feature: Ceres CLONE 1375562-F
  misc_feature: SWISSPROT Homolog: EC 6.3.2.19 Ubiquitin--protein ligase
gaccattacctacaacatcctactcgaaaaagatctaggtgtctcccgcgctctgatctcatcttctgctcggtggtgtcccctcactctcacccatggattcccgggccgtggttattcacgtggggacttacttcctgcggaactactcatccccctgctagaacaaacccccggatgtcgcccaacaacctctacagctgaatcctgcaccatggttcgcagtcgacgacctcaccgtcaagagcgcggctgccaacaacatgacgcccatacacccacatcgtcatgtctttctaacttcgccccaatggccttcccccactgctatccctgcagacccatgtcgccaagattagttactgaaaggtgtcatcccaatgggtataccgagggaacggcctgcatttctaatcttccccgccgtgctgcacatgccccatgggtataaggttactttcgaacgaaggacaccacttgcctctctttgaaaaaaaaacttgtgagcaccgtctcgatggtctctagtccaaatgacgagcgcccacgtggatccatcatcctttggattgtaccagatccctgaggcatgatcccaggaaaagaactaggcaaagggggcccgcgaacctcaggagggggtctgagagagcaacattgttccgcgtcgccacaccgagcagttatgtctttc

SEQ ID NO: 14170 - DNA, 696 bp, Zea mays
  misc_feature: Ceres CLONE 1375563-F
  misc_feature: Encodes the peptide sequence at SEQ ID NO. 14171
ctattactagtggatcccccgggctgcaggaattcgcacgagaccattacctagaacatcctaatcgaaaagttccgcaccccacggcaggcgcttgagagtacttgactactaccctcccacctgcgagactgcaacgccgttgcttcaactcgactccagcatccctcgtccccgcatcaccgcgccgccgacactccgctcgctttcgctcccgagacccgggcctgccgagccgccgccatggacgaggagtacgacgtgatcgttctgggcacggggctcaaggagtgcatcctcagcggtctcctctctgtcgacggcctcaaggttctacacatggatagaaatgattactacggaggagattccacctccctaaacctgaaccagctctggaagaggtttaggggggaagacaagccaccggcacatctaggtgcaagcagagattacaatgtagacatggttccaaagtttatgatggcaaacgggactttggttcgcactctcattcacactgatgcgacaaaatatttgtcattcaaaggtgttgatggaagctatgtctttcagaaacggaagattcacaaggttcctgccaccgatatggaggctctaaaatctcctttgatggtcctatttgagaaacgaagagcagggaactttttttgttacgggccaaagtacaatgaa

SEQ ID NO: 14171 - protein, 151 aa, Zea mays
  misc_feature: Ceres CLONE 1375563-F
  misc_feature (1)..(151): Pfam Name: GDI Pfam Description: GDP dissociation inhibitor
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDATKYLSFKGVDGSYVFQKRKIHKVPATDMEALKSPLMVLFEKRRAGNFFCYGPKYNE

SEQ ID NO: 14172 - DNA, 703 bp, Zea mays
  misc_feature: Ceres CLONE 1375567-F
  misc_feature: Encodes the peptide sequence at SEQ ID NO. 14173
  misc_feature (480)..(480): n is a, c, t, g, unknown, or other
  misc_feature (481)..(481): n is a, c, t, g, unknown, or other
  misc_feature (494)..(494): n is a, c, t, g, unknown, or other
  misc_feature (495)..(495): n is a, c, t, g, unknown, or other
  misc_feature (515)..(515): n is a, c, t, g, unknown, or other
  misc_feature (524)..(524): n is a, c, t, g, unknown, or other
ggagctccccgcggtggcggccgctctagaactagtggatcccccgggctgcaggaattcgcacgagaccattacctagaacatcctaatcgaaaacgcaaacccctctcgatcgacacacgcagccgcgacccatcgcgacctgacccgaccctcccgaggccgccagccttatcctctccgcctccgcctcccgccgtcccctccgacccatcacaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaanngatgtaacgatgnngcgtacagtgcaagagaggntgagctggnagaccctgtggaaacattggagctaaattggtcagcaagctgcagctaagacaacgatcttgctggagatggacaccaacctctgtggtcttgctcagggctgattggtgaagggtggttagggcggggcagctggggctaatcctgtcaaattacctggggggattgaaaaacgctaa

SEQ ID NO: 14173 - protein, 112 aa, Zea mays
  misc_feature: Ceres CLONE 1375567-F
  misc_feature (82)..(82): Xaa is any aa, unknown, or other
  misc_feature (83)..(83): Xaa is any aa, unknown, or other
  misc_feature (87)..(87): Xaa is any aa, unknown, or other
  misc_feature (94)..(94): Xaa is any aa, unknown, or other
  misc_feature (97)..(97): Xaa is any aa, unknown, or other
MASTFGATSTVGLMAAPTGKNVRLQRRANFRVKAAKELYFNKDGSAIKKLQTGVNKLADLVGVTLGPKGRNVVLESKYGSPXXCNDXAYSAREXELXDPVETLELNWSASCS

SEQ ID NO: 14174 - DNA, 747 bp, Zea mays
  misc_feature: Ceres CLONE 1375575-F
  misc_feature: Encodes the peptide sequence at SEQ ID NO. 14175
  misc_feature (546)..(546): n is a, c, t, g, unknown, or other
  misc_feature (646)..(646): n is a, c, t, g, unknown, or other
  misc_feature (655)..(655): n is a, c, t, g, unknown, or other
tggagctccccgcggtggcggccgctctagaactagtggatcccccgggctgcaggaattcgcacgagaccattacctagaacatcctaatcgaaaaaattgaaaacagggccttggtcgagttaaaaaaaacgcgagtgaaacacactgacaccgcaaacacgccaaccggcctaccgccttcttctcttgtctcgtcctcctcgcgactatggccgccgccgccgaggtagaccccagccccaacccgccgccaactacagcctccggcctctccaagaccaagacgcgggaggccgaccgccgccgacgccgccgcagcaaggccaagaagaacaagtccgtcactgaggctgatgcccaggacgctgacgggggagcttccagctccgacgccaaggagaacgccgatcccaaccccgagccacaggttgaggtggagatagagtacgtgccggagaaggccgagcttgacgaccctctcctggatgatttcaaggccattcttcgagaagttcaccttcaaggacgctgctgcagcggcgngccgaggatgatataaaaagacgagggtgccgctgagccaaccaaagaaggggtcactgggatgatgatgaccaccgacgaagatgatgagcaggagganaacagaagnaaaggacggaggcctatccaataagaagaagaagctggaacgcaaggaatgaagattgcagacctcaacagatatgaacagactgggggggg

SEQ ID NO: 14175 - protein, 116 aa, Zea mays
  misc_feature: Ceres CLONE 1375575-F
  misc_feature (112)..(112): Xaa is any aa, unknown, or other
MAAAAEVDPSPNPPPTTASGLSKTKTREADRRRRRRSKAKKNKSVTEADAQDADGGASSSDAKENADPNPEPQVEVEIEYVPEKAELDDPLLDDFKAILREVHLQGRCCSGXPRMI

SEQ ID NO: 14176 - DNA, 528 bp, Zea mays
  misc_feature: Ceres CLONE 1375576-F
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (256)..(256): n is a, c, t, g, unknown, or other
  misc_feature (264)..(264): n is a, c, t, g, unknown, or other
  misc_feature (271)..(271): n is a, c, t, g, unknown, or other
  misc_feature (373)..(373): n is a, c, t, g, unknown, or other
  misc_feature (418)..(418): n is a, c, t, g, unknown, or other
  misc_feature (421)..(421): n is a, c, t, g, unknown, or other
ctccccgcgggtggcggccgctctagaactagtggatcccccgggctgcaggaattcgcacgagaccattacctagaacatcctaatcgaaaaaaaacttagccgcgtggacgcacaccagcacctgccctcctcgccgtcgccgcctccctccgcgcgaccgatctaccctccgccgccaccatgtcgctgatcgccggggaggacttccagcatatcctgcgtttgctgaacaccaacgnnntgggatgggggnaaggccangaaaagnaaatcccatttggggtttttccgggccccaattgggaacccctccaaaaattccaaaaaggggggggtggggtcccggggggggcccggcccccggcgcttnttccttttcccccaaaaacaatttcggcgttcccttttggggggncgnccaaaaaagggaaaaaaagggggggggccccccgggaaaacaatttcccgaacccttttggaaacaaagaggggccggcgaagctgaacgcctgatgaggctggacc

SEQ ID NO: 14177 - DNA, 730 bp, Zea mays
  misc_feature: Ceres CLONE 1375581-F
ccccgcggtggcggccgctctataactagtggatcccccgggctgcaggaattcccacgagaccattacctagaacatcctaatcgaaaactagcctctatctcattccactccgacattcacgagcagctgtcgggagtcaggccatggcgccggatctaagcgaactcgccgccgccgctgcagcccgtggcgcctacctcaccggcgtcagcgtcgcgagcctccccactgcctcctccctcccagtagacgactcctcctgcgcgcgacatcactcattggagagagacctccggcaaatgccgcctagcagctatgtgattgccgcgctgccacctataaccgactgctgcgcgctcacccccggggcggagcgccttcgaagtgtggcttcatacaaaaccccccaggccgaaggaccccaatccatcggccactcctgcgaagaaccattcactgccccccaagggaaaggacacgctctttgctgggaccatgctccactcaagcaccccaggccggccaccggaaatcccttttgcttccacaaaccccccttcttccacaccccgggaagggctcccccgcagaaccttggaatcccgctcccgccaccaaaacttggcgccggccagggggaccccatccagaaccgccgagggtcaagaaacttcttcacaccgttaattgggcagcccgccccccctcaatgccctgggctcacgcc

SEQ ID NO: 14178 - DNA, 698 bp, Zea mays
  misc_feature: Ceres CLONE 1375583-F
cgcggtggcggccgctctagaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacaaatcacaataataaaaaaaataataaaaactagtactacgcaatccagctttctccttataaagaaatcaatggataaatttaaaaaaagcagagcatcaaaccaagaagaaaaactgatgtcacgaacttgacagttgacttttcgcgcaaacaaacaaacaaacactacgtactgtgctctgcttatggatacatacatgcatactagtagctcatatatgcgtacaaaggcgccccgcaggcccaccttcgtgggcatctggaagaagcgtgcggtggagcagtactcgccgatcccgtacgtggcgacgctgctgaactgcatgatgtgggtgctgtacgggctgccgctgg

SEQ ID NO: 14179 - DNA, 758 bp, Zea mays
  misc_feature: Ceres CLONE 1375587-F
  misc_feature: Encodes the peptide sequence at SEQ ID NO. 14180
tccccgcggtggcggccgctctagaactagtggatcccccgggctgcaggaattcgcacgagaccattacctagaacatcctaatcgaaaacacaagcagcatccgcacactcccaattcccctcgagcgccgcagcgagcccaagaagccgaccgccgagccccctctccagtccagtccgcggtctcggtttcttgcttgcccggcgcccaatcttcagagagagctccttctcgtcgtctgtctccatggccgcctcgaccaagaccgtcgccgtcctcctcgccgcggtgctcctcgcgctggtcgcgtccgcggcagccagcaggaagctggaggaggacgcacttctgggaagcctggccccagcccccgcgccggccgttggcggtgccgcggggctgcctggcggtaagccgggggcgtgggccgtcgccggtctggtctctctcgtcgccttcctcgtgatcctgagggcgcgggcatctggctccgtattccgtgagatgggtggtacgactcctgctgatccggatcgcatatattacaggccaggcccgaaatgtcatggtccgttccggtttggtccaaaggcgccctccctttttgcctggtatacggacgggaaccctggattttttctttataatactaaacacacctctgtctttggccgttctcttctttaatgaccattctggtattccacgtctcgtgggtggggggccctaacagtggtaagattagtaaccttcat

SEQ ID NO: 14180 - protein, 146 aa, Zea mays
  misc_feature: Ceres CLONE 1375587-F
MAASTKTVAVLLAAVLLALVASAAASRKLEEDALLGSLAPAPAPAVGGAAGLPGGKPGAWAVAGLVSLVAFLVILRARASGSVFREMGGTTPADPDRIYYRPGPKCHGPFRFGPKAPSLFAWYTDGNPGFFLYNTKHTSVFGRSLL

SEQ ID NO: 14181 - DNA, 706 bp, Zea mays
  misc_feature: Ceres CLONE 1375588-F
  misc_feature: Encodes the peptide sequence at SEQ ID NO. 14182
  misc_feature (579)..(579): n is a, c, t, g, unknown, or other
ggcggccgctctagaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccggacggctatccgcgccatcggcaatggcaccgcccttgtgctcttcctctccccggtgtaagaatccatcgattctgcttctgcttgctattttttatctacaaatcgcaatactcaaaaaaatagtataaactagtactacgcaatccagctttctccttataaagaaatcaatggataaatttaaaaaaagcagagcatcaaaccaagaacaacaactgatgtcacgaacttgacagttgacttttcgcgcaaacaaacaaacaaacactacgtactgcgctctgcttatggatacatacatgcataccagcagctcatatatgcgtacaaatgcgccccgcangcccaccttcgtgggcatctggaagaagcgtgcggtggaacactactcgccgatcccgtacgaggcgacgctgctgaactgcatgatgtgggtgctgtacgggctgccgctggggcaccccacagaa

SEQ ID NO: 14182 - protein, 61 aa, Zea mays
  misc_feature: Ceres CLONE 1375588-F
  misc_feature (19)..(19): Xaa is any aa, unknown, or other
MDTYMHTSSSYMRTNAPRXPTFVGIWKKRAVEHYSPIPYEATLLNCMMWVLYGLPLGHPTE

SEQ ID NO: 14183 - DNA, 684 bp, Zea mays
  misc_feature: Ceres CLONE 1375592-F
tggcggccgctctagaactagtggatcccccgggctgcaggaattcgcacgagaccattacctagaacatcctaatcgaaaaaccagagagtcagagtgcggaggtgaacgtgacgtgacgctcctcctctataaaaggagacgcctgtgctgcagtgtgcacagcacagcccgtcgcgcgccgctgcgttgaggttgagccaaggcgcaatggcaacctccacctcagttcccgtcctcctgctcctcgccgccgccgccggcctcctcctgctccccggctcgctggcgtggcagagcagcaactgtgcaccgggcgcgcccggcagtggctcgccgacgtgcccttcacccggctccggctccggcggcggccacagcccgccccaccatagcaagccgcccaagcaccaccatggcaagccgcccaagtgcccgccgtgcacccctccgtacgtgcctccgacgcctcgcccgtcaccgccgtacgtgccaccatatgtcccgccgacgcctcggccatcaccaccaccgtacgtggcaccatacgtcccccgccccgccgaagccttcggccctcaccgccctaaggtgccaaccatacggtccccggcccccccaaagcctcggggcggccaccggccgtaagttcccccccaaggccccgggcccgccgaatttccg

SEQ ID NO: 14184 - DNA, 710 bp, Zea mays
  misc_feature: Ceres CLONE 1375593-F
  misc_feature: Pfam Name: DUF124 Pfam Description: Protein of unknown function DUF124
  misc_feature (482)..(482): n is a, c, t, g, unknown, or other
cgcggtggcggccgctctagaactagtggatcccccgggctgcaggaattcgcacgagaccattacctagaacatcctaatcgaaaagaattttcgaatttctagttcgtctgcgatccaatcgtgtgggggtgctctcgagaatcgttaaacctcgtcagaggttttgctttcacgacacgatggccgcaccgttcttctcaactccattccagccatatgtctaccaggtacgtgtgaacgcatgacccggccagttagtattcatgtgattatgtcatttgataacaattgtaatgcagagtcaacaagatacagtcacacctttccagattttgggtggtgaagctcaagttgttcagataatgttaaagtcagaggagagagtcattgctaagccaggttccatgtgttacatgtctgggtctgttgagatggagaatacatatactcctgaacaacaagttggagtcttacagtgnattttcggtaagagtgtaaccagcgttgttcttcggaatactgggccaaacgatgggtttgtgggtgttgctgcaccttatttcgctaggattctaccgattgatttagctatgtttggaggtgagatcttatgccagccagatgcattcctttgttcggtcagtgatgtgaaggttgtcaactctttttgacagagggcaaaaaacattgttgccgctgctgcataa

SEQ ID NO: 14185 - DNA, 706 bp, Zea mays
  misc_feature: Ceres CLONE 1375601-F
  misc_feature: Encodes the peptide sequence at SEQ ID NO. 14186
  misc_feature (409)..(409): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (511)..(511): n is a, c, t, g, unknown, or other
aagctggagctccccgcggtggcggccgctctagaactagtggatcccccgggctgcaggaattcgcacgagaccattacctagaacatcctaatcgaaaagcaaaaatctctgccgtgcctctcgtctctcttctcaggcgccacgcaaaacgttctccgttttccctctccggatccggcccgcgggggccaggagctaccgatgatccggaccgcaacggtgcgagcgcgtctcctcctatcgcgctcctacgtagcacaggcacaggcagcttctcgctggcctctcgtccgctggaaggcttcgcatcttggatctgtacgctctttctatcagatggacattacaaggcaatacaaaaataaaagtttgactgcaagaggggtgcatagctcccctgagagtncagaattttagcatgaaagctgtgttccatggcactctaaggatttagggtccatgtcagaagattctgctannnaagtgcttgaacaggtgaatggttggnaactgatcactgaaaggggtggtctggaattactagaacatggaaggggagaactttgttaaagggactgagtctttcagcttgtgctgcattgctgaggaaaagccacatccaacttcccctgttgtgggaaagggaaaattggggtttgctctttcgcaaggtaaaagaaaggttctcctgggggaaaaaatt

SEQ ID NO: 14186 - protein, 71 aa, Zea mays
  misc_feature: Ceres CLONE 1375601-F
  misc_feature (69)..(69): Xaa is any aa, unknown, or other
MIRTATVRARLLLSRSYVAQAQAASRWPLVRWKASHLGSVRSFYQMDITRQYKNKSLTARGVHSSPESXEF

SEQ ID NO: 14187 - DNA, 723 bp, Zea mays
  misc_feature: Ceres CLONE 1375604-F
  misc_feature: Encodes the peptide sequence at SEQ ID NO. 14188
  misc_feature (546)..(546): n is a, c, t, g, unknown, or other
  misc_feature (558)..(558): n is a, c, t, g, unknown, or other
  misc_feature (595)..(595): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaaaccggcttcctcctcctcctcctctcccctcccgattccttctctctcccgctaaatggatggacacgctactgcgccggatttctccccagccggttccttcggccacgcgaccgcgcgctcggaaaactccatggacagcgaaggaggcgaaccaagggcgacgtattcgccgccggagaaggtaagtgtcgatccgccgtgtcccgcgattcgtttgtcttgctccgagcggcgaacagcagtgggggtcgtcctcgcggatccgtcttcaagctttcgcggatccgccttcaagcttcgcggatcccacacgaaacctccgagttctctcgccaattcgatccgcctcaccgccgccgcccgtccgccggtcggccttgactgctccgtcgcacgtggcggttcgcagcacggaatctaccttgtgttgacagatccggngaaacccttggntcccggtcgttccggctcgaatcttctgcggactgcnaaatgtaagcgttctccattggaggggacacctaccccnnngcggtgnttggccaggtttgcggataggaagcaacctgtttccgcaggggaaaatttagcttggggaaaaaaaaaccggggaccggg

SEQ ID NO: 14188 - protein, 188 aa, Zea mays
  misc_feature: Ceres CLONE 1375604-F
  misc_feature (130)..(130): Xaa is any aa, unknown, or other
  misc_feature (134)..(134): Xaa is any aa, unknown, or other
  misc_feature (160)..(160): Xaa is any aa, unknown, or other
  misc_feature (162)..(162): Xaa is any aa, unknown, or other
MDGHATAPDFSPAGSFGHATARSENSMDSEGGEPRATYSPPEKVSVDPPCPAIRLSCSERRTAVGVVLADPSSSFRGSAFKLRGSHTKPPSSLANSIRLTAAARPPVGLDCSVARGGSQHGIYLVLTDPXKPLXPGRSGSNLLRTAKCKRSPLEGTPTPXRXLARFADRKQPVSAGENLAWGKKNRGP

SEQ ID NO: 14189 - DNA, 731 bp, Zea mays
  misc_feature: Ceres CLONE 1375609-F
cgcggtggcggccgctctagaactagtggatcccccgggctgcaggaattcgcacgagaccattacctagaacatcctaatcgaaaaagtctgcgcaccgccactcgtccacacgcgaaggcacctagcagccgccactcgccgaactgaggaacccgccgggcgacgggatacagcggcagcgcgcccctctatccccgacgcgacggcgccctgccgctgccgataagcctgccccaatgggcacacaaggatagggcgtggactaagagaacttctaggaagatgatccgatctactcaaggttgtggagagagccttactttggagaggaacccatatcagacgatgtgcagcttcacgatgtgaggaatgacatccgaggcagcctactatcccccatgccatgcagagaatcctctgagatggggcttgattctcacacctgtcggcggctgtggagatgttgtcgcccgaaaggagcttcacctagccccctgggcccccgcgggatatgggggagttccacggtcaaggaacgcacttcgccttggacagtccaaaggtacgtggcggcccctcacgcacctcgtgcaaactcgttaaagaagacctgctattaaccctcggggtgggcgggggaaacaacactcccccatggcaacgcggagggtgtaccacctccgcctcacgggtgggccggggcacaccccacctcctcccgcttactt

SEQ ID NO: 14190 - DNA, 742 bp, Zea mays
  misc_feature: Ceres CLONE 1375612-F
  misc_feature: Translation starting site: 176
  misc_feature: Pfam Name: Ribosomal_L13e Pfam Description: Ribosomal protein L13e
tccccgcggtggcggccgctctagtactagtggatcccccgggctgcaggaattcgcacgagaccattacctagaacatcctaatcgaaaattccacttcacagcctctccgcctccgctcctcgcgccgccgccgcgtctcctcctgtacaggtaaggagaggaagagggcgaaatggtgaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattggtcaatgccagactttaaaggacggggtggagggcaggtcctgctagaggttttacccttgacgagctgaaggctgctggcatcccaaagaagcttgctccaaccattggtatttcctgctgatcaccgcccgcaataacaaatccttttgagggaccgcatggccaatgttccaaaggcttaacaacatacaaggccacgctggttaatccttccccaaggggtggcacaccatgtttaagggctcgcggacttccactcccaaagcaactttgcccccgcctcccccgggtccaggggcggcctcactgtgccattctaacccgggtcggacaaaactgctccaatcgggtgttgcgccacggcccccgcaacgagaacgccaacaacttttg

SEQ ID NO: 14191 - DNA, 771 bp, Zea mays
  misc_feature: Ceres CLONE 1375626-F
  misc_feature: Encodes the peptide sequence at SEQ ID NO. 14192
  misc_feature (31)..(31): n is a, c, t, g, unknown, or other
aagctggagctccccgcggtggcggccgctncatactagaggatcccccgggctgcaggaattcccacgagaccattacctagaacatcctaatcgaaaacaatcatcagcgggatgtgctccggctcgagtgcgcacgtggggtacctagctcggtctgctagtctaccatggatgatcacccccggtgcgcgacgggaggtgccgccggctacggcgacctccagcgcgcgggcggcatgcacggtgaggcgcagcggcagcacaagccggtcgccatgatgacggcgctcagagccgcgacggccgcgaccttcggcggctcgatgctggtgctgtccggtgtgatcctggccggttctgtgatcgagctcacggcggccacccccgtgctggtgatcttcaacccagcgccccagccggacgacatcgcgctggaggtcaaggcggcccgggatcgtcacctccgcccgtgatcggcagacactgccctgcccgagactctcctggatgcacaaagcacctgacgggcgaacatccggcggagcgcccaaccagtttggaccagggcaaggggcaacgctggccacccaatggcccggcgtcgaccgacgggatgtcgcaagcagccacccgcatcgaacttgggttgctctgggtactccgaagaaaacacaagcccgaacgtccaagcggagatcctgcggaggggctggctctttctctggtatggccgttgccaccgccggcgcgagcgtaaataacgggggc

SEQ ID NO: 14192 - protein, 101 aa, Zea mays
  misc_feature: Ceres CLONE 1375626-F
MDDHPRCATGGAAGYGDLQRAGGMHGEAQRQHKPVAMMTALRAATAATFGGSMLVLSGVILAGSVIELTAATPVLVIFNPAPQPDDIALEVKAARDRHLRP

SEQ ID NO: 14193 - DNA, 709 bp, Zea mays
  misc_feature: Ceres CLONE 1375630-F
  misc_feature: Encodes the peptide sequence at SEQ ID NO. 14194
  misc_feature (687)..(687): n is a, c, t, g, unknown, or other
  misc_feature (704)..(704): n is a, c, t, g, unknown, or other
cgcggtggcggccgctctagaactagtggatcccccgggctgcaggaattcgcacgagaccattacctagaacatcctaatcgaaaaatcggcattcagcagccacctcttaccaccccaacgtgatggcggtgagcaacaacatcacggcatgcgtgacgctgctggcgctgatctgcgcggtgcccgtgatcgcgtcgggggtgtggttcgcgtcggcgcagggcgaggagtgcgcgcgcctggcgcggtggcccgtggccatcctgggcgggctgctcctgctggccgcgctggcgggcttcgtgggcgcgtactggaaccggcgcggcctgctggccttctacctcttcgccatggcgtcgctcgtggtgctcctcatcgcgctcctcgccttcgccttcgccgtcacccgcgggtccggcgcctaccccgtgctcggccgcgcctacgacgactaccgcctcgacggcttctccatgtggctccgcgggtacgtctccgacgaccccgggcgctgggacaaggtcagggcctgcctcgccgtctccgacacctgcaagaagctcgcgcgccaggccgccttcaccagcgcagaccagttctatcagtcgcacctctccccgctccagtccgggtgctgcaagccgccgtcggtgtgcgggttcagctacgtgagccccacgntgtggtcccgccccggncgcgc

SEQ ID NO: 14194 - protein, 194 aa, Zea mays
  misc_feature: Ceres CLONE 1375630-F
  misc_feature (3)..(189): Pfam Name: Tetraspannin Pfam Description: Tetraspanin family
  misc_feature (188)..(188): Xaa is any aa, unknown, or other
MAVSNNITACVTLLALICAVPVIASGVWFASAQGEECARLARWPVAILGGLLLLAALAGFVGAYWNRRGLLAFYLFAMASLVVLLIALLAFAFAVTRGSGAYPVLGRAYDDYRLDGFSMWLRGYVSDDPGRWDKVRACLAVSDTCKKLARQAAFTSADQFYQSHLSPLQSGCCKPPSVCGFSYVSPTXWSRPGR

SEQ ID NO: 14195 - DNA, 679 bp, Zea mays
  misc_feature: Ceres CLONE 1375651-F
  misc_feature: Encodes the peptide sequence at SEQ ID NO. 14196
agagctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaacgggctctgggcttggt

SEQ ID NO: 14196 - protein, 150 aa, Zea mays
  misc_feature: Ceres CLONE 1375651-F
  misc_feature (49)..(150): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLG

SEQ ID NO: 14197 - DNA, 689 bp, Zea mays
  misc_feature: Ceres CLONE 1375662-F
  misc_feature (501)..(501): n is a, c, t, g, unknown, or other
agagctggagctccccgcggtggcggccgctctagaactagtggatcccccgggctgcaggaattcgcacgagaccattacctagaacatcataatcgaaaaattaaccgcctctccctcgctcctctcgctcgctcggctcactccctctccaaagcggcagcctcacgcagtcacgcgctccaccacgccacctccctctactcactcatgttgttttccgtccatccgcccaccggttcgtagcccgcgccgcaaaaccctagccccgggaggatcgcggggcgcctccgcggtgccagcgacgtggctcgtttgatccgattgctggtcgagccccgcccctcgctgccgcgcttcgctccggctgtgcagcggcgtgagcaccgagcacactcgcgaatggggaactgctagggtgcttggatcaaggatgggagccctcaccctgggggctcaggttcgtccatcctatcctagccggtgcttggtaccgttggntcatggggtgatgcgatgagggttttccggggatcgggcttggctagttgcgctctacgggcaggggggaggggggtttgaaatgggaaaattcccggctcggtggctacttggtccgggaaacatggatccttttgcgaaaaggaaggggaaccccgtcctggggggatggggtttcccccgggggg

SEQ ID NO: 14198 - DNA, 704 bp, Zea mays
  misc_feature: Ceres CLONE 1375663-F
  misc_feature: Encodes the peptide sequence at SEQ ID NO. 14199
  misc_feature (425)..(425): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (453)..(453): n is a, c, t, g, unknown, or other
aaagctggagctccccgcggtggcggccgctctagaactagtggatcccccgggctgcaggaattcgcacgagaccattacctagaacatcctaatcgaaaaatctcgcaataccaaccttccggatccagtgccgcacgcctcactccccgtccccgacacccatgacacgcaagaggcggaagcacgccgccgccgccgccgccgcctagggttccgatcccttcctcatggattcgctgccgcggaagcgcaagggcgcgcgcgccgcgtgctccctggccggatcccgccacgatgcgcctgccgcccgcaagcgcacctgccgcgagcccaagccgcggcccgagaagaagaagccctcttccgccgatgagggctccgcctccgtccgcggcgcgtgttatttgagggggcgcccgccnccaacgnnnnggcgcgcaaactgaaaanccccggccggcggggataaaccggcaaaacggtatacacgggacatacgaccactccaattcggcggggacagaactacttcccccgccgaaagttaacctttgggccccacttaggcccacacgcgagcccctccgggcgaggacaccatccgcaccaacggcactctgggcactatgcggggccccacaataaatttggtataaaaaatctgaatcataccactggccgcctctgagtggagttttcca

SEQ ID NO: 14199 - protein, 72 aa, Zea mays
  misc_feature: Ceres CLONE 1375663-F
  misc_feature (68)..(68): Xaa is any aa, unknown, or other
  misc_feature (69)..(69): Xaa is any aa, unknown, or other
MDSLPRKRKGARAACSLAGSRHDAPAARKRTCREPKPRPEKKKPSSADEGSASVRGACYLRGRPPPTXXRAN

SEQ ID NO: 14200 - DNA, 594 bp, Zea mays
  misc_feature: Ceres CLONE 1375669-F
  misc_feature (370)..(370): n is a, c, t, g, unknown, or other
agagctggagctccccgcggtggcggccgctctagaactagtggatcccccgggctgcaggaattcgcacgagaccattacctagaacatcctaatcgaaaagtaccacgttcaaaacggcaagtcgatcgatctgaaaccacagatcgatcgacgaccagcagaagacgacgtacgtgaaaccgcgagacagtgcgaggacgactggggtgtggcggtgcgatccatcgacaaggccatgggacaacggcgctttgaggacgaacgcgcagctctggcgactgtggcaagcttgctgctcatcctaacgacagcccaagctgctgctgctgctgcttctggacgccatctgtctttgcccacgcagaangcggcggcggcgcgcatgaacgacaccagtagtagtgacatgcaggtcatcacacccgcgccactcgctatctcgacggcggctcgaatggggcccggacgggtgctccgggggaggacgtggcggtgtaccagacagcgccaccctctgcccaggggatcccgggctacacggggggatcatcaacgtctggaggggggggtggcacggtctacgacgtccac

SEQ ID NO: 14201 - DNA, 933 bp, Zea mays
  misc_feature: Ceres CLONE 1375670-F
  misc_feature: Encodes the peptide sequence at SEQ ID NO. 14202
  misc_feature (13)..(13): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
ccccccccccccngccgcccgcgggccnnnnccccggncnnncccagagctggagctccccgcggtggcggccgctctagaactagtggatcccccgggctgcaggaattcgcacgagaccattacctagaacatcctaatcgaaaaaaatagaaaaatctcctgcctccgcggccgtgccgagccggcatcccctcccgtcccccacccccagcagcgatcgcgacgacccgagccggcaagggtgacaggcggctgacgagccccatgggagacaacaagtctccgctgagcctgagcccgatgggcgggcgcgaccgggaccgggagctcctcatcccgggctcggacggaggctcggagcccggcgatggggggaaggaaggggacaggagcctcctccgcctcgggcggcgctatcctacgtccggccggggagactacccaataggcggggccccaccccggggggcgtgcaagcaagctccttcgccggccatggcggaatctccccttacgcccagagggaacaacccacgcgtccggtcgcgccccgcgggggcggccataaaggccgtgccgcggagagcgttctcccggcgtcggagatagagtggccgacggaggcggcggacaacacactcattactctgagctctttcgcccgacctgactcaaccgcgcggcggccgctgcgcagcacgggagtagggagcgggacgagcacaccgcaacgggacgagtgcatggcgccgtagccgcgcagtgaaaatgctccttccacgctcgtttgacccctggcaattaccgactctcagcatgccacgtgcgcgatctgatgctcgcaccagacgtacaccgcgccgcgcagcatgcggtgcaccagacgcgcgaccgaacggctcatcacagcgagggcccgcggccctccgg

SEQ ID NO: 14202 - protein, 114 aa, Zea mays
  misc_feature: Ceres CLONE 1375670-F
MGDNKSPLSLSPMGGRDRDRELLIPGSDGGSEPGDGGKEGDRSLLRLGRRYPTSGRGDYPIGGAPPRGACKQAPSPAMAESPLTPRGNNPRVRSRPAGAAIKAVPRRAFSRRRR

SEQ ID NO: 14203 - DNA, 608 bp, Zea mays
  misc_feature: Ceres CLONE 1375676-F
  misc_feature: Encodes the peptide sequence at SEQ ID NO. 14204
  misc_feature (207)..(207): n is a, c, t, g, unknown, or other
  misc_feature (282)..(282): n is a, c, t, g, unknown, or other
  misc_feature (313)..(313): n is a, c, t, g, unknown, or other
  misc_feature (376)..(376): n is a, c, t, g, unknown, or other
  misc_feature (378)..(378): n is a, c, t, g, unknown, or other
  misc_feature (381)..(381): n is a, c, t, g, unknown, or other
  misc_feature (482)..(482): n is a, c, t, g, unknown, or other
aaagtggagtccaccgcggggcggcgctctagaactagtggatcccccgggctgaggaatcgcacgagaccattacctagaacatcctaatcgaaaactccactcctcctcctctctctctccacatttcctctcccgataagagtgaggcctcggctaagcttgagcttcccctccctccctccagcgctccagtccctcctcctncggcaaaatctgcggcgagctcgatccggtccgatactaaccacgccgcagagccgcgcgacctgatcgcgcggnggtcgaggagagggaaagcgcgcgccgcggntgcctgccaccgtaccccgcgcagagaaggaaagagagcccgtatccctccgccccggtgccngncgnaccgatggactccgagcactggatctcgccgctgggccgcgcgaagcgcttctacgccgggcagctcggccacagcgatcggggccggatggacgacctgnaaatggaccaaggagccaaggccgaagttcccctgcccctactggtacaagggaccacgaagtttgaatccctctgggcggaccctggaggaaggacaacccgttttaaaccccaagccgggggcc

SEQ ID NO: 14204 - protein, 74 aa, Zea mays
  misc_feature: Ceres CLONE 1375676-F
  misc_feature (33)..(33): Xaa is any aa, unknown, or other
MDSEHWISPLGRAKRFYAGQLGHSDRGRMDDLXMDQGAKAEVPLPLLVQGTTKFESLWADPGGRTTRFKPQAGG

SEQ ID NO: 14205 - DNA, 688 bp, Zea mays
  misc_feature: Ceres CLONE 1375677-F
  misc_feature: Encodes the peptide sequence at SEQ ID NO. 14206
aaagctggagctccccgcggtggcggccgctctagaactagtggatcccccgggctgcaggaattcgcacgagaccattacctagaacatcctaatcgaaaaaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgcccggtccatgtgccgccgccggttcatctgccgccgccaccatgccactaccctactcaaacgccccggccttagcctcatccccaggcacacccatgcccgtgccacaaccgcatccaagccccgtgccagctgcagggaaactgcggcgtttgcagcaaccccgatcctggggccaggggggccaagtttcctgaggcattcatggcaaccccgaagggggagcccctatgggttcgccctcatggccagtccgttccggacagcaagttttgcccagcaagcttcgggcaggggggggccccacacacccg

SEQ ID NO: 14206 - protein, 133 aa, Zea mays
  misc_feature: Ceres CLONE 1375677-F
MRVLLVALALLALAASATSTHTSGGCGCQPPPPVHLPPPVHLPPPVHLPPPVHLPPPVHLPPPVHLPPPGPCAAAGSSAAATMPLPYSNAPALASSPGTPMPVPQPHPSPVPAAGKLRRLQQPRSWGQGGQVS

SEQ ID NO: 14207 - DNA, 632 bp, Zea mays
  misc_feature: Ceres CLONE 1375684-F
  misc_feature (51)..(51): n is a, c, t, g, unknown, or other
  misc_feature (265)..(265): n is a, c, t, g, unknown, or other
  misc_feature (297)..(297): n is a, c, t, g, unknown, or other
  misc_feature (304)..(304): n is a, c, t, g, unknown, or other
  misc_feature (305)..(305): n is a, c, t, g, unknown, or other
  misc_feature (347)..(347): n is a, c, t, g, unknown, or other
  misc_feature (367)..(367): n is a, c, t, g, unknown, or other
  misc_feature (387)..(387): n is a, c, t, g, unknown, or other
  misc_feature (388)..(388): n is a, c, t, g, unknown, or other
  misc_feature (392)..(392): n is a, c, t, g, unknown, or other
  misc_feature (415)..(415): n is a, c, t, g, unknown, or other
aaagctggagtccccgcggtggcggccgctctagaactagtggatcccccngggctgcaggaattcgcacgagaccattacctagaacatcctaatcgaaaaatccaggcagcacagctccctccccactcgaggctccgagctttattttttcttgttttgtttgttttcttggtaggagtaacaatagtttctggcagccttcttctcctcgctctctaccgaggagagaggagagagagaaatccggaggcaagcttcaggnttgtataagggatctagatctatcgactaccngagagannaaaaccaaaattacgcgagaagcatgagccactcgccgccgnccgcgtgagagccccctcgncgtgccgcgcccgccgccgnngagnccagagccgttctcttgcccagncggggggccccgggggcccttgggtggcaccagggggcaacccggaatgaatttgctcaactcctctggaaaagccaggtttaagggtgttaaaggggcccctgacccccttttttgggggaaaaaaaaagggccccaaccctaggggcgcttttaagggcaccctttgggaaaaaaaattgttggggggcgcgaattttaaccccctcctcccatt

SEQ ID NO: 14208 - DNA, 614 bp, Zea mays
  misc_feature: Ceres CLONE 1375690-F
  misc_feature: Encodes the peptide sequence at SEQ ID NO. 14209
  misc_feature (266)..(266): n is a, c, t, g, unknown, or other
  misc_feature (364)..(364): n is a, c, t, g, unknown, or other
agagctggagctccccgcggtggcggccgctctagaactagtggatcccccgggctgcaggaattcgcacgagaccattaccagaacatcctaatcgaaaaaccatttcgctagctccatagcacttgttccagctagctaggagagagagctttgtttaggcggcggcaagatgaacaggaagccaggagactgggactgcagggcgtgccagcacctcaacttcagccgtcgggatgcatgccagcgctgcagtgaaccacgtnggagtggtgatcgtagcggcggtggtggcgacttgggtgggcgtggtggttcctccttcggcggtggctttggtgctggctctgatgtccccccctgntgactgggactggtgctgcgggcacacaacttcggcagccgctccactggctcaggggctcttgccacaaggaggaggctgcccggcccctttaaaagggaatgtcaccgtccccggttaacccggtttcggaggggggttcccccctacaaccccccgggttgaaattggggactgggtcccccccaggcccggtgaaaggacacacttccctaagaagagagaagttttctgggcccccccccccccc

SEQ ID NO: 14209 - protein, 63 aa, Zea mays
  misc_feature: Ceres CLONE 1375690-F
  misc_feature (4)..(33): Pfam Name: zf-RanBP Pfam Description: Zn-finger in Ran binding protein and others
  misc_feature (32)..(32): Xaa is any aa, unknown, or other
MNRKPGDWDCRACQHLNFSRRDACQRCSEPRXSGDRSGGGGDLGGRGGSSFGGGFGAGSDVPP

SEQ ID NO: 14210 - DNA, 680 bp, Zea mays
  misc_feature: Ceres CLONE 1375703-F
  misc_feature: Encodes the peptide sequence at SEQ ID NO. 14211
  misc_feature (204)..(204): n is a, c, t, g, unknown, or other
  misc_feature (205)..(205): n is a, c, t, g, unknown, or other
  misc_feature (207)..(207): n is a, c, t, g, unknown, or other
  misc_feature (209)..(209): n is a, c, t, g, unknown, or other
  misc_feature (210)..(210): n is a, c, t, g, unknown, or other
  misc_feature (216)..(216): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (382)..(382): n is a, c, t, g, unknown, or other
aaagctggagctccccgcggtggcggccgctctagaactagtggatcccccgggctgcaggaattcgcacgagaccatacctagaacatcctaatcggaactccaaagtttcgtccaccatttcgctcccgcaagcaccgatttgtttactgctctctccgacgcgcggcggcggagctccctacgacgactggaaccatgggnntngnncggggncgggcnnnncgaatccttgccaaccttcgcgagccggcgccgcgccggctcacagagcgggacatctggcagcagaaaaagaagctcaagaggggcggcggcggcgggaggcgctcgttcgcggcggaggacgatgaggacttcgaggccgactttgaggtcttcnaggccgactggagtgattcagatttggagctcagggaggggactgacgacgacgtcgtcgagatcaagcccttcactggcaagaggactttctccagcgatggcttaggcaccatgactagtgctgtagcaaggtcagccaagaaggagagaaagaatctatacggggggaatccgccagggggccttgggggcaagggggtctgctgaaaatcaaagaaccctcaaaggggggggcccgggttttgggtttggaaccttttcaataacccccgggggaaagtttgcaaaaggcttat

SEQ ID NO: 14211 - protein, 130 aa, Zea mays
  misc_feature: Ceres CLONE 1375703-F
  misc_feature (3)..(3): Xaa is any aa, unknown, or other
  misc_feature (4)..(4): Xaa is any aa, unknown, or other
  misc_feature (9)..(9): Xaa is any aa, unknown, or other
  misc_feature (62)..(62): Xaa is any aa, unknown, or other
MGXXRGRAXRILANLREPAPRRLTERDIWQQKKKLKRGGGGGRRSFAAEDDEDFEADFEVFXADWSDSDLELREGTDDDVVEIKPFTGKRTFSSDGLGTMTSAVARSAKKERKNLYGGNPPGGLGGKGVC

SEQ ID NO: 14212 - DNA, 667 bp, Zea mays
  misc_feature: Ceres CLONE 1375707-F
  misc_feature: Encodes the peptide sequence at SEQ ID NO. 14213
  misc_feature (435)..(435): n is a, c, t, g, unknown, or other
  misc_feature (436)..(436): n is a, c, t, g, unknown, or other
  misc_feature (439)..(439): n is a, c, t, g, unknown, or other
  misc_feature (448)..(448): n is a, c, t, g, unknown, or other
agagctggagctccccgcggtggcggccgctctagaactagtggatcccccgggctgcaggaattcgcacgagaccattacctagaacatcctaatcgaaaaaaaaccccctcaaaatcctccgaaccccgccgccgacgagcgagctatggcgctggcgcggcggctgctccgccttactccctacctcggcacgctctcgctcccaccccccaactcgcatctcctccggaatcgcacctatatctctgacatgcgccgctctgccttcgtcgaccgcttgctccgttccgtacgctccgagatctccttcctcgataactccgccccgccaccgccaccaccgcctcctaagccattcaccattgaggaccgcccgggcgagcagtgggcccgcctgcgccgcgtgtcctgcgggcccgaagggggaggaannagnaggtcaggntggacgccacgttggtcgacggcgcgctccctccctcccgctcgggcgcggacacgggcggcccgcccagaatgcatatcagtggtaaggttgaggtctccaaggccgcgcggcctggagtggcgctcaccttcgagtgctccgcgtggcctgaccagatggaggggcgagggggcttttccgtccgccggggggggcctgccccagggcagcagtacg

SEQ ID NO: 14213 - protein, 49 aa, Zea mays
  misc_feature: Ceres CLONE 1375707-F
MHISGKVEVSKAARPGVALTFECSAWPDQMEGRGGFSVRRGGPAPGQQY

SEQ ID NO: 14214 - DNA, 674 bp, Zea mays
  misc_feature: Ceres CLONE 1375708-F
  misc_feature: Translation starting site: 248
agagctggagctccccgcggtggcggccgctctagaactagtggatcccccgggctgcaggaattcgcacgagaccatacctagaacatcctaatcgaaaagtctcaggatgcggtcgaaccagagccccgtcccaactccaccacctctcttctctacagcgcgagcaagggcggcgtcggtcgcggtgtcggcgggaaccgggcctcgctctccccatctctccgatcacttctgtcctgtgaaaatggcgtatgaactacgctcaacgtctgtgggtcagaagttccatgggcaggccgtgctgttgagcagaatctcttcctattccgccatgaacaaccctgtattcaacaatgcctattctgcttacaatgtgcgcgcagaggtcatatcatgggatgaatgcagctgctggactctcatctggcatggaaccatctcctggctttgcttctgccccataagagaaaggcttttctggagttatgatcgactttatgatgggtggagtttctgctgctgtctccaagacagctgcagctccgattgagcgtgccaagcttttcattcagaaccaggatgagatgctcaagactggtatgatttctgagccgtacaagggtattgatcactgctttgagcggtacatcagagatgaggggtttgtctca

SEQ ID NO: 14215 - DNA, 680 bp, Zea mays
  misc_feature: Ceres CLONE 1375712-F
  misc_feature: Encodes the peptide sequence at SEQ ID NO. 14216
aaagctggagctccccgcggtggcggccgctctagaactagtggatcccccgggctgcaggaattcgcacgagaccattacctagaacatcctaatcgaaaagggaaaatcataggttctccacgacgcggccatctccgccaccgccagcgccacctgctagggtcaacacccgctctctgcggactgcgtgaagcaccagcggcggccaccgggcaggacgagccccctccccaaacagagaggggcggggatcagtgcgtgcgctcctggtggagggcgtggaagagcttggcaggcggcaagcaggggtttgggaggatggtttcgctctcgacttggttccgctatgccgcacaaaagttcgagtactgcgtttccctctcgttgaagaaatataatgacgtgggccggatcagcagcacacagctaactgatgtgttaaacaaaaatttattccaaggcaagctcacctacgtgtgtccgaccaaaggggaagaagccatggctcccatcgcatctccgactggaggagccgtccttgtcagaaaactcgcaaatttgagccccacgcaagtgtttgtcgggggacgttgtgttgttaaaagacccagagggatctgatgatttaattattcggacgacggggtggcttggaagggtatgagagggtctctaag

SEQ ID NO: 14216 - protein, 100 aa, Zea mays
  misc_feature: Ceres CLONE 1375712-F
MVSLSTWFRYAAQKFEYCVSLSLKKYNDVGRISSTQLTDVLNKNLFQGKLTYVCPTKGEEAMAPIASPTGGAVLVRKLANLSPTQVFVGGRCVVKRPRGI

SEQ ID NO: 14217 - DNA, 638 bp, Zea mays
  misc_feature: Ceres CLONE 1375715-F
  misc_feature: Translation starting site: 451
  misc_feature: SWISSPROT Homolog: EC 2.4.1.207 Xyloglucan:xyloglucosyl transferase
  misc_feature (361)..(361): n is a, c, t, g, unknown, or other
  misc_feature (362)..(362): n is a, c, t, g, unknown, or other
  misc_feature (369)..(369): n is a, c, t, g, unknown, or other
  misc_feature (473)..(473): n is a, c, t, g, unknown, or other
  misc_feature (481)..(481): n is a, c, t, g, unknown, or other
aaagctggagctccccgcggtggcggccgctctagaactagtggatcccccgggctgcaggaattcgcacgagaccattacctagaacatcctaatcgaaaaacaagctcgatcaccaacccagctcggtcgtcccagctgatcaggtcgagcaccttgcgacctgctcgatcatcagtgtagagtgtctgtaggtgtctgtctctcttggtggctggttgcaacggtcatggcgacgtcgtctcgtcgggtgcccttgctgctgctggtcctgggcgtgctggtgtcgtgctccttcgcggcgggcagcttggacaggagctggacatcacgtggggcgacgggcggggcaaggtcctgnnacacggncggctgctgacgctgtcgctggaccgcacgtccggctccgggttccagtcccggcacgagtacctggtcgggcagatcgacatgcagctgcggctggtgccggncaactccngcggcaccggtcacggctactacctgtcgtcgcaggggggggcgcacgacgagatcgacttccaggtccctgggcaacgtggtcgggcaagccctacacgctgcacaccaacgggttcacgcgggggcaggggcagcgggagcaccagttccccctt

SEQ ID NO: 14218 - DNA, 657 bp, Zea mays
  misc_feature: Ceres CLONE 1375716-F
  misc_feature: Encodes the peptide sequence at SEQ ID NO. 14219
  misc_feature (416)..(416): n is a, c, t, g, unknown, or other
  misc_feature (487)..(487): n is a, c, t, g, unknown, or other
aaagctggagctccccgcggtggcggccgctctagaactagtggatcccccgggctgcaggaattccacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacgggggggaggccccgcggaagagggaatgcgagagcgagtgccgcnagcggcacagcaaggtgacgcggggcgaggacggcgacaggcgcgtggacgcctacgtctcccgctccggnagggggggagtggcggcgcccagtgcctgcgccgccacgagggcccaggcgtgggaaaacccaggagtgcatggagggggttcccgccgccgcggactggccgtcgacatgggggaaggagtacggtcgcggcagcgagaggcgcggcaagggccccggaaagaggggcg

SEQ ID NO: 14219 - protein, 148 aa, Zea mays
  misc_feature: Ceres CLONE 1375716-F
  misc_feature (69)..(69): Xaa is any aa, unknown, or other
MGKGSVGASWWAFLLLAGVLLVVAATAGAEDGVVERDRKEDLRWCKQACEWQYGGEAPRKRECESECRXRHSKVTRGEDGDRRVDAYVSRSGRGGVAAPSACAATRAQAWENPGVHGGGSRRRGLAVDMGEGVRSRQREARQGPRKEG

SEQ ID NO: 14220 - DNA, 812 bp, Zea mays
  misc_feature: Ceres CLONE 1375717-F
  misc_feature: Encodes the peptide sequence at SEQ ID NO. 14221
  misc_feature (27)..(27): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
gggtttccccccccccccccccccccnannnnaannnnnnntttnnnnnntcaaagctggagctccccgcggtggcggccgctctagaactagtggatcccccgggctgcaggaattcgcacgagaccattacctagaacatcctaatcgaaaacgaaaaattcgtttgcttttcgtcttcgtcctctctttgcccagttgtcggtcgcccgcgccgtcgtctccgctccgccggccttcctgcgaaaccctagcgaggcgagcgagagagaaactagcggccatgttcggctacaggaaggctgacccggacctcgaggccggcgggtcctcgctgctgtaccccggaatgacggagagccccgagctgcggggggcgttcgtcggcagatctacggcatcctagccgtccagttcgccatggggggggggggtctccggccttcgtccgtcaagggggcccgcccgcttccaactttctttcgtgctcccccaaaggccggggggcggacatttcaaaatgctgccccgatcattcctggcgctttcccccggggttgggggcccttctgggggttattaaccccccaaaaagcatcccgggggagaacttggggggggggctccgggctctttttacgcgggagcccatttaaattttttgccgcggggggaaggggcaggggcgccttctccctaaggggggaaaagaattttttttgggggggggttgggcgtttttatagggggggagggggggggggggaaaacgggtttaaagggggggccacccttttgtgcggggggggagg

SEQ ID NO: 14221 - protein, 40 aa, Zea mays
  misc_feature: Ceres CLONE 1375717-F
MFGYRKADPDLEAGGSSLLYPGMTESPELRGAFVGRSTAS

SEQ ID NO: 14222 - DNA, 682 bp, Zea mays
  misc_feature: Ceres CLONE 1375720-F
  misc_feature: Translation starting site: 216
  misc_feature: Pfam Name: DUF866 Pfam Description: Eukaryotic protein of unknown function (DUF866)
  misc_feature (339)..(339): n is a, c, t, g, unknown, or other
agagctggagctccccgcggtggcggccgctctagaactagtggatcccccgggctgcaggaattcgcacgagaccattacctagaacatcctaatcgaaaagaagcgaaagccgaaatcccattccccttccccctcttcgtctccgtcggcggcgtcggaccgaacccgagcccggagccctaactaaccctaggaggcaggcggcggcggggatggtgtactacgcgctgttggtgggcgcggagctggatggcctcaccaacctgcagccccgccacggctgcgacgaccccaacttcccctactacctcaagctcaagtgcgagaactgcgggngaggtcaccgccaagtccacctacgtcaccctcagcggggaggcgagctgcccaaaggacacggcgccgctcacctcgtccagaggtgcagctttgtgggagagatggaacagtgtgatgattcctggtcaggggacaccacttactattgagcagagccagaaggaggagaagacttgtttgatgggggttgactggggagggtatgaacctgggtgaggtttcctcttggactgggtggaaaggtgaaacttggggatggggcctccttttggaattgggcggctccgaggggggatttttccgggaaaaaaaaaaaaaaggaaaatgcccccctttaact

SEQ ID NO: 14223 - DNA, 686 bp, Zea mays
  misc_feature: Ceres CLONE 1375721-F
  misc_feature: Encodes the peptide sequence at SEQ ID NO. 14224
aaagctggagctccccgcggtggcggccgctctagaactagtggatcccccgggctgcaggaattcgcacgagaccattacctagaacatcctaatcgaaaagaaactgttccgctcccactccgatcggattcggtgggacggtggcatctatgcgcccgtcgcaccgtcgctcaaactgtataaacctgcgcccgaacacttcgagctcacccgcaacctcctccgggaagcgcgatcgccgtctcgaaggagctgaaatccaagattccaagctcttctgtcacaggttgagggaagttgaagcaaaagtctaagcaaaaatgttttacgggggatatgcttaccatggcaactcgtttgagcaaacataccgttggtatccagcatcgttttttgataagccacacctggaaggcggtgataaagtaataatgccaccttctgcccttgatcgtcttgcttccttgcacatcgagtaccctatgctatttgagctgcacaatgatgcaccccagcggatttcacactgtggtgttttgggagtttgttgcaaaagaaggcatgatcatcatgccctaattggatgatggcaaacatgctgctttcagagggggacactgtccatgtaaaaaaagcgactccttcccaggggacattattggaaattggcaccctcacccgat

SEQ ID NO: 14224 - protein, 88 aa, Zea mays
  misc_feature: Ceres CLONE 1375721-F
  misc_feature (10)..(87): Pfam Name: UFD1 Pfam Description: Ubiquitin fusion degradation protein UFD1
MFYGGYAYHGNSFEQTYRWYPASFFDKPHLEGGDKVIMPPSALDRLASLHIEYPMLFELHNDAPQRISHCGVLGVCCKRRHDHHALIG

SEQ ID NO: 14225 - DNA, 655 bp, Zea mays
  misc_feature: Ceres CLONE 1375724-R
cgattgggtccgggccccccctcgaggtcgacggtatcgataagcttttttttttttttttttccatgcatttccggactctctttattccggcccacgcatgacgaacatagttttttctccccggcggtctgccgtgcatgtgccacgcaccagctaagctgcattctcgctttttcgttgtttttgctggtgaatagaacacccctatggtgccactgacccccctgcttgatggatgcttcttgggcttctccacttcgatggcccgggtagtcaaccccattccggacactgaagtggagttctgtacggcgcgacctcgtcactttggttaggccgatcacaccagcctccaccaggttctcgtgcttgtccgccatggcgttgtaaaccaaactcccactcgctttcccggattttatccacaatcacctcaccttccaccccagcattatgggctatcagcgctgcaggtgccaccaaagccttctgaatgatatcagcacctaggcgctcctcaggatcatccaacgtctccttgatagccggtactaatgtcgatagatggacatacgctgcaccgcctcctggaacataccttcctctattgctgcataagtcgcattcttcgagaccgctaaggggagcttgc

SEQ ID NO: 14226 - DNA, 669 bp, Zea mays
  misc_feature: Ceres CLONE 1375724-F
  misc_feature: Encodes the peptide sequence at SEQ ID NO. 14227
  misc_feature (567)..(567): n is a, c, t, g, unknown, or other
aagctggagctccccgcggtggcggccgctctagaactagtggatcccccgggctgcaggaattcgcacgagaccattacctagaacatcctaatcgaaaagccgccaacccccaaacaaaaccctaggccaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgccttcgaccagggctccagagccgcccttcaggccggcgtcaagaagctcgccggcgcgggcggcgtcaccctcggacccagaggaaggaatgttgtcttggatgagtttggaacccccaaagtggtcaatgatggagttaccattgcccgcgctattgagctcgctgatcccatggagaatgctggtgcttccttgattcgtggaagtgctagtaagacgaatgactcggctggtgatggaactacnactggctctggtctcgctagggagatcatcagattgggcatgttgagcattacttcggggcaaatcggggggccgttaggagggattggatagactggtcag

SEQ ID NO: 14227 - protein, 165 aa, Zea mays
  misc_feature: Ceres CLONE 1375724-F
MATIPTTDSGLVLSSSALLRRTRRAASSVTARLPAVARRRPQLLVRASAKEIAFDQGSRAALQAGVKKLAGAGGVTLGPRGRNVVLDEFGTPKVVNDGVTIARAIELADPMENAGASLIRGSASKTNDSAGDGTTTGSGLAREIIRLGMLSITSGQIGGPLGGIG

SEQ ID NO: 14228 - DNA, 733 bp, Zea mays
  misc_feature: Ceres CLONE 1375725-F
  misc_feature: Encodes the peptide sequence at SEQ ID NO. 14229
  misc_feature (521)..(521): n is a, c, t, g, unknown, or other
  misc_feature (624)..(624): n is a, c, t, g, unknown, or other
  misc_feature (651)..(651): n is a, c, t, g, unknown, or other
  misc_feature (730)..(730): n is a, c, t, g, unknown, or other
  misc_feature (733)..(733): n is a, c, t, g, unknown, or other
tggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgccggtgttcctgatcttcagccccgtgctggtccccgccgcgctgctcatcgggacggccgtcatggggttcctcacgtcnggcgcgctggggctcgggggcctgtcctcgctcacgtgcctcgccacacggcgcggcaggcgttccagcgcaccccggactacgtggagggagcgcaccgcangatggcggagggccgcgcgcacgcggnccacaagaccgcgcaggcagggcaggccatccagggcagggcgcaagaagcccgcccccggggaaggtgcaggtgccgnccn

SEQ ID NO: 14229 - protein, 176 aa, Zea mays
  misc_feature: Ceres CLONE 1375725-F
  misc_feature (44)..(156): Pfam Name: Oleosin Pfam Description: Oleosin
  misc_feature (142)..(142): Xaa is any aa, unknown, or other
  misc_feature (151)..(151): Xaa is any aa, unknown, or other
MADRDRSGIYGGAHATYGQQQQQGGGGRPMGEQVKGMLHDKGPTASQALTVATLFPLGGLLLVLSGLALTASVVGLAVATPVFLIFSPVLVPAALLIGTAVMGFLTSGALGLGGLSSLTCLATRRGRRSSAPRTTWRERTAXWRRAARTRXTRPRRQGRPSRAGRKKPAPGEGAGA

SEQ ID NO: 14230 - DNA, 690 bp, Zea mays
  misc_feature: Ceres CLONE 1375726-F
  misc_feature: Encodes the peptide sequence at SEQ ID NO. 14231
  misc_feature (612)..(612): n is a, c, t, g, unknown, or other
  misc_feature (690)..(690): n is a, c, t, g, unknown, or other
aaagctggagctccccggcggtggcggccgctctagaactagtggatcccccgggctgcaggaattcgcacgagaccattacctagaacatcctaatcgaaaaatctagccatcagatcaaacaatccccaaacgcctccgcctccctagggttttgctctcggctcgtcggatccagttcgggggatcctccatggcgtcgcgtccgtcgctgaagtcgaagcccaagggcaagggcgggaagaaggccaccgccgacgacgaggacgccaccgcggcggcgaccacggtgcggctcatgaaggagtggaccacgtggacgatgaagaaggcgaaggtggtggcgcactacggcttcatccccctcgtcatcgtcatcggcatgaactccgagcccaagccctccgtgttccagctcctctcccccgtctgatcggatctccccgtcagggcccggatgaggtcggtccgtagtagtttgtagctggtacttcatttgcttacatatgtccgagatcgagttgaagaaggtggatcatgctttctgggcgatttggaaggatttggtttaataattttgtaggtggcggatgtcttctatactcgggatcnaaagatgtcttggttaaaaaaaaaaaaaaaaagcttatcgataccgccgacccttcggggggggggccgggtacccan

SEQ ID NO: 14231 - protein, 79 aa, Zea mays
  misc_feature: Ceres CLONE 1375726-F
  misc_feature (37)..(76): Pfam Name: Tom7 Pfam Description: TOM7 family
MASRPSLKSKPKGKGGKKATADDEDATAAATTVRLMKEWTTWTMKKAKVVAHYGFIPLVIVIGMNSEPKPSVFQLLSPV

SEQ ID NO: 14232 - DNA, 741 bp, Zea mays
  misc_feature: Ceres CLONE 1375727-F
  misc_feature: Encodes the peptide sequence at SEQ ID NO. 14233
tggagctccccgcggtggcggccgctctagaactagtggatcccccgggctgcaggaattcgcacgagaccattacctagaacatcataatcgaaaactgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggccatgaggtcttgctgtttgaagctcttcgtgaggccttgatggaagagatggaattagatccaacagtgtgtgtatttggtgaagatgtttgccattacggtggttcttacagagtgacaaaaggtttggctgatacgtttggagacctttcgagtctggacacccctattgcggagaactcgtttactggcatgggagttggaccggaaatgaaaggctgaagcccgtctttgaaggcatgaacatgggatccctgctcccggcttacaacaaaatctcaaaaaactgtgggaggttcattaaccttcccggggcacgttaaaacccccttggggatccggggccccgggggggggggtcccaaatttggaaaaaaacctccccacgcccggaaaccattttccccgccttcccagggcgggaaggg

SEQ ID NO: 14233 - protein, 133 aa, Zea mays
  misc_feature: Ceres CLONE 1375727-F
  misc_feature: SWISSPROT Homolog: EC 1.2.4.1 Pyruvate dehydrogenase (acetyl-transferring)
MATAFSLRAAAPATAPRAVSRSTSAARVVPVASALAGRGRLVARAAVTAKADVPSSTSDGHEVLLFEALREALMEEMELDPTVCVFGEDVCHYGGSYRVTKGLADTFGDLSSLDTPIAENSFTGMGVGPEMKG

SEQ ID NO: 14234 - DNA, 672 bp, Zea mays
  misc_feature: Ceres CLONE 1375729-F
  misc_feature: Encodes the peptide sequence at SEQ ID NO. 14235
  misc_feature (217)..(217): n is a, c, t, g, unknown, or other
  misc_feature (277)..(277): n is a, c, t, g, unknown, or other
  misc_feature (279)..(279): n is a, c, t, g, unknown, or other
  misc_feature (280)..(280): n is a, c, t, g, unknown, or other
  misc_feature (365)..(365): n is a, c, t, g, unknown, or other
  misc_feature (404)..(404): n is a, c, t, g, unknown, or other
  misc_feature (405)..(405): n is a, c, t, g, unknown, or other
  misc_feature (411)..(411): n is a, c, t, g, unknown, or other
  misc_feature (412)..(412): n is a, c, t, g, unknown, or other
aaagctggagctccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgcttccacccgtccgtcgcctctctctcggctgcctgattgnatttggttgccccggttccagcaatggcggtccaggcgcattatcaccaccactaaccancnncgcgagtccccctttcctcgtcagcggcgcgccggagggcagccggttggcggcagcgatggagctgcatcatcaggcgcaaaangaggctatggcgccgcagcaggctcaggctccgcccctnnctctgnnactctcgcatgggaggatacgccggcggaaggaaacgccagcgcgaagccggacccatggcgtccagttcttctctctgcagaagaaacgcaaggcgaggggccccagggggataaactgggggcaactcccaaaagggaggggggatgggccctccggtcaatttcaaaaaggtctcgaaaacaggtgtggggaacttccccggtcctcggccttggttttatgttttcctcctaaaaaggaccccccccaaaaggaaa

SEQ ID NO: 14235 - protein, 111 aa, Zea mays
  misc_feature: Ceres CLONE 1375729-F
  misc_feature (9)..(9): Xaa is any aa, unknown, or other
  misc_feature (23)..(23): Xaa is any aa, unknown, or other
  misc_feature (25)..(25): Xaa is any aa, unknown, or other
MELHHQAQXEAMAPQQAQAPPLXLXLSHGRIRRRKETPARSRTHGVQFFSLQKKRKARGPRGINWGQLPKGRGDGPSGQFQKGLENRCGELPRSSALVLCFPPKKDPPQKE

SEQ ID NO: 14236 - DNA, 717 bp, Zea mays
  misc_feature: Ceres CLONE 1375737-F
  misc_feature: Encodes the peptide sequence at SEQ ID NO. 14237
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (346)..(346): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (353)..(353): n is a, c, t, g, unknown, or other
  misc_feature (354)..(354): n is a, c, t, g, unknown, or other
aagctggagctccccgcggtggcggccgctctagaactagtggatcccccgggctgcaggaattcgcacgagaccattacctaaaacatcctaatcgaaaacgtgtttctaactccggtggctccaccaccagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagaatctggcgacccttttgnnnnnnnnnnnnnnnnnnnnngngnnnggnnggggggccggggggggggggggggggggggggggggggggggggagaggagggccgccccagaagaaagaaaacccacgccggggggggtggagtgggcgggcgcctttcgaaaaccccccccttttaaaaaaagacaaatttccttttccttgggcgtttttttcaagggggggtgggaataaattttaaaaaaggggtttcccttggcccacccaaagaaaaaaccccctaaaggcttttggcccccaaaaaaaaaaaaatgttgtggctttttttacccccccaaaacaacacccccgggggggttttttttaaaccacccagagaagggggggggtttgggggcgcccctctccccccg

SEQ ID NO: 14237 - protein, 125 aa, Zea mays
  misc_feature: Ceres CLONE 1375737-F
  misc_feature: SWISSPROT Homolog: EC 3.4.25.1 Proteasome endopeptidase complex
  misc_feature (53)..(53): Xaa is any aa, unknown, or other
  misc_feature (54)..(54): Xaa is any aa, unknown, or other
  misc_feature (55)..(55): Xaa is any aa, unknown, or other
  misc_feature (56)..(56): Xaa is any aa, unknown, or other
  misc_feature (57)..(57): Xaa is any aa, unknown, or other
  misc_feature (58)..(58): Xaa is any aa, unknown, or other
  misc_feature (59)..(59): Xaa is any aa, unknown, or other
  misc_feature (60)..(60): Xaa is any aa, unknown, or other
  misc_feature (61)..(61): Xaa is any aa, unknown, or other
  misc_feature (63)..(63): Xaa is any aa, unknown, or other
MSRRGDWVYENNGGTCVAIAGADYCVVAADTRLSVGYSILTRDHSKNLATLLXXXXXXXXXGXGAGGGGGGGGGGGGRGGPPQKKENPRRGGWSGRAPFENPPLLKKDKFPFPWAFFSRGGGNKF

SEQ ID NO: 14238 - DNA, 738 bp, Zea mays
  misc_feature: Ceres CLONE 1375739-F
  misc_feature: Translation starting site: 189
  misc_feature (427)..(427): n is a, c, t, g, unknown, or other
  misc_feature (636)..(636): n is a, c, t, g, unknown, or other
  misc_feature (667)..(667): n is a, c, t, g, unknown, or other
ggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgccctcacaaactccctcatgatgcacgggcgcaacaacggcnagaaggtcatggctgtccgcatcatcaagcataccctggagatcattcacctgctcaccgatgcccaccccatccaggtcgtcgtcgacgcgatcgtcaacagtggaccccgtgaggatgccacccggattggttcccgctggtgttgtgagggaggcaggccgtggatatctcacccctgaggagggtgaacaggccatctacctccntcacactggtggcaggggagagtgctttccnggaacatcaaaccattgccgagtgcctggcagatgagctgatcaacgctgccaagggctcatcccaacagt

SEQ ID NO: 14239 - DNA, 718 bp, Zea mays
  misc_feature: Ceres CLONE 1375741-F
  misc_feature: Encodes the peptide sequence at SEQ ID NO. 14240
  misc_feature (663)..(663): n is a, c, t, g, unknown, or other
aaagctggagctccccgcggtggcggccgctctagaactagtggatcccccgggctgcaggaattcgcacgagaccattacctagaacatcctaatcgaaaagccccgtcgcacagaatcgcttggtgcaccctgcgagggcctcctcgaaaccctagcttgcccagcccctccgggccatgggcaagtacatgcgcaaggccaaggcttccagcgaggttgtcatcatggatgtcgccgccgctccgctcggagtccgcacccgagcgcgcgccctcgcgctgcagcgtctgcaggagcagcagacgcagtgggaggaaggtgctggcggcgagtacctggagctaaggaaccggaggctcgagaagctgccgccgccgccggcgaccacgagggaggtcggcgggaggaaagcggcagccgaggccgccgcaactaaggaggctgaggcgtcgtacggggagaacatgctcgagttggaggccatggagaggattaccagggagacgacgccctgcagcttgactaacacccagatgactagcactcctgggtccacgagatctagccactcttgccaccgcagggtgaacgctcctcgggtgcacgccgtcccaagttctagggagatgaatgagtacttcgctgcggaacagcgacgcnacagcaggtttcatttgacagtacacttcgatcttgaaacgatgcctcctccagg

SEQ ID NO: 14240 - protein, 179 aa, Zea mays
  misc_feature: Ceres CLONE 1375741-F
  misc_feature (162)..(162): Xaa is any aa, unknown, or other
MGKYMRKAKASSEVVIMDVAAAPLGVRTRARALALQRLQEQQTQWEEGAGGEYLELRNRRLEKLPPPPATTREVGGRKAAAEAAATKEAEASYGENMLELEAMERITRETTPCSLTNTQMTSTPGSTRSSHSCHRRVNAPRVHAVPSSREMNEYFAAEQRRXSRFHLTVHFDLETMPPP

SEQ ID NO: 14241 - DNA, 697 bp, Zea mays
  misc_feature: Ceres CLONE 1375755-F
  misc_feature: Encodes the peptide sequence at SEQ ID NO. 14242
  misc_feature (534)..(534): n is a, c, t, g, unknown, or other
  misc_feature (546)..(546): n is a, c, t, g, unknown, or other
  misc_feature (579)..(579): n is a, c, t, g, unknown, or other
  misc_feature (666)..(666): n is a, c, t, g, unknown, or other
aagctggagctccccgcggtggcggccgctctagaactagtggatcccccgggctgcaggaattcgcacgagaccattacctagaacatcctaatcgaaaaatactgtctccactccagtgacccagtccccgcgctgcatccttccgcttcctctcgctccctctgctctctcgcggtcgcagtctcgcagatcccgatcgcgcaaggagccagcgtagagggtgatcgacgatggcgggcagcacgcgcgcagcgcacaaggcgttcctgctctgcaactacacgctgctgggtgcagcatcggcgtgcatcttcctcacgctctcgctccgcctcgccccgtccgcgtgcggcctgctcctcgtcttcctccacgcgctcaccgctgtcttcgccgccgcgggctgctcgggctccttcaccgacggcggcgccggggccggccgcgcgcacgccgcgcacacaggggggggccgtgctcaccgccatcttccaggggcgccgccgcgctgctcgccttcacccggaccgncgacttcctcgncgagctgcggtcctacgtccgggaggaggacgncgaggtcattctcaaagctcatcgggggctcggcaccgccatcttcgtgctcgagtgggccgcgctagcgctcgcatcgcgctcggncttgacgatgatgcaacgaggagattgacgt

SEQ ID NO: 14242 - protein, 137 aa, Zea mays
  misc_feature: Ceres CLONE 1375755-F
  misc_feature (101)..(101): Xaa is any aa, unknown, or other
  misc_feature (105)..(105): Xaa is any aa, unknown, or other
  misc_feature (116)..(116): Xaa is any aa, unknown, or other
MAGSTRAAHKAFLLCNYTLLGAASACIFLTLSLRLAPSACGLLLVFLHALTAVFAAAGCSGSFTDGGAGAGRAHAAHTGGGRAHRHLPGAPPRCSPSPGPXTSSXSCGPTSGRRTXRSFSKLIGGSAPPSSCSSGPR

SEQ ID NO: 14243 - DNA, 719 bp, Zea mays
  misc_feature: Ceres CLONE 1375761-F
  misc_feature (286)..(286): n is a, c, t, g, unknown, or other
  misc_feature (424)..(424): n is a, c, t, g, unknown, or other
  misc_feature (425)..(425): n is a, c, t, g, unknown, or other
  misc_feature (473)..(473): n is a, c, t, g, unknown, or other
  misc_feature (486)..(486): n is a, c, t, g, unknown, or other
tggagctccccgcggtggcggccgctctagaactagtggatcccccgggctgcaggaattcgcacgagaccattacctagaacatcctaatcgaaaaagcggcactacacgccagagagagggaaggggaggttggccagagagccgagagcagccctgcagtcgagagcatccgactgctagctactagcaatagcataggcagataagctcgggccgggccggggcacgcgcacaatgaggtcgcggcggtggcacagcgtggtcgccgtagcgctggcagcgncggcgtggtggtggtgcgcgggcggcccaagcgcaggcgcaggcgcagctgagccagagctactacgcgtcgacgtgccccgaacgtggagacgctggtcccgcggcgccgtcacccaggaggctgcaggagaccttnncacgcggggccgggcacgctccggcctcttcttccacgactgctttcntcaggggctgccnacgcgtcccgggctgctgtccgggccccgacgacaggaacaggggggggggggcgaacaccacggtgtgccccgggagggggttcgacctggtccaccgcgccaagggccgccgcgggaagccaacccgggctgggccaaaagggggggccgggggccaaatccttcgcctggcgcccgggggaggcgtttcccagaaagggggggccggacaaccggggggggggggggggg

SEQ ID NO: 14244 - DNA, 719 bp, Zea mays
  misc_feature: Ceres CLONE 1375762-F
  misc_feature: Translation starting site: 472
  misc_feature (527)..(527): n is a, c, t, g, unknown, or other
  misc_feature (607)..(607): n is a, c, t, g, unknown, or other
  misc_feature (613)..(613): n is a, c, t, g, unknown, or other
  misc_feature (614)..(614): n is a, c, t, g, unknown, or other
  misc_feature (628)..(628): n is a, c, t, g, unknown, or other
  misc_feature (673)..(673): n is a, c, t, g, unknown, or other
aaagctggagctccccgcggtggcggccgctctagaactagtggatcccccgggctgcaggaattcgcacgagaccattacctagaacatcctaattgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcngtggcagcaccccgatcctgggccagtgcgtcgagttcctgaggcatcagtgcagcccgaacgcgacgccctactgctcngctcanntgcagtcgttgcgncagcagtgtgccagcagctcaggcaaggtgaagcgcagcaccggnaccaggggattttcggtttggtcttcagtcatcctgcagagcagcg

SEQ ID NO: 14245 - DNA, 750 bp, Zea mays
  misc_feature: Ceres CLONE 1375765-F
  misc_feature: Encodes the peptide sequence at SEQ ID NO. 14246
  misc_feature (508)..(508): n is a, c, t, g, unknown, or other
  misc_feature (562)..(562): n is a, c, t, g, unknown, or other
  misc_feature (578)..(578): n is a, c, t, g, unknown, or other
  misc_feature (659)..(659): n is a, c, t, g, unknown, or other
  misc_feature (665)..(665): n is a, c, t, g, unknown, or other
  misc_feature (666)..(666): n is a, c, t, g, unknown, or other
  misc_feature (750)..(750): n is a, c, t, g, unknown, or other
aaagctggagctccccgcggtggcggccgctctagaactagtggatcccccgggctgcaggaattcgcacgagaccattacctagaacatcctaatcgaaaaaccgccaccgggatggccggagttcccgccaccttctcctcagccaccgctcagatcgggggcttcctctcgaagaagccttacgcgccgccgttgtgggccacgcacctctcccccatgccttgccataccttctcgctcggccatttcccaacaccgattcacaagtggaatctgcccaatttgccggaaggaacggaagtgtggatcaagcgagacgatttatcaggcatgcagttgagtggaaacaaggtccggaagctggagttcttgatggcagatgccgtagcacaaggcgcggactgcgttattactgttgggggtatacagagtaaccactgccgtgccacagccgtggctgctaagtatctcaatcttgattgctacctgatactacgtacctccnagcttcttgtggataaggacccctggtttggttggcaatcttcttgtcgagagnactagtggggcacacngttgatcttgtgtcaaaagaaaatatggaaaaattggcagtgtggctttagctgactgctgaaaaaaagcttctggaagangggagnnagcgtatgtgatttcctggtggtggatcaactcattggggactgtgggatatattgaggcaattaaggagattgagcagcaatn

SEQ ID NO: 14246 - protein, 149 aa, Zea mays
  misc_feature: Ceres CLONE 1375765-F
  misc_feature: SWISSPROT Homolog: EC 4.4.1.15 D-cysteine desulfhydrase
  misc_feature (132)..(132): Xaa is any aa, unknown, or other
MAGVPATFSSATAQIGGFLSKKPYAPPLWATHLSPMPCHTFSLGHFPTPIHKWNLPNLPEGTEVWIKRDDLSGMQLSGNKVRKLEFLMADAVAQGADCVITVGGIQSNHCRATAVAAKYLNLDCYLILRTSXLLVDKDPWFGWQSSCRE

SEQ ID NO: 14247 - DNA, 683 bp, Zea mays
  misc_feature: Ceres CLONE 1375766-F
  misc_feature: Encodes the peptide sequence at SEQ ID NO. 14248
  misc_feature (668)..(668): n is a, c, t, g, unknown, or other
aaagctggagctccccgcggtggcggccgctctagaactagtggatcccccgggctgcaggaattcgcacgagaccattacctagaacatcctaatcgaaaaaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagagtggtgctgggaagcacgtgccccgtgctgtttttgttgaccttgaacccactgtcatcgatgaggtgagaactggcacctaccgccagctcttccaccctgagcagctcatcagtgggaaggaggatgcagcccacaactttggcccgtggtcactacaccatttggcaggagatggttggacctgtgccttgatcgcatcaggaagcttgccggacactgcactggtctccagggcttcctcgtcttcaacggtgttggtggagggacgggctctgggcttggntccctcctctagagg

SEQ ID NO: 14248 - protein, 155 aa, Zea mays
  misc_feature: Ceres CLONE 1375766-F
  misc_feature (151)..(151): Xaa is any aa, unknown, or other
MRECISIHIGQAGIQVGNACWELYCLEHGIQADGQMPGDKTIGGGDDAFNTFFSESGAGKHVPRAVFVDLEPTVIDEVRTGTYRQLFHPEQLISGKEDAAHNFGPWSLHHLAGDGWTCALIASGSLPDTALVSRASSSSTVLVEGRALGLXPSSR

SEQ ID NO: 14249 - DNA, 773 bp, Zea mays
  misc_feature: Ceres CLONE 1375768-F
  misc_feature: Encodes the peptide sequence at SEQ ID NO. 14250
  misc_feature (212)..(212): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
caaagctggagctccaccgcggtggcggccgctctagaacaagtggatcccccgggctgcaggaattcgcacgagaccattacctaagaacatcctaatcgaaaaatctacctcactcgtagctcaagcatcagcggcaggagctctgggcagcgtgcgcacgtggggtacctagctcgctctgctagcctaccatggctgatcaccaccgngggcgcgacgggaggtggcgggggctacggcgacctccagcgcgggggcggcatgcacggcgaggcgcagcagcagcagaagcagggcgccatgatgacggcgctcaaggccgcgacggccgcgacccttcgcgggtcgatgctggtgctgtccgggctgatcctggccggcaccgtgatcgcgctcacggtggccaccccgtgctgtgactccccnnnnnnnnngggggggggcgccccccccctgggggttgggtctggaggggggggggggttcgccccctccgggggcctcgggggtccttggggttttcccggggttcccccgggtgggcccaagtccccggagggggaagcaccccgccgggcgccgaaccagttggaacacgccaggggggaggttgggggcccagggcccgggacattagggggtgggaacggcccgctatcgacaaggggggggggggtttggaaaaaaaaaaccaactctagggggaccgggggggggtcccttttgaacaatgggggggggggggatttatggccctaaagggggggggt

SEQ ID NO: 14250 - protein, 165 aa, Zea mays
  misc_feature: Ceres CLONE 1375768-F
  misc_feature (56)..(56): Xaa is any aa, unknown, or other
  misc_feature (57)..(57): Xaa is any aa, unknown, or other
  misc_feature (58)..(58): Xaa is any aa, unknown, or other
MHGEAQQQQKQGAMMTALKAATAATLRGSMLVLSGLILAGTVIALTVATPCCDSPXXXGGGAPPLGVGSGGGGGFAPSGGLGGPWGFPGVPPGGPKSPEGEAPRRAPNQLEHARGEVGGPGPGTLGGGNGPLSTRGGGVWKKKTNSRGTGGGSLLNNGGGGDLWP

SEQ ID NO: 14251 - DNA, 724 bp, Zea mays
  misc_feature: Ceres CLONE 1375771-F
  misc_feature (423)..(423): n is a, c, t, g, unknown, or other
  misc_feature (431)..(431): n is a, c, t, g, unknown, or other
  misc_feature (551)..(551): n is a, c, t, g, unknown, or other
  misc_feature (620)..(620): n is a, c, t, g, unknown, or other
  misc_feature (639)..(639): n is a, c, t, g, unknown, or other
aagctggagctccccgcggtggcggccgctctagaactagtggatcccccgggctgcaggaattcgcacgagaccattacctagaacatcctaatcgaaaaatcatcaactgatcaaacagagacaaacctatactgctacatgcataatggttggtacatggtaaaactatagcaagctaaggtcgatcgctcgtctatagctagaccactaccacctccatggtttcttgactgatagatagacggacgagaatgaagaagctagctagctactagatatatcatcagtagagtgttcagttgttgatgatggcctcctccttgcccctggtcaccactgggctgcgccatcctcctcctccgcagcagtcgccgagggtggtcctgcagagcgaggacccgaccgagtggtgcgcgtggncgcaccangggcaccgcctgtgggtgggcatgccggactccttctgggtgtacacgtacaaggtggaccggtgcccgttccggggcaacacgtgtggacgacgtgcccgtacgcgcactggggggagngcgcgcgccgccgcgaccccagccgctacgcgtacgccgccgcgacgtgcccggactacgccgactccnagcgcccgaaccgcctggnccggtccaccgcgccccccacctgggcgggcggcctccgctgcggcttcccgcacggcgtcttccaagacgtgctgcaccccacc

SEQ ID NO: 14252 - DNA, 673 bp, Zea mays
  misc_feature: Ceres CLONE 1375772-F
  misc_feature: Encodes the peptide sequence at SEQ ID NO. 14253
  misc_feature (460)..(460): n is a, c, t, g, unknown, or other
aaagctggagctccccgcggtggcggccgctctagaactagtggatcccccgggctgcaggaattcgcacaagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcacaagctcctatagcttcccttcttcccccgtacctctcaccagtggtgtcttcggtatgtcaaaacccaattcttgaaccctacaggatccaacaggcaatcgcagctggcatcttacctttatcaccctgtgttgcgtccaacaatcatcagccctattacagcagttacctttggtgcatttattggcacaaaacatcagggcacaacaactacnacaacttgtgctagcaaaccttgctgcctactctcagcaacagcagtttctttccattcaccaactagctgcattgaactctgcttctttattgcaacaacaacaactaccattcaggcagctacctgctgcctacccccagcattttctcccattcaccaactgggagcatggaactctcctggctatttacggcaggacaactactaaccg

SEQ ID NO: 14253 - protein, 104 aa, Zea mays
  misc_feature: Ceres CLONE 1375772-F
  misc_feature (101)..(101): Xaa is any aa, unknown, or other
MAAKIFCLLMLLGLSASAATATIFPQCSQAPIASLLPPYLSPVVSSVCQNPILEPYRIQQAIAAGILPLSPCVASNNHQPYYSSYLWCIYWHKTSGHNNYXNLC

SEQ ID NO: 14254 - DNA, 685 bp, Zea mays
  misc_feature: Ceres CLONE 1375774-R
  misc_feature: SWISSPROT Homolog: EC 4.2.1.3 Aconitate hydratase
cgattgggtaccgggccccccctcgaggtcgacggtatcgataagcttttttttttttttttttagccaaatgcttcgtgattacattagcatcaagatgacagatgtttgaaacgatacaattctgctcgatagcattggaaaatgaactgcaaaatatgaaaaaaaataacatgaaatcaaggcaacctaaatacatgtggtatgcacccaagctcgataagaagtgggctaaggatgccagttggcatgcttagtcataacgtcacaaaatggaataagaaaaaattgaatagacgttgcaggatgacatgagcgggcttcaacaggattttaacttgcttctgtgcacttctctcccagtccaagatcttctcaacaaccttcccggtgacctaaaaaccatcacagttcctaattgctgactcgagataaatgcttatagaatatgagaactgatcttaagagcgtcatagcatcttgcaattggattggcagctgcaagaaatgaagtccctaaaatgagtattattgtaatggcagctttggcaatagatattgtctgctgctccatggcctcaggaatcgcaactctagcaatgtcgatgcaaggcggggagtgcgcttgtacatggagtcgtcctcttcgccatcaatctatctgctggatctgaccaccgtcgag

SEQ ID NO: 14255 - DNA, 696 bp, Zea mays
  misc_feature: Ceres CLONE 1375775-F
  misc_feature: Encodes the peptide sequence at SEQ ID NO. 14256
  misc_feature (234)..(234): n is a, c, t, g, unknown, or other
  misc_feature (258)..(258): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
aagctggagctccccgcggtggcggccgctctagaactagtggtcccccgggctgcaggaattcgcacgagaccattacctagaacatcctaatcaaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcggnggctacggcgacctccagcgcggnggcggcatgcacggcgaggcgcagcagcagcagaagcagggcgccatgatgacggcgctcaaggccgcgacgggcgcgaccccttcgcggtcgatgctggtgctgtccgggctgatcctggccggcaccgtgatcgcgctcacgtgggcaccccgggctgtgactcgcggnnnnggggggggggggcgccccccttccccttggggctctggggggggggggtttgtccccccggggggccccgggggcccttggggtggccggggtccccgggggggggccgggcccggggggggggggcccccggcgggggcccgcccgtggggccccgccggggggggggggggggggccgggggcccgggtttcgggggggggggccgggcccggttcggcggggggggggggggtcttggggggaaacacccccccggggggg

SEQ ID NO: 14256 - protein, 167 aa, Zea mays
  misc_feature: Ceres CLONE 1375775-F
  misc_feature (79)..(79): Xaa is any aa, unknown, or other
MADHHRGATGGGGGYGDLQRGGGMHGEAQQQQKQGAMMTALKAATGATPSRSMLVLSGLILAGTVIALTWAPRAVTRGXGGGGRPPSPWGSGGGGFVPPGGPGGPWGGRGPRGGAGPGGGGPPAGARPWGPAGGGGGGPGARVSGGGAGPGSAGGGGVLGGNTPPGG

SEQ ID NO: 14257 - DNA, 780 bp, Zea mays
  misc_feature: Ceres CLONE 1375778-F
  misc_feature (238)..(238): n is a, c, t, g, unknown, or other
  misc_feature (263)..(263): n is a, c, t, g, unknown, or other
  misc_feature (339)..(339): n is a, c, t, g, unknown, or other
  misc_feature (345)..(345): n is a, c, t, g, unknown, or other
  misc_feature (348)..(348): n is a, c, t, g, unknown, or other
  misc_feature (379)..(379): n is a, c, t, g, unknown, or other
  misc_feature (395)..(395): n is a, c, t, g, unknown, or other
  misc_feature (413)..(413): n is a, c, t, g, unknown, or other
  misc_feature (433)..(433): n is a, c, t, g, unknown, or other
  misc_feature (434)..(434): n is a, c, t, g, unknown, or other
  misc_feature (438)..(438): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (521)..(521): n is a, c, t, g, unknown, or other
  misc_feature (524)..(524): n is a, c, t, g, unknown, or other
  misc_feature (526)..(526): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (535)..(535): n is a, c, t, g, unknown, or other
  misc_feature (536)..(536): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (557)..(557): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (585)..(585): n is a, c, t, g, unknown, or other
  misc_feature (587)..(587): n is a, c, t, g, unknown, or other
  misc_feature (614)..(614): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaaatcaaatcgccaccgaaaattccccccaaaaaacaataagcaattgttcatcatcgtcagagtaaacacagcagaaccctagcgcgccgttcctccgacgactcacatcccacccactcacccaccccatggcggncaagctctccacccagcgccgacgntcccggcctcggtgcggctctccgcagcagcgcaggcggctgcgatccagccctcctccccgcgcttcttcttttnctcctnttntccgctggccggggaccaacaccggctcccnccgcgacgcgcatagncgccatttgcgtcgattnctccgacagccccgccttcnncgtnaaaaatggggccgtgagaactacctcccgcccccgnnnaaaaacgccgtcgtgcctgctccacgtggnnncccactccgttcnctncnggnnnnnannaactggnnnttccatcccgtntttcccgnnnnctgaacgaggccacacncntgccgaagccgccgccgcccccccccnccgaggcggncccccccctccgaaggagagctgcagaaaaaaaaagcggagggggagaaaaacaacgccttcactctaaacaagggcaagacctccgggcaacccccttggccaatgcaaaaacccttctaaaaaaaccatgtcgcaggacccccccccctggagg

SEQ ID NO: 14258 - DNA, 682 bp, Zea mays
  misc_feature: Ceres CLONE 1375780-F
  misc_feature: Translation starting site: 225
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (437)..(437): n is a, c, t, g, unknown, or other
  misc_feature (444)..(444): n is a, c, t, g, unknown, or other
  misc_feature (446)..(446): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (459)..(459): n is a, c, t, g, unknown, or other
  misc_feature (468)..(468): n is a, c, t, g, unknown, or other
  misc_feature (477)..(477): n is a, c, t, g, unknown, or other
  misc_feature (483)..(483): n is a, c, t, g, unknown, or other
  misc_feature (499)..(499): n is a, c, t, g, unknown, or other
  misc_feature (503)..(503): n is a, c, t, g, unknown, or other
  misc_feature (506)..(506): n is a, c, t, g, unknown, or other
  misc_feature (509)..(509): n is a, c, t, g, unknown, or other
  misc_feature (510)..(510): n is a, c, t, g, unknown, or other
  misc_feature (512)..(512): n is a, c, t, g, unknown, or other
  misc_feature (513)..(513): n is a, c, t, g, unknown, or other
  misc_feature (519)..(519): n is a, c, t, g, unknown, or other
  misc_feature (520)..(520): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (539)..(539): n is a, c, t, g, unknown, or other
  misc_feature (541)..(541): n is a, c, t, g, unknown, or other
  misc_feature (551)..(551): n is a, c, t, g, unknown, or other
  misc_feature (552)..(552): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (565)..(565): n is a, c, t, g, unknown, or other
  misc_feature (566)..(566): n is a, c, t, g, unknown, or other
  misc_feature (576)..(576): n is a, c, t, g, unknown, or other
  misc_feature (587)..(587): n is a, c, t, g, unknown, or other
  misc_feature (589)..(589): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (596)..(596): n is a, c, t, g, unknown, or other
  misc_feature (597)..(597): n is a, c, t, g, unknown, or other
  misc_feature (599)..(599): n is a, c, t, g, unknown, or other
  misc_feature (601)..(601): n is a, c, t, g, unknown, or other
  misc_feature (609)..(609): n is a, c, t, g, unknown, or other
  misc_feature (610)..(610): n is a, c, t, g, unknown, or other
  misc_feature (612)..(612): n is a, c, t, g, unknown, or other
  misc_feature (615)..(615): n is a, c, t, g, unknown, or other
  misc_feature (621)..(621): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (636)..(636): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (663)..(663): n is a, c, t, g, unknown, or other
  misc_feature (664)..(664): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (673)..(673): n is a, c, t, g, unknown, or other
  misc_feature (674)..(674): n is a, c, t, g, unknown, or other
  misc_feature (677)..(677): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
tgactgtcgccccccgggggggcgctctataataaatgaatcccccgccctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcggggtnnnnnnnnnatcannnnncaancaactcnanacttnnnntaacnaccttgctnccactctcncaactncatttctttcctccanccantanctnntnnaacccnncnnnttttttnnnnaccanantacatccacnncctttccnnnccnnaccccatcanttttctcctcncncnnnnannantnttaatccnntnctnatttcncnnnnannnntacancattcccnnnnnntattnnnnntaccnncnnnncttnnacncnnnn

SEQ ID NO: 14259 - DNA, 762 bp, Zea mays
  misc_feature: Ceres CLONE 1375781-F
  misc_feature: Encodes the peptide sequence at SEQ ID NO. 14260
  misc_feature (411)..(411): n is a, c, t, g, unknown, or other
  misc_feature (675)..(675): n is a, c, t, g, unknown, or other
  misc_feature (688)..(688): n is a, c, t, g, unknown, or other
aagctggagctccccgcggtggcggccgctctagaactagtggatcccccgggctgcaggaattcgcacgagaccattacctagaacatcctaatcgaaaaagcaggcgttcggcccggcagcccccaagtcccatcgccgagcagaaagtcaggaacagaactcaggcgttggcgattggcatctccctcccctaagccatggctaccgggcggcccgtacgactcgtgctggatgcctccctcctcctcgacccctcctccaccagggaggcggcggcggtggcgctgcggcccggggtagaggagttgctgcggcggttgcgctactccaacctgagcgtggcaatctgctatgcagagggcatgccaactaatgagtcagactttcttgaaaaggtcgcaagctcancacttgtttggatctatagtacttcttgcaaaaagtgggaatctttctccaattgaattaatgatagaatggagccgaacaaagtttttgtttttatgcgacttcaagagttgacaaaggtttaatttctgagctcagatcagaaactggagagttctttctgtagctatgatggaaaacatagaggttcctgggggttttaatggtcaaggggcttcaggagttgcttctcacctgggctactctatgaaaaagggactttgngggtcaaccgggntccgggggattgggaaatatatgaaaaaatccccggggaggagactttcgcaaagaggaggagcatttccataa

SEQ ID NO: 14260 - protein, 88 aa, Zea mays
  misc_feature: Ceres CLONE 1375781-F
  misc_feature (71)..(71): Xaa is any aa, unknown, or other
MATGRPVRLVLDASLLLDPSSTREAAAVALRPGVEELLRRLRYSNLSVAICYAEGMPTNESDFLEKVASSXLVWIYSTSCKKWESFSN

SEQ ID NO: 14261 - DNA, 716 bp, Zea mays
  misc_feature: Ceres CLONE 1375782-F
  misc_feature: Encodes the peptide sequence at SEQ ID NO. 14262
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (439)..(439): n is a, c, t, g, unknown, or other
aagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgtcttcgcggnnnttngggggggggggggcccccacatcgggctggcgttcaagggggggcccgggttccgcaacctccgggggcctcggcgttcgctggcgctggccggtgttctctctgggatggacaaggtaccctgacggggcaggcaccccggcggggcgcccgaccaggctggaccacgcccaaggcgggagggttggcggtccaagggcccggcgaacatccaggaggggcagcacagcaaccggatcgaacagggggggacggggggtcctttggaaagcaataa

SEQ ID NO: 14262 - protein, 173 aa, Zea mays
  misc_feature: Ceres CLONE 1375782-F
  misc_feature (36)..(158): Pfam Name: Oleosin Pfam Description: Oleosin
  misc_feature (80)..(80): Xaa is any aa, unknown, or other
  misc_feature (81)..(81): Xaa is any aa, unknown, or other
MADHHRGATGGGGGYGDLQRGGGMHGEAQQQQKQGAMMTALKAATAATFGGSMLVLSGLILAGTVIALTVATPVLVSSRXXGGGGAPTSGWRSRGGPGSATSGGLGVRWRWPVFSLGWTRYPDGAGTPAGRPTRLDHAQGGRVGGPRARRTSRRGSTATGSNRGGRGVLWKAI

SEQ ID NO: 14263 - DNA, 761 bp, Zea mays
  misc_feature: Ceres CLONE 1375783-F
  misc_feature: Encodes the peptide sequence at SEQ ID NO. 14264
  misc_feature (591)..(591): n is a, c, t, g, unknown, or other
  misc_feature (639)..(639): n is a, c, t, g, unknown, or other
  misc_feature (660)..(660): n is a, c, t, g, unknown, or other
aagctggagctccccgcggtggcggccgctctagaactagtggatcccccgggctgcaggaattcgcacgagaccattacccagaacatcctaatcgaaaacactgaaacgaaattaccctatagggatgagatttaaaatgaggtttgaaggtgaagaggctccagaacaaaggttcactgggaccattgttggaaatgtggatcctgatcaagctggatgggctgaatctaaatggcgttacctcaaggtgaggtgggatgaagcttcctccattccacgtcctgaaagggtttctccctggcaaatagaacctgcagtcagccctccccctatcaacccgcttccagtgcacagacccaagagaccgcgctctaatgctgtagcttctctgcccgagtcttcagctccaacaaaagaagctgctccaaaggtcacattagagactcaacaacatgccctgcaaaggcccttgcagacccaggataatgtggccccgaaaagtgtttttggtgataacagtgaattggactctgctcataagtcctccctgcgaccgtcaggttttgatctggacaagagcaccattgncatgcagagggaagcttggttcagatatttggatgcgaatgaacaggncctgatggttacagtgaaatnggtatcgggatatcaccacctaatggagatgacggaatttcgcagggtttctgttccttacctggatcagatggccgctggacgccctattttctggaaca

SEQ ID NO: 14264 - protein, 211 aa, Zea mays
  misc_feature: Ceres CLONE 1375783-F
  misc_feature (1)..(41): Pfam Name: Auxin_resp Pfam Description: Auxin response factor
  misc_feature (155)..(155): Xaa is any aa, unknown, or other
  misc_feature (171)..(171): Xaa is any aa, unknown, or other
  misc_feature (178)..(178): Xaa is any aa, unknown, or other
MRFKMRFEGEEAPEQRFTGTIVGNVDPDQAGWAESKWRYLKVRWDEASSIPRPERVSPWQIEPAVSPPPINPLPVHRPKRPRSNAVASLPESSAPTKEAAPKVTLETQQHALQRPLQTQDNVAPKSVFGDNSELDSAHKSSLRPSGFDLDKSTIXMQREAWFRYLDANEQXLMVTVKXVSGYHHLMEMTEFRRVSVPYLDQMAAGRPIFWN

SEQ ID NO: 14265 - DNA, 684 bp, Zea mays
  misc_feature: Ceres CLONE 1375788-F
  misc_feature: Encodes the peptide sequence at SEQ ID NO. 14266
  misc_feature (343)..(343): n is a, c, t, g, unknown, or other
  misc_feature (387)..(387): n is a, c, t, g, unknown, or other
  misc_feature (389)..(389): n is a, c, t, g, unknown, or other
aaagctggagctccccgcggtggcggccgctctagaactagtggatcccccgggctgcaggaattcgcacgagaccattacctagaacatcctaatcgaaaaaagcggaccataaccacgggcagcaggacattatattcttctgcctgcccttccgttcaatttcaatttcactttccttctctcctctcctcctgctgctactaggttcgggccgtccgtccttgctcttgatctgcattatttaattcggaccattcccccgccgtcctcccgcccgcctgccggagatggagatggagaacgggcacgccaagtaccgggtggccgtcattggcagcgncaactggggcagcgtcgcctcccgcctcatgggtggggagacgncnagcttgcctccttctatgatgaagtaaggattgggggtgttgaaggaatactggctaacggcaggaacttatctaggtccttaccgaacagaatggaacttgcaaaacatgcccagtataaagcttggaaccaaaggtaatttgcgacccttgatttgaaaggccatccaaaaagcgaaattgcgggttttttggaggcccccaacattttggggggggatatttaaaaagtttttgtggaaacttaccccccggggggggggttttccccccctcaggggggtgggggggaaaa

SEQ ID NO: 14266 - protein, 41 aa, Zea mays
  misc_feature: Ceres CLONE 1375788-F
  misc_feature (18)..(18): Xaa is any aa, unknown, or other
  misc_feature (33)..(33): Xaa is any aa, unknown, or other
MEMENGHAKYRVAVIGSXNWGSVASRLMGGETXSLPPSMMK

SEQ ID NO: 14267 - DNA, 730 bp, Zea mays
  misc_feature: Ceres CLONE 1375796-F
  misc_feature: Encodes the peptide sequence at SEQ ID NO. 14268
  misc_feature (422)..(422): n is a, c, t, g, unknown, or other
  misc_feature (487)..(487): n is a, c, t, g, unknown, or other
  misc_feature (508)..(508): n is a, c, t, g, unknown, or other
  misc_feature (578)..(578): n is a, c, t, g, unknown, or other
tggagctccccgcggtggcggccgctctagaactagtggatcccccgggctgcaggaattcgcacgagaccattacctagaacatcctaatcgaaaaattccgtcgtcgtcgtcagcagcttctgcttgctctggggggaaggagagagagagagcgagagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccgggccgtgtccgtgcagctcggcgaccacggccacctcgcctactcccacaccaaccaggcgctcctccgccccaggtcgttcgcggccnagggacgaggtgttctgcctgtttcgagggggtgctgggacaacctgggtcgtctgagccagcancacgggctgtcaagaagggcngccacgaggtgctcctcgtcatcgagggctacaagacggtgggcgaccgggcgccctacccggccagttncatggtcgcccaggtcaccgggtcccaacggcttcgtcctctttcgaaaagtccccaacttcccgggtagcccatccccacccccaagggggggtggccctctttttggggggaacacccggcaaagggggggggtcccgtttcccaaagaa

SEQ ID NO: 14268 - protein, 147 aa, Zea mays
  misc_feature: Ceres CLONE 1375796-F
  misc_feature (73)..(73): Xaa is any aa, unknown, or other
  misc_feature (95)..(95): Xaa is any aa, unknown, or other
  misc_feature (102)..(102): Xaa is any aa, unknown, or other
  misc_feature (125)..(125): Xaa is any aa, unknown, or other
MLAVFSGQVVEVPAELVAAGSRTPSPKTKASQLVGRFLAASEPGRVRAARRPRPPRLLPHQPGAPPPQVVRGXGTRCSACFEGVLGQPGSSEPAXRAVKKGXHEVLLVIEGYKTVGDRAPYPASXMVAQVTGSQRLRPLSKSPQLPG

SEQ ID NO: 14269 - DNA, 725 bp, Zea mays
  misc_feature: Ceres CLONE 1375798-F
  misc_feature: Encodes the peptide sequence at SEQ ID NO. 14270
  misc_feature (483)..(483): n is a, c, t, g, unknown, or other
  misc_feature (518)..(518): n is a, c, t, g, unknown, or other
  misc_feature (519)..(519): n is a, c, t, g, unknown, or other
  misc_feature (540)..(540): n is a, c, t, g, unknown, or other
  misc_feature (555)..(555): n is a, c, t, g, unknown, or other
  misc_feature (603)..(603): n is a, c, t, g, unknown, or other
aaagctggagctccccgcggtggcggccgctctagaactagtggatcccccgggctgcaggaattcgcacgagaccattacctagaacacctaatcgaaaaactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcantcaagccccgtgcagctgcagggaaccctgcgcgnntgcagcaccccgatcctgggncagtgcgtcgagttnctgaggcatcagtgcagcccgaacgcgacgccctactgctcggctcantggcagtcgttgcgggcagcagtggtgccagcagctcagggaaggtggagccgcagcaccggtaccaggggatcttcggtttggtccctcaggccatcctgcaaaaacacccgcaaaagggc

SEQ ID NO: 14270 - protein, 187 aa, Zea mays
  misc_feature: Ceres CLONE 1375798-F
  misc_feature (107)..(107): Xaa is any aa, unknown, or other
  misc_feature (119)..(119): Xaa is any aa, unknown, or other
  misc_feature (131)..(131): Xaa is any aa, unknown, or other
  misc_feature (147)..(147): Xaa is any aa, unknown, or other
MRVLLVALALLALAASATSTHTSGGCGCQPPPPVHLPPPVHLPPPVHLPPPVHLPPPVHLPPPVHLPPPVHVPPPVHLPPPPCHYPTQPPRPQPHPQPHPCPCQQPXSSPVQLQGTLRXCSTPILGQCVEXLRHQCSPNATPYCSAXWQSLRAAVVPAAQGRWSRSTGTRGSSVWSLRPSCKNTRKR

SEQ ID NO: 14271 - DNA, 764 bp, Zea mays
  misc_feature: Ceres CLONE 1375799-F
  misc_feature: Encodes the peptide sequence at SEQ ID NO. 14272
  misc_feature (348)..(348): n is a, c, t, g, unknown, or other
  misc_feature (352)..(352): n is a, c, t, g, unknown, or other
  misc_feature (407)..(407): n is a, c, t, g, unknown, or other
  misc_feature (444)..(444): n is a, c, t, g, unknown, or other
aagctggagctccccgcggtggcggccgctctagaactagtggatcccccgggctgcaggaattcgcacgagaccattacctagaacatcctaatcaaaaagaaaaaaaaactaggtcttccactcttcctccactagtctactcggcagatttcactgactctcaccggcggtttttgtgcctccaccggccgccgccatgccgtacctcgtccgcgagcggctctacttcggcggcatcaaagacgccattgccgcactcacggagtcttcctccacgccggacttcacccacgtcctctccgtggtcagctccgcctccatctccttcatcaccgattgccgccngggnctcgagatccccacccgaggagtcctccgcgtagtcgcgggcgaggaggcgcggnaccgactgcggcggtccccccgggacccttatgccgntggttgaagcgcgccggcaccggctggcggtcacgccaatggccgtgccccttggggaacaccgaggaggaggacttggttaaccgcctcaaagcctggctttggttcttcaaggaggacagaaaggccgaaatgcccccccccttgtttttttgggggggggcaagagggcctccccccttgggggtttccctttggaagagaaaaaaaaacccttagaaaaaatttaaaactcctaaagagaatttttgggggccggggcgcaaaaaagtggtttttctggcccgctgtaaatattttaagaagggggtcccaaaggg

SEQ ID NO: 14272 - protein, 83 aa, Zea mays
  misc_feature: Ceres CLONE 1375799-F
  misc_feature (50)..(50): Xaa is any aa, unknown, or other
  misc_feature (70)..(70): Xaa is any aa, unknown, or other
  misc_feature (82)..(82): Xaa is any aa, unknown, or other
MPYLVRERLYFGGIKDAIAALTESSSTPDFTHVLSVVSSASISFITDCRXGLEIPTRGVLRVVAGEEARXRLRRSPRDPYAXG

SEQ ID NO: 14273 - DNA, 742 bp, Zea mays
  misc_feature: Ceres CLONE 1375800-F
  misc_feature: Encodes the peptide sequence at SEQ ID NO. 14274
aaagctggagctccccgcggtggcggccgctctagaactagtggatcccccgggctgcaggaattcgcacgagaccattacctagaacatcctaatcgaaaaaaaacttccatcctcgctaagtcgctcgttctcattgcaactaccgaggtgctcactgtcactgcctgcagatccagctgctcggtctcataaaccctcttgctttgctgctgcagctgaaagtctgcaaccgttgacacacacatgcttagaacctgtacccgagcgtccctcgaccagaagctcgacctcgcctagctctactcctaagaggccaacctcgacggactcaaggagtgatcagtggcgactatgggctccaccatcctcaccctggtgagcgagcgcatgctaccgtggtccaagaacaatatcgaccccaccgagcaggtgatcatcaaactcacgatgtgtagatatggcctacttcatcgccggcgacaagaagatcctgactgctgaagagatgccactcgatctagcaagacgctgaacacctcagggacacctccttgcaggacagcgttcatgcccttcagactgcttctagtcgcgagactagaactacgtgcagagctagctactaactctatttacagtttgccgatgcaagcaacagatgcccaacgatgcatgactgactaacctatgtcattgcgacgatgctgaccgtggatgtgctattatactactactacaa

SEQ ID NO: 14274 - protein, 49 aa, Zea mays
  misc_feature: Ceres CLONE 1375800-F
MGSTILTLVSERMLPWSKNNIDPTEQVIIKLTMCRYGLLHRRRQEDPDC

SEQ ID NO: 14275 - DNA, 729 bp, Zea mays
  misc_feature: Ceres CLONE 1375804-F
  misc_feature: Encodes the peptide sequence at SEQ ID NO. 14276
  misc_feature (545)..(545): n is a, c, t, g, unknown, or other
  misc_feature (549)..(549): n is a, c, t, g, unknown, or other
  misc_feature (552)..(552): n is a, c, t, g, unknown, or other
aagctggagctccccgcggtggcggccgctctagaactagtggatcccccgggctgcaggaattcgcacgagaccattacctagaacatcctaatcgaaaaatcccaaatctcaacccaagaacaaaaatggccaccgccaccactgaagccgaagttcgtgagtacctacgaacgaagctcggtcgcctcaaggaacagctgaaagacatggcctccaggcaccccgacgctggagccgcggccgtcatcgctgtcagtgccgtgggcgcctacttcttgtagcccgtggtggcctcgcccgtggccatgatgaacgcccctggatccgaagtagagctcggctcccatgcggagattttcgagaaaaatgagctgcacttaaatgtccatgagcccgtggaaggttacgcacatgtccccgctttggggaactgaccatcaacaagtggacttgaagctcgagaacagctaccgtaccgacccttcttttctctggcaaacagaggatgatataatttcctttcccagggaaccagaccgganttcnggnttttttttatctgacaaacaaccttgtgtgcgggactggccactttggataaaaatcggaattttttttaggaacataagcaacgccaaagccccaaaaaaccccccaataaaaaaccaaaaaaagttttatcgaatccgtgtcaccctttagagggggccccgggaacccattttg

SEQ ID NO: 14276 - protein, 51 aa, Zea mays
  misc_feature: Ceres CLONE 1375804-F
MATATTEAEVREYLRTKLGRLKEQLKDMASRHPDAGAAAVIAVSAVGAYFL

SEQ ID NO: 14277 - DNA, 690 bp, Zea mays
  misc_feature: Ceres CLONE 1375808-F
  misc_feature: Encodes the peptide sequence at SEQ ID NO. 14278
  misc_feature (408)..(408): n is a, c, t, g, unknown, or other
  misc_feature (479)..(479): n is a, c, t, g, unknown, or other
  misc_feature (482)..(482): n is a, c, t, g, unknown, or other
  misc_feature (520)..(520): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (566)..(566): n is a, c, t, g, unknown, or other
  misc_feature (572)..(572): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (583)..(583): n is a, c, t, g, unknown, or other
  misc_feature (584)..(584): n is a, c, t, g, unknown, or other
  misc_feature (586)..(586): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
aaagctggagctccccgcggtggcggccgctctagaactagtggatcccccgggctgcaggaattcgcacgagaccattacctagaacatcctaatcgaaaaacccccaaaaaaaatctcgcgtgccgccggcggccaccaccatcactgccatgatcagcatcctcgcgcaggagcgcctcctcgggttcgccctgggttccgtctccatcggcggcttcgtcctccaccagcgccgggccatctaccgttcaatcgctgaagccgacgggtcgccctacttttaccagcctggtgaaattgccagtcgaagaagctcaactgaactggctcatgtatggaacaaggcagtggacgagacccttgggcgacttgttgtgtaccttagttcgcgtgggtggtgattcnagctccatgttgagcatggtaacccgagaaaactctttttcagccactgatgtgctcatacctccctgtanccngatgaacatgtatttttttttaaaaagagatacttccnatgaccgatttatctgaaaaaannnnnnnnnnnnnnnnnannnnangaaaanannnnnnnnannanttttnnnaaaaaaaaaagcttatcgatccgtccactcgggggggggccggacccatttcccctaagggagtcgatacgcgggtcactgccgggttttaaacggg

SEQ ID NO: 14278 - protein, 83 aa, Zea mays
  misc_feature: Ceres CLONE 1375808-F
MISILAQERLLGFALGSVSIGGFVLHQRRAIYRSIAEADGSPYFYQPGEIASRRSSTELAHVWNKAVDETLGRLVVYLSSRGW

SEQ ID NO: 14279 - DNA, 671 bp, Zea mays
  misc_feature: Ceres CLONE 1375811-F
  misc_feature: Encodes the peptide sequence at SEQ ID NO. 14280
  misc_feature (458)..(458): n is a, c, t, g, unknown, or other
aaagctggagctccccgcggtggcggccgctctagaactagtggatcccccgggctgcaggaattcgcacgagaccattacctagaacatcctaatcgaaaaagattccgcattcctctctgtcacctccgctgcgccgccagcccgccatcacataacttcgccttctatcccttcgtaaacccttctctcttcttcccgcggcctgctcgttcgatctgtccagcagacttgaggttccgagcggccggaaaccagcggcaaacgtcggcatggcgctcgtattgcattctggggctggaaacaaaaatgccttcaaggcacttattgctgcagaatacagtggggtcaaggttgagttgaccaaggattttgagatgggtgtctccaacaagacccctgagtttctaaagatgaacccccttgggaaggttcctgttctggagactcctgatggncctgtttttgagagtaatgctattgcgcgctatgttgctcgcttgaaggatgacaaccctcttttcgggtcttcccgtattgacaagcccacgttgagcagtggatggactttgctgcaacagaaagtgatcctagtgttggatggtacttgtatcccaggcttgggtacatcccttatgctcacacgactgagggaacagctattgcttcat

SEQ ID NO: 14280 - protein, 133 aa, Zea mays
  misc_feature: Ceres CLONE 1375811-F
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
MALVLHSGAGNKNAFKALIAAEYSGVKVELTKDFEMGVSNKTPEFLKMNPLGKVPVLETPDGPVFESNAIARYVARLKDDNPLFGSSRIDKPTLSSGWTLLQQKVILVLDGTCIPGLGTSLMLTRLREQLLLH

SEQ ID NO: 14281 - DNA, 618 bp, Zea mays
  misc_feature: Ceres CLONE 1375814-F
  misc_feature (203)..(203): n is a, c, t, g, unknown, or other
  misc_feature (283)..(283): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcgnacgacgacccatggggaagggtaagggggtgcatcatggtgggcgttcctcctgttcgccggggggtggtggcctaacanccacgcccggggggaggaacgaatggtccaacgggacccaaggagacctgggggggcaaccagcgtgggagggcaaaaccgaaggaccccccccaaaaaggatggaaaaaaaggggccccaaggcccaccaaaattaaccggggaaagggaaaagggggggaaacccaaattcccttccaaggggaggagggggggggccagttttgtccccccaaagggcccccggggggaaaaccaaagggggaggaggggccccccccggggagtgggcccaaaatgagaaaaaaaaaaacccccccaaaaaaaagcgcgaaaatcccccaaaaagaggccc

SEQ ID NO: 14282 - DNA, 715 bp, Zea mays
  misc_feature: Ceres CLONE 1375816-F
  misc_feature: Pfam Name: PX Pfam Description: PX domain
aaagctggagctccccgcggtggcggccgctctagaactagtggatcccccgggctgcaggaattcgcacgagaccattacctagaacatcctaatcaaaaaccttccaaccggacttgagtcacttgactccgccgcgggattccccgccagatctcattctcgccccaaccctaaccgccgacggtggccatgatggccaccgagcccttgtccccggggaatctcgtcgaggacgtcgaaacactacccctggactcctcctccactctcgcggctacgacggacccgctgctccgcccacttcccccctcgtccaccttctctcccaccgccggtgagaaccatggcgcgtttctggactaggaggatgaggacgtggtggatgacttcacgcctccgctggctccccatgccgctacggccgcgacgaagtcccgcgaggcgtcaccgtggttcgctgagatcactgtctccgagccctagaagcacgcggagcccgcgaccggagccgtgggcgtcattcccggctcggccagctacgtctcctacctcatcgccactcaggtgccgaacggaagcgagttccgcgtgcgtcggcgattccgtgacgtcgtggcgctcggcgaccgcctcgcggagacccaccgcggcctctttgtaccggggcggtccaacaagaaaatcgtcgaagggcaggtcatgcaacggcaca

SEQ ID NO: 14283 - DNA, 765 bp, Zea mays
  misc_feature: Ceres CLONE 1375826-R
  misc_feature (651)..(651): n is a, c, t, g, unknown, or other
ccaattgggtaccgggccccccctcgaggtcgacggtatcgataagcttttttttttttttttttatccgacagaaactaaacgttcaacatttccacttcggacgccatttagcagagataagttcagaacttcaaaatacttggggtacaatctaagtacacaagccaactcagcacataattctgtctagggtagaccacacaaactacggcggtcgaccaggcatgttgagcagatccgtttggagcattgctgtaacgttctctcatcttctcctcgaacctatacttgaactcacagacttgtcacaagcacaggcaaacgatacagatagactcaagggataaaaggctttacctgccgcatacactatgtcacgggttccttctacctgccgcgcctagaggaaggtgaactgctgctgcagctgtcactggagacgcttcttcctcctctaagatgctttctagggctgcggctccttgatacccatcttggtccctttctcggtggagtacgtgatcgagaatatgatgagtctgacctaccacgactcaatggaggccctctgtccgcttcttggagaaattgatctggaagccgagaacctaaggagtcccgccagcagtagagcgacttgaatcgacntgccatgtgatcggcccttcttgggagggctccatcaacccaccttaggaaagtgcgttagcgcacgactaaggaagcttcaggggcaagcaacctggcgttgcctgattcgag

SEQ ID NO: 14284 - DNA, 754 bp, Zea mays
  misc_feature: Ceres CLONE 1375826-R2
  misc_feature (1)..(1): n is a, c, t, g, unknown, or other
ngggatatttgtcatattttctcttcagactgtctattgcagaggtatgttcagaacttcaaaagccttggggtacaatgatggtacacgtgccaactcagcacataactctgtctggggtacaccacacaatctagggcggtataccaggtcatgttgagcagatgccgtttggagctgcgctgtagcgctctcatatcttcccctcgaacctatacgtgcactcacggattgtcacacgcacacgcaaacgatacagatagtctcaagggataaaaggcttcacgtagccgcatacacctgtgtcacgggctccctatacccgccgcgtctaggggaaggtgaactgcttctgcagctgtctctagagactcttcttccccctctagagaggtctttatggggccggggctcctagatactctccttggctcctttctcggtagagcacgtgaccagatatctgaagagtgagacctaccacgccgctgtggatgcccctctccccttattggaaaaattgatctggagcgagaacctgggtgtccgccagctagagagccactggcatccactcccatgagggcgaccttcttagaggtgcccacttgcccctgacgaggtggcgagcgccgaaaaaggaaccttcaggtcctgagcctgcggagctttttgaaataattatcaaaacccttccctggaaaataacttcccccccggtggccaaaaatgcctccaaaaagggggggggggc

SEQ ID NO: 14285 - DNA, 736 bp, Zea mays
  misc_feature: Ceres CLONE 1375827-F
  misc_feature: Encodes the peptide sequence at SEQ ID NO. 14286
  misc_feature (338)..(338): n is a, c, t, g, unknown, or other
  misc_feature (339)..(339): n is a, c, t, g, unknown, or other
  misc_feature (372)..(372): n is a, c, t, g, unknown, or other
  misc_feature (415)..(415): n is a, c, t, g, unknown, or other
  misc_feature (430)..(430): n is a, c, t, g, unknown, or other
  misc_feature (487)..(487): n is a, c, t, g, unknown, or other
  misc_feature (496)..(496): n is a, c, t, g, unknown, or other
  misc_feature (503)..(503): n is a, c, t, g, unknown, or other
  misc_feature (588)..(588): n is a, c, t, g, unknown, or other
aagctggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcgnngcgttactcccagaagcggttccgcaagcgcantgcccgatcgtcgagcgcctcacaaactccctcatgatgcacnggcgcaacaacggcnagaaggtcatggctgtccgcatcatcaagcataccctggagatcattcacctgctcnacgatgccnacccccnatcagtcgtcgtcgacgcgatcatcaacagtggaccccgtgaggatgccacccgtattggtccccctggtgttgtgagggagcangccgtggatatctcaccccctgaggagggtgaacaggccatctacctcctcaccactggtgccagggaagagtgcttttcggaacatcaaaaccattgccgagtgccttggaaatgacctgatcaacgctgccaagggttcatccaaa

SEQ ID NO: 14286 - protein, 99 aa, Zea mays
  misc_feature: Ceres CLONE 1375827-F
  misc_feature (1)..(93): Pfam Name: Ribosomal_S7 Pfam Description: Ribosomal protein S7p/S5e
  misc_feature (4)..(4): Xaa is any aa, unknown, or other
  misc_feature (9)..(9): Xaa is any aa, unknown, or other
  misc_feature (28)..(28): Xaa is any aa, unknown, or other
  misc_feature (31)..(31): Xaa is any aa, unknown, or other
  misc_feature (33)..(33): Xaa is any aa, unknown, or other
  misc_feature (61)..(61): Xaa is any aa, unknown, or other
MMHXRNNGXKVMAVRIIKHTLEIIHLLXDAXPXSVVVDAIINSGPREDATRIGPPGVVREXAVDISPPEEGEQAIYLLTTGAREECFSEHQNHCRVPWK

SEQ ID NO: 14287 - DNA, 707 bp, Zea mays
  misc_feature: Ceres CLONE 1375828-F
  misc_feature: Encodes the peptide sequence at SEQ ID NO. 14288
  misc_feature (404)..(404): n is a, c, t, g, unknown, or other
  misc_feature (490)..(490): n is a, c, t, g, unknown, or other
  misc_feature (491)..(491): n is a, c, t, g, unknown, or other
  misc_feature (562)..(562): n is a, c, t, g, unknown, or other
  misc_feature (563)..(563): n is a, c, t, g, unknown, or other
  misc_feature (606)..(606): n is a, c, t, g, unknown, or other
  misc_feature (629)..(629): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcnagagcgagtgccgcgagcggcaccagcaagctgacgcgggcgaggacggcgacagcggcgtggacgcctacgtctcccgctccggnnaggggcgagtgcccggcgcagtgcctgcgccgccacgagggccagccgtgggagacccaggagtgcatganngcgtgccgccgccgcggactggccgtcgactggagcaagagtnacggtcgcgcacgagagcgcggnaagtgcccggagaggtgcgagcgccacaccgcgggactggtggagagcacctgcgggaaaaannnngggggggggggg

SEQ ID NO: 14288 - protein, 164 aa, Zea mays
  misc_feature: Ceres CLONE 1375828-F
  misc_feature (64)..(64): Xaa is any aa, unknown, or other
  misc_feature (93)..(93): Xaa is any aa, unknown, or other
  misc_feature (116)..(116): Xaa is any aa, unknown, or other
  misc_feature (117)..(117): Xaa is any aa, unknown, or other
  misc_feature (131)..(131): Xaa is any aa, unknown, or other
  misc_feature (139)..(139): Xaa is any aa, unknown, or other
  misc_feature (160)..(160): Xaa is any aa, unknown, or other
  misc_feature (161)..(161): Xaa is any aa, unknown, or other
MGKGSVGASWWAFLLLAGVLLVVAATAGAEDGVVERDRKEDLRWCKQACEWQYGKDTPRKRECXSECRERHQQADAGEDGDSGVDAYVSRSGXGRVPGAVPAPPRGPAVGDPGVHXXVPPPRTGRRLEQEXRSRTRARXVPGEVRAPHRGTGGEHLREKXXGGG

SEQ ID NO: 14289 - DNA, 700 bp, Zea mays
  misc_feature: Ceres CLONE 1375829-F
  misc_feature: Translation starting site: 215
  misc_feature: SWISSPROT Homolog: EC 1.11.1.7 Peroxidase
  misc_feature (353)..(353): n is a, c, t, g, unknown, or other
  misc_feature (416)..(416): n is a, c, t, g, unknown, or other
  misc_feature (447)..(447): n is a, c, t, g, unknown, or other
  misc_feature (448)..(448): n is a, c, t, g, unknown, or other
aaagctggagctccccgcggtggcggccgctctagaactagtggatcccccgggctgcaggaattcgcacgagaccattacctagaacatcctaatcgaaaatcgcgccagagccacgcacgctagtgtcagtggcacgcaggcagccgcgcgcaccgaggggagaccagagctagcggcgaggccaagggcaagggcaagggcgcggacggcaatggcgagagctggaggcggcggtccgttcttcccggtccgcggcgcggcgctggtggtcgtgctgctaggcatcgtcgcgggcgcggcgagggcgcagctgcggctgaactactacggcagctcgtgccccagcgcgnagtccacggtgcgctccgtcatctcgcagcgccctcagcagagctttcgccgtggggcccggnacgctccggctcttctttcacgactgcttcnncaggggatgccaaccctccgtgatgctgatggcgcccaacggggacgacaaaagccccagggggcgggagccccccctggccccggagcccggggaccctttcaaaagggaaaggggggccgggaaggccccccccggggggcccggaagggttctggggggggaattcccccgcgggggcgcccgggggacgcccctcccttgtgggggggggccaaatattccggggggatttgggcgcggggaaaaaaa

SEQ ID NO: 14290 - DNA, 669 bp, Zea mays
  misc_feature: Ceres CLONE 1375830-F
  misc_feature: Encodes the peptide sequence at SEQ ID NO. 14291
  misc_feature (52)..(52): n is a, c, t, g, unknown, or other
  misc_feature (415)..(415): n is a, c, t, g, unknown, or other
  misc_feature (426)..(426): n is a, c, t, g, unknown, or other
  misc_feature (439)..(439): n is a, c, t, g, unknown, or other
  misc_feature (442)..(442): n is a, c, t, g, unknown, or other
  misc_feature (443)..(443): n is a, c, t, g, unknown, or other
  misc_feature (456)..(456): n is a, c, t, g, unknown, or other
aaagctggagctccccgcggtggcggccgctctagaactagtggatcccccngggctgcaggaattcgcacgagaccattacctagaacatcctaatcgaaaagactaggccagggttccatcccaccccgccgccatccgatccgatggagggcggcgactcgtccggcgccggcggcggcgccggctccggtggcgccgtggcggcggcggccaagtggcggagcgacgcgtcgcggtcgttcagtactacctggaccgctcccgcctcagccactggggggtggctcggcacgctcgccgccgcggcaatctacgcgctgcgggtctacatggcgcagggcttctacatcgtcacctacgggcttgggatctacctccctcacctcctcatcggtttcctctcccccatggntcgacccgagntcgacccctccgncgnncgcgaggggccgncgctgccaacccgggggtctgacgaggtcaagcccttcatcaggggtttccccgagttcaaggtctgggatggaatcccaaaagttttggtggagcttttggggaggacttcctcccgggggtggaggttccgggttttgggccaaaccccctggaaaaggggtgggtccctttggcctaaaaggggagccccaagtggggatagagcaaaaa

SEQ ID NO: 14291 - protein, 174 aa, Zea mays
  misc_feature: Ceres CLONE 1375830-F
  misc_feature (8)..(143): Pfam Name: Rer1 Pfam Description: Rer1 family
  misc_feature (90)..(90): Xaa is any aa, unknown, or other
  misc_feature (94)..(94): Xaa is any aa, unknown, or other
  misc_feature (98)..(98): Xaa is any aa, unknown, or other
  misc_feature (99)..(99): Xaa is any aa, unknown, or other
  misc_feature (104)..(104): Xaa is any aa, unknown, or other
MEGGDSSGAGGGAGSGGAVAAAAKWRSDASRSFSTTWTAPASATGGWLGTLAAAAIYALRVYMAQGFYIVTYGLGIYLPHLLIGFLSPMXRPEXDPSXXREGPXLPTRGSDEVKPFIRGFPEFKVWDGIPKVLVELLGRTSSRGWRFRVLGQTPWKRGGSLWPKRGAPSGDRAK

SEQ ID NO: 14292 - DNA, 647 bp, Zea mays
  misc_feature: Ceres CLONE 1375831-F
  misc_feature: Encodes the peptide sequence at SEQ ID NO. 14293
aaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcaggcattggtacaaaccatcagggcacagcagctgcagcaactcgtggctacctgtgatcaaccaagtaagctctggcaaaccttttctccctactcttaagaacaacaatttcctttcattcaaccaattggctaaatttgaaccgggggtggtttattttgcgagaaacaagctataacacattcaaccccggtttgtttcgggcctaattcctagaaaaaaaaaaag

SEQ ID NO: 14293 - protein, 115 aa, Zea mays
  misc_feature: Ceres CLONE 1375831-F
MATKIFSLLMLLALSACVANATIFPQCSQAPIASLLPPYLPSMIASVCENPALQPYRLQQAIAASNIPLSPLFQQSPALSLVQALVQTIRAQQLQQLVATCDQPSKLWQTFSPYS

SEQ ID NO: 14294 - DNA, 677 bp, Zea mays
  misc_feature: Ceres CLONE 1375833-F
  misc_feature: Encodes the peptide sequence at SEQ ID NO. 14295
aaagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggaacctagctcgctctgctagcctaccatggctgatcaccaccggtgtgcgacgaaaggaggtgggggctacggcgacctccagcgcgtgggtgacatgcacggcgagcggcacaaccagcataagcaggtcgccatgatgacggcgctcaaggccgcgacggacgcgaccttcagcgggtcgatgctgttgctgtctgttatgatcgtgatcgggagcgtgatcgagctcacggcggccacccccgagctggcgatcttcagacgtggctgggagcccgtcgacatcgcgctgatgttcatggcggcaggtgctgtcacctcgagtggactcggtgtcattgaactgtccgaagtctccaggcatgaccaggacctgacgggcaagcacgcgtacggtatccgaccagttggaacacatcgatgatagggtggaacccacggtcaggggatatcagggtttgcatcactagagcgggatcaacacggcgtagggggaccttgaaaa

SEQ ID NO: 14295 - protein, 132 aa, Zea mays
  misc_feature: Ceres CLONE 1375833-F
  misc_feature (36)..(132): Pfam Name: Oleosin Pfam Description: Oleosin
MADHHRCATKGGGGYGDLQRVGDMHGERHNQHKQVAMMTALKAATDATFSGSMLLLSVMIVIGSVIELTAATPELAIFRRGWEPVDIALMFMAAGAVTSSGLGVIELSEVSRHDQDLTGKHAYGIRPVGTHR

SEQ ID NO: 14296 - DNA, 689 bp, Zea mays
  misc_feature: Ceres CLONE 1375836-F
  misc_feature: Encodes the peptide sequence at SEQ ID NO. 14297
  misc_feature (179)..(179): n is a, c, t, g, unknown, or other
  misc_feature (210)..(210): n is a, c, t, g, unknown, or other
ccgaagctggagctcaccgcggtggcggccgctctagactagtggatcccccgggctgcaggaattcgcacgagaccattacctagaacatcctaatcgaaaaattcttccttccttctttccttcaccaatggccacgagaatagccttgtgtcttctcggccacgtcctcctcgcgntcgcgtcgatggcagtggcggcggcggccgntgacgcgggcaagatcggcatctgccacggccgcgttggaagtaacctcccgccgccgtcggccgccgaggaactgctcatgcggaatgggatcaccaaggtgcgcatcttcatggcggacccgggcgagctcccgaccttacgccgagcggggccccgcgcggggggggggggggcgccacgacaatcacagctgcctgccccgggggcggcccgagggcaggaccagaagggcgggcgagctacgacgtggcgggagagcgaggacgtgggggggggcggggggagaggaggccctccaggccgacggaagtgggggggatgtgaggtgggacgcatagtgcgagagagcgcaaacatggtctgccggtcgcgtgctccccgccgcggccctgggtgcctgcggggcgaaggaggtgtccggacggggcgcccccggggcttttgtgcgcgggaggaacgaggacggggatggggag

SEQ ID NO: 14297 - protein, 186 aa, Zea mays
  misc_feature: Ceres CLONE 1375836-F
  misc_feature: SWISSPROT Homolog: EC 3.2.1.39 Glucan endo-1,3-beta-D-glucosidase
  misc_feature (17)..(17): Xaa is any aa, unknown, or other
  misc_feature (27)..(27): Xaa is any aa, unknown, or other
MATRIALCLLGHVLLAXASMAVAAAAXDAGKIGICHGRVGSNLPPPSAAEELLMRNGITKVRIFMADPGELPTLRRAGPRAGGGGAPRQSQLPAPGAARGQDQKGGRATTWRESEDVGGGGGRGGPPGRRKWGGCEVGRIVRESANMVCRSRAPRRGPGCLRGEGGVRTGRPRGFCAREERGRGWG

SEQ ID NO: 14298 - DNA, 721 bp, Zea mays
  misc_feature: Ceres CLONE 1375837-F
  misc_feature: Encodes the peptide sequence at SEQ ID NO. 14299
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (30)..(30): n is a, c, t, g, unknown, or other
  misc_feature (31)..(31): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
nnnnnnnnnnnnnnnnnnnccccccccccnnccgggggcgnnnnnnnnntcaagctggagctccccgcggtggcggccgctctagaactagtggatcccccgggctgcaggaattcgcacgagaccattacctagaacatcctaatcgaaaaaaagccgtcccttcccaaccctcccttcgatccctggggcggcggccgggaccatgacgaccggatccaacggcgacggaggcggcgcggggtcctggtacccgcagcgccgcccgcactacgggtacggcggggggtccgcctccttccgcggctgctgctgctgcctcttcctgctgctcaccttcctggcgctcctcgctctggccgtcgcgctcgtcgtcgtgctcgtggggaagccccgcaaaccgcagttcgacctcaaccaggtggccgtgcagtacctcctggtggcctcgccgacgacgtcgccgggccggcgtgcccccccggggccgcctacctctccctcaacatcacggctgctcttcaccggccgagaaaccccaacaaggggggggcattccgggaacgggggccccgcggggtttcgacagtcatggtacccacggggggggccccgctccgggggggtgggggggggggggggccccggggtttccgaagagaagccccgggggaaaaagggaaacccccgggctggggttcacagggacacccgcgggggt

SEQ ID NO: 14299 - protein, 172 aa, Zea mays
  misc_feature: Ceres CLONE 1375837-F
MTTGSNGDGGGAGSWYPQRRPHYGYGGGSASFRGCCCCLFLLLTFLALLALAVALVVVLVGKPRKPQFDLNQVAVQYLLVASPTTSPGRRAPPGPPTSPSTSRLLFTGRETPTRGGHSGNGGPAGFRQSWYPRGGPRSGGVGGGGGPGVSEEKPRGKKGNPRAGVHRDTRGG

SEQ ID NO: 14300 - DNA, 661 bp, Zea mays
  misc_feature: Ceres CLONE 1375840-F
  misc_feature: Encodes the peptide sequence at SEQ ID NO. 14301
aaagctggagctccccgcggtggcggccgctctagaatagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgccccgtgacaagacattggggggagggatgatgctttcagcaccttcttcagtgaaatggcgctggaaaccacgcccccgtgctgtttttgttgacctgagcccactggcatcgatgagggaggacggcccctatcgccagttcttcctccggagaggttatccgggggaggaggatgcagccaaaaacttcgtcggggccacaaaaccttggaaaggaaattgttgacctgtccctagccccaaaggaagtttgaaaaaattggccgggcccccggggtccccccttttaacgttgtggggggaggaaaggttttgtgtttgtt

SEQ ID NO: 14301 - protein, 111 aa, Zea mays
  misc_feature: Ceres CLONE 1375840-F
MRECISIHIGQAGIQVGNACWELYCLEHGIQADGQMPRDKTLGGGMMLSAPSSVKWRWKPRPRAVFVDLSPLASMREDGPYRQFFLRRGYPGEEDAAKNFVGATKPWKGNC

SEQ ID NO: 14302 - DNA, 680 bp, Zea mays
  misc_feature: Ceres CLONE 1375844-F
  misc_feature: Encodes the peptide sequence at SEQ ID NO. 14303
  misc_feature (611)..(611): n is a, c, t, g, unknown, or other
  misc_feature (651)..(651): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagatnattgcactggtctcccaggcttcctcgtcttcaacgctgntggngggagaacgggctcttgggcttgtt

SEQ ID NO: 14303 - protein, 150 aa, Zea mays
  misc_feature: Ceres CLONE 1375844-F
  misc_feature (49)..(150): Pfam Name: Tubulin Pfam Description: Tubulin/FtsZ family, GTPase domain
  misc_feature (128)..(128): Xaa is any aa, unknown, or other
  misc_feature (141)..(141): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADXCTGLPGFLVFNAXGGRTGSWAC

SEQ ID NO: 14304 - DNA, 665 bp, Zea mays
  misc_feature: Ceres CLONE 1375845-F
  misc_feature: Encodes the peptide sequence at SEQ ID NO. 14305
  misc_feature (345)..(345): n is a, c, t, g, unknown, or other
  misc_feature (372)..(372): n is a, c, t, g, unknown, or other
  misc_feature (373)..(373): n is a, c, t, g, unknown, or other
  misc_feature (399)..(399): n is a, c, t, g, unknown, or other
  misc_feature (427)..(427): n is a, c, t, g, unknown, or other
  misc_feature (439)..(439): n is a, c, t, g, unknown, or other
  misc_feature (440)..(440): n is a, c, t, g, unknown, or other
  misc_feature (448)..(448): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcgaaaaccgtcaggctgtcactgtccccctcaccgccgccgtcctcgtcaccacacctcacccgttgctcccactccttccagaaccacctcctcgccaccgtggctgcctgccctgcccgctataagactcttcactcccgctgcgacgcagtcctcacaagcaccagaccaattaactagcttcttctagctctagctaggctcgtctgctgcaagaaagtacagcgcaggcatggaggggaaaggnagagacgtccgcctgggcgcccacagnntctcgagcgcagcccatcggcacggncgcgcagggcacggacgacaagactacnaggagcccccgnncgggccgntcttcgagcccggaaggtccaggtctggtccttctaacgggcgggatcgccgaagtgggggcaacttcctcttccttaaaatttcatccccaccggtaggggggttcccagccacccccaaggggccccccggggatcgcgccnnnnnnnnnnnnnnnnnnnnnnnnnnnnnnnnnnnnnnnnnnnnnnnnnnnnnnnnnnnnnnnnnnnnnnnnnn

SEQ ID NO: 14305 - protein, 87 aa, Zea mays
  misc_feature: Ceres CLONE 1375845-F
  misc_feature (14)..(14): Xaa is any aa, unknown, or other
  misc_feature (15)..(15): Xaa is any aa, unknown, or other
  misc_feature (33)..(33): Xaa is any aa, unknown, or other
  misc_feature (37)..(37): Xaa is any aa, unknown, or other
  misc_feature (40)..(40): Xaa is any aa, unknown, or other
MEGKGRDVRLGAHXXSSAAHRHGRAGHGRQDYXEPPXGPXFEPGRSRSGPSNGRDRRSGGNFLFLKISSPPVGGFPATPKGPPGDRA

SEQ ID NO: 14306 - DNA, 682 bp, Zea mays
  misc_feature: Ceres CLONE 1375850-F
  misc_feature: Translation starting site: 229
  misc_feature: SWISSPROT Homolog: EC 2.4.1.207 Xyloglucan:xyloglucosyl transferase
  misc_feature: SWISSPROT Homolog: EC 3.2.1.73 Licheninase
aaagctggagctccccgcggtggcggccgctctagaactagtggatcccccgggctgcaggaattcgcacgagaccattacctagaacatcctaatcgaaaaagcaccagttgcttcacggcttcatcatcactccactagccagtcagctactggcctacagctagccgcctcctctcctctcatcccatcccatctcatctccgacaagcgaagcagagcactggcatgagcatggaccgcatggcgcggcgttccgtgtccttgctcctcgctctggctctcctggccgccgcggcgtcggcggactcgtggctgtacgagaagttcacgacggagggcaacgtgcgcgcggactacaacgcgcaggggcagcaggtgacgtctctgatcctgacgcagcagtccggcggcgccttcagctcgcggcagaagtacctgttacgggagttcagcatccagatgaggctgatcccgggcaactccgcgggcaccgtgacctccttctacctgtcgtcgggcgacgggcccgggcacgacgagatcgacatggagttcatgggcaacgccagcgggcaggcccgtggggctgaacaccaacgtgtgggccaacggcgacgggaagaaggagcaccagttctacctggggttcgacccgggccgcgacttccacacctacacc

SEQ ID NO: 14307 - DNA, 700 bp, Zea mays
  misc_feature: Ceres CLONE 1375853-F
  misc_feature: Encodes the peptide sequence at SEQ ID NO. 14308
  misc_feature (397)..(397): n is a, c, t, g, unknown, or other
  misc_feature (427)..(427): n is a, c, t, g, unknown, or other
  misc_feature (469)..(469): n is a, c, t, g, unknown, or other
  misc_feature (542)..(542): n is a, c, t, g, unknown, or other
aagctggagctccccgcggtggcggccgctctagaactagtggatcccccgggctgcaggaattcgcacgagaccattacctagaacatcctaatcgaaaaattcacacaccacacctcccgaactacaagtttcgcttctcgtcgcgacgactgggcgagaccgccgccgccgcctgagttctgtagaaatggctgatggtgaggacatccagcctcttgtctgcgacaatggcactggaatggtcaaggctggttttgctggcgacgatgcaccaagggctgttttccctagtattgttgggcgtcctcgccacactggtgttatggtagggatgggacagaaggatgcgtatgttggcgacgaggcacagtccaagagaggtattctcacgctncagtatccgatcgagcatggtatggtgagncactgggatgacatggaggaaaatctgcatcacactttctancacgagcttcgtgttgccccagaggagccaccctgtgttgctcactgaggctccctttgaaccaaagggccancggggaagaagatggccccaatttatgttcaagacttttcagggttcctgcccaggacccttggcaattcaaggagggggttgccctttttggccccgggggcggaactaaggggatttgtttccccaacctggggggggggggggagcccccactgg

SEQ ID NO: 14308 - protein, 108 aa, Zea mays
  misc_feature: Ceres CLONE 1375853-F
  misc_feature: SWISSPROT Homolog: EC 2.7.10.2 Non-specific protein-tyrosine kinase
  misc_feature (79)..(79): Xaa is any aa, unknown, or other
  misc_feature (93)..(93): Xaa is any aa, unknown, or other
MADGEDIQPLVCDNGTGMVKAGFAGDDAPRAVFPSIVGRPRHTGVMVGMGQKDAYVGDEAQSKRGILTLQYPIEHGMVXHWDDMEENLHHTFXHELRVAPEEPPCVAH

SEQ ID NO: 14309 - DNA, 693 bp, Zea mays
  misc_feature: Ceres CLONE 1375860-F
  misc_feature: Encodes the peptide sequence at SEQ ID NO. 14310
  misc_feature (389)..(389): n is a, c, t, g, unknown, or other
  misc_feature (412)..(412): n is a, c, t, g, unknown, or other
  misc_feature (447)..(447): n is a, c, t, g, unknown, or other
  misc_feature (471)..(471): n is a, c, t, g, unknown, or other
aaagctggagctccccgcggtggcggccgctctagaactagtggatcccccgggctgcaggaattcgcacgagaccattacctagaacatcctaatcgaaaaaaattgaccgccattgtgcaaaccagaaccccttcgccattttcaccaactccctccgatcccggccatggcgggggaggactgccgctccggcgcggaaatggacgcgctcgtacgacgcttgaagctccaccggccgtccccatccccctacgaccccgatccggccgcggcccccgtccccgccaccgccggagacggcgagctgttccggccgcggagagctgccgtgcttgtctgcctcttccggggagacggcagcgagctccgcgtcatcctcactaagngctcggtctccctctccaccacntcgggtgaagtttcattggcaggaggaaagggtcnaggagggtgatgctgatgatgtancaccagcgtttaggagagcaaaagaggagattgggacttgaccccgctcctgggaactgggggttggctccccttaaaaccttcttggccaaaaatcttgggggaagtgtccctggtggtgggatacgggtaaaagaaaaccttttaacctgggctttaaatttgggggggaaaaaaaaaatttggggggcccccggggaagttcccccaggggaggaaacg

SEQ ID NO: 14310 - protein, 95 aa, Zea mays
  misc_feature: Ceres CLONE 1375860-F
  misc_feature (74)..(74): Xaa is any aa, unknown, or other
  misc_feature (93)..(93): Xaa is any aa, unknown, or other
MAGEDCRSGAEMDALVRRLKLHRPSPSPYDPDPAAAPVPATAGDGELFRPRRAAVLVCLFRGDGSELRVILTKXSVSLSTTSGEVSLAGGKGXGG

SEQ ID NO: 14311 - DNA, 717 bp, Zea mays
  misc_feature: Ceres CLONE 1375862-F
  misc_feature: Encodes the peptide sequence at SEQ ID NO. 14312
aaagctggagctccccgcggtggcggccgctctagaactagtggatcccccgggctgcaggaattcgcacgagaccattacctagaacatcctaatcgaaaaaagcagcgagatccaatctagaagagcccctctccctctctctctctctcttcgccgttcgaagctccgcaccccaatctaatcgacacctcgccgagatgggccgcaaggtcttcgtcggtggcaactggaaatgcaatggaaccacagatcacggcgagaagattgtccaaaccctgaatgaagggcaggttcccccttcagatggttgtggaggtccttgtcagccctccttatgtcttccttcctggggactagaggcacctgcgccaagaggggcatggttgcggtttccaaacttgttgggtaacaacggaggtggtttcccccggtggaaagcagggctgaaatgctccctcaaccctggggggtccccgggggctttccttggacactcttgaaaagaaagttcccgctgtgggaaattcacattgaatttgtgtggggaacaaagggggggggtatggcccgggctcacgggactaaaaggcgccttttgctgtggggtgctgccaaaaacctttggggcaaaggggggggctggggtctttccctccccctgaaagagtgtgtggttgctccaccacaaaaaaaattgggtgttgaaaaaaaagg

SEQ ID NO: 14312 - protein, 100 aa, Zea mays
  misc_feature: Ceres CLONE 1375862-F
  misc_feature: SWISSPROT Homolog: EC 5.3.1.1 Triose-phosphate isomerase
MGRKVFVGGNWKCNGTTDHGEKIVQTLNEGQVPPSDGCGGPCQPSLCLPSWGLEAPAPRGAWLRFPNLLGNNGGGFPRWKAGLKCSLNPGGSPGAFLGHS

SEQ ID NO: 14313 - DNA, 643 bp, Zea mays
  misc_feature: Ceres CLONE 1375865-F
  misc_feature: Encodes the peptide sequence at SEQ ID NO. 14314
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
aaagctggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcagcagagacggaggctgctgctgccccggtcgaggctgctgagccggagatagccgcgagaccaagaggtgcgtgggnnnnntttaatacaagaaaaaaagaga

SEQ ID NO: 14314 - protein, 134 aa, Zea mays
  misc_feature: Ceres CLONE 1375865-F
  misc_feature (126)..(126): Xaa is any aa, unknown, or other
  misc_feature (127)..(127): Xaa is any aa, unknown, or other
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPAAETEAAAAPVEAAEPEIAARPRGAWXXFNTRKKE

SEQ ID NO: 14315 - DNA, 692 bp, Zea mays
  misc_feature: Ceres CLONE 1375866-F
  misc_feature: Encodes the peptide sequence at SEQ ID NO. 14316
  misc_feature (579)..(579): n is a, c, t, g, unknown, or other
aagctggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctactttctggagggcagggggcagactcccgtgttccctcggatctttggccacgaggctggaggtatcatagagagtgttggagagggtgtgactgacgtagctccgggcgaccatgtccttcctgtgttcactggggaggggcaaggagtgtgccccactgcaaggcggcagaggggcaccatgtgtgatgtgctcaggatcaacaccgacgcggnggtgatgattgccgatggccaagtcccgggttttccatcaatgggaagcctatctaccactgttgttgggacttccacctccagcgaggacaccgcatgggttgttgggttgg

SEQ ID NO: 14316 - protein, 161 aa, Zea mays
  misc_feature: Ceres CLONE 1375866-F
  misc_feature (34)..(159): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (124)..(124): Xaa is any aa, unknown, or other
MATAGKVIKCKAAVAWEAGKPLSIEEVEVAPPQAMEVRVKILFTSLCHTDVYFLEGRGQTPVFPRIFGHEAGGIIESVGEGVTDVAPGDHVLPVFTGEGQGVCPTARRQRGTMCDVLRINTDAXVMIADGQVPGFPSMGSLSTTVVGTSTSSEDTAWVVGL

SEQ ID NO: 14317 - DNA, 679 bp, Zea mays
  misc_feature: Ceres CLONE 1375868-F
  misc_feature: Encodes the peptide sequence at SEQ ID NO. 14318
  misc_feature (392)..(392): n is a, c, t, g, unknown, or other
aagctggagctccccgcggtggcggccgctctagaactagtggatcccccgggctgcaggaattcgcacgagaccattacctagaacatcctaatcgaaaagacgacgctgacgcggctgaaaatttccacgaacacatagatccgcatcgtcgatccatccgtcctcctcccgacggtacgccagcctgccagagtccgacgcacgcctagggctcctggacacagcagagcccacgccttgactcgctccgttcgagtggagcgcacaggcaccgggcggcgaccagagagggagcggatcgagggggctcggcttgagtggaggagatggaccgcaaggatgtcgggatcctcgccatggacatctacttccgggcctcctgggtgcancaggaagcacttgaggcccatgatggggcgagcaaaggaaagtaccccattgggctggggcaagattgactggccttttttgaccagggtggaggatgccatctccatgagttttggaggtttgtcaattctctggtggaaaaaataaaagatggatccccaggttaaattggccgctttggggggggggaaagggaaccgttttttgaccaaaggcaattcccttcaaaatttggcttgaagccggatttttttggggaagggggaaataacgtggattttgaggg

SEQ ID NO: 14318 - protein, 43 aa, Zea mays
  misc_feature: Ceres CLONE 1375868-F
  misc_feature: SWISSPROT Homolog: EC 2.3.3.10 Hydroxymethylglutaryl-CoA synthase
  misc_feature (21)..(21): Xaa is any aa, unknown, or other
MDRKDVGILAMDIYFRASWVXQEALEAHDGASKGKYPIGLGQD

SEQ ID NO: 14319 - DNA, 643 bp, Zea mays
  misc_feature: Ceres CLONE 1375869-F
  misc_feature: Encodes the peptide sequence at SEQ ID NO. 14320
  misc_feature (480)..(480): n is a, c, t, g, unknown, or other
  misc_feature (496)..(496): n is a, c, t, g, unknown, or other
aaagctggagctccccgcggtggcggccgctctagaactagtggatcccccgggctgcaggaattcgcacgagaccattacctagaacatcctaatcgaaaagtctccaaagcgagaagacgaagaaaggggaaatcgagagatgagctaccagagagtccctcccgaggaaccctaccctcctccaggacatcctcgatctcaggcgcacccttacccaccgccaccagatgtgtacccgcctccccctcggggccatggacatccaccaccaccccatggcgtgtacccgccgccgccgcagggtccttaccccccaccacagcagcctccaccggggtaccagggctacttcaacgaccagcagcgtccttactacccgccgccgcatggagagcatcaacacaacaccaccagggaaacccaggtagctcctctgggttctcaaaggatgttggctgctctctgctgctgctgcgngctgggagaatgctgncgctgcttctgagacgtgagatgtccgggaatccgatcgcaagttatcgtcgctagcattcgggagcaccccaggttatatcatataaaaagaactggggcttgaaataaaccggagggaacaagggtcatgggcttccaggccccc

SEQ ID NO: 14320 - protein, 121 aa, Zea mays
  misc_feature: Ceres CLONE 1375869-F
  misc_feature (113)..(113): Xaa is any aa, unknown, or other
  misc_feature (118)..(118): Xaa is any aa, unknown, or other
MSYQRVPPEEPYPPPGHPRSQAHPYPPPPDVYPPPPRGHGHPPPPHGVYPPPPQGPYPPPQQPPPGYQGYFNDQQRPYYPPPHGEHQHNTTRETQVAPLGSQRMLAALCCCCXLGECXRCF

SEQ ID NO: 14321 - DNA, 659 bp, Zea mays
  misc_feature: Ceres CLONE 1375870-F
aaagctggagctccccgcggtggcggccgctctagaactagtggatcccccgggctgcaggaattcgcacgagaccattacctagaacatcctaatcgaaaaatcaaccatattattgagagccacaagcaacatataacgggcaatccactagcaacgatatagcatgaatggcgaccaagatagtttccctccttatgctccttgctctttctacatgagttgctaacgcgacaaatttccctcaatgctcacgagctcctatagcttcccttcttcccccataccttccatcaattatagcttcaatatgtgaaaacccagctcttcaaccatataggcttcaacaagcaatcgcagcaagaaacatacctgtatcgtccttgatgaatcaacaatcgtcagccctatcttttgtgcagatattggtacaaccatcaggggacacagctgcaaaactcgtgctactctgatcaacaaggagctctggtaaactttctcatactctcagaactagatttgctgcattcaacaattgctacactgaacctgctggttattgccaccacaactattaccatttaaggggtgaattaactggcaaattcccggagaaaggaactttttgtcttttaaccaatggccccaaaaaacccctt

SEQ ID NO: 14322 - DNA, 674 bp, Zea mays
  misc_feature: Ceres CLONE 1375871-F
  misc_feature (501)..(501): n is a, c, t, g, unknown, or other
aaagctggagctccccgcggtggcggccgctctagaactagtggatcccccgggctgcaggaattcgcacgagaccattacctagaacatcctaatcgaaaaatacttttcctccttcagtttttatcacacgtcaatggagtggggctagcaatggcatggtaacttttccaatctttttgcattaaaaaagaaatcctaaagaaaaaggattactaaacgagcacgctcgccggcgctgggaccaggctctgggtctcgcatcacgatcagatccaatccaaggccgcgccccagcccggcggatggattccgccgccgtggccatcgtgacgggtgccgttcccggcgcaggcacacctgaaacagctgctgcacctgtccctgctcctgccatcgcgggggctccctgtccacttcgccgcgccggagccgcacctccgggaggcccgcgcgcagctgcacggttgggggccccgaccccgcgtcggggggcttccnccccgctggaggggcccgctgaagattccccctccccggaaccatcctccccggttccgggggcaaatgaagccccggtttcaaggccttttgaaccggggggggggggcccccgttaagcccgctccctgggggagggtggaccctttcccaccccccgggtttctcaaacc

SEQ ID NO: 14323 - DNA, 634 bp, Zea mays
  misc_feature: Ceres CLONE 1375876-F
  misc_feature: Encodes the peptide sequence at SEQ ID NO. 14324
  misc_feature (372)..(372): n is a, c, t, g, unknown, or other
  misc_feature (416)..(416): n is a, c, t, g, unknown, or other
  misc_feature (470)..(470): n is a, c, t, g, unknown, or other
  misc_feature (541)..(541): n is a, c, t, g, unknown, or other
  misc_feature (591)..(591): n is a, c, t, g, unknown, or other
aagctggagctccccgcggtggcggccgctctagaactagtggatcccccgggctgcaggaattcgcacgagaccattacctagaacatcctaatcgaaaaaaccccaccacaacccagcgccggcagtcgccgtcatcgatcgatcgccggaaaactaacccctaacgatgtctggagccggcgaggaggacaagaagcccgcggagggcggcgcccacatcaaccttaaggtcaagggacaggatggcaatgaggtgttctttcgcataaagaggtccacccagctgaagaagctgatgaacgcttattgtgaccgccagtctgtggacatgaatgccattgcgttcctgtttgatggccgcaggcttcncggcgagcagacccctgatgagctggagatggaggacggcgacnagatcgacgccatgcttcaccagaccggaggcagcgttcctagcaccacctaanagcctcgttttgctctccgtcctgcgtagtactaaacaagagggaaaaagtctttttaaggaacttgtgantgctctggctcccttgtgcattgctgagggcatccttagcctttgttagnaggatgggttgggactttggtctgtcatcactcgtttatctat

SEQ ID NO: 14324 - protein, 99 aa, Zea mays
  misc_feature: Ceres CLONE 1375876-F
  misc_feature (21)..(91): Pfam Name: ubiquitin Pfam Description: Ubiquitin family
  misc_feature (68)..(68): Xaa is any aa, unknown, or other
  misc_feature (83)..(83): Xaa is any aa, unknown, or other
MSGAGEEDKKPAEGGAHINLKVKGQDGNEVFFRIKRSTQLKKLMNAYCDRQSVDMNAIAFLFDGRRLXGEQTPDELEMEDGDXIDAMLHQTGGSVPSTT

SEQ ID NO: 14325 - DNA, 626 bp, Zea mays
  misc_feature: Ceres CLONE 1375879-F
  misc_feature: Encodes the peptide sequence at SEQ ID NO. 14326
  misc_feature (416)..(416): n is a, c, t, g, unknown, or other
aagctggagctccccgcggtggcggccgctctagaactagtggatcccccgggctgcaggaattcgcacgagaccattacctagaacatcctaatcgaaaaacttttcaaatcgacaaaggggaaaggttcgcttcttgtggcatcttgctttccttcgagtgccatggccgatccggcggaggagaacgttgtctcgccgccaccgacccctgcggccccagccgtgggcgcctcagacccgcccctgcagcctgctgctgacagcgcctcaacggagaaggtgtctgctccggcgccggaggtaaggtcccggagattcaggcttcttggagaggacacttccgtgcacaaatccccttggggggcggtaaactgctgacgttctggtatggaaaagacagaaaacttctgctngtgtaataggcgcgcaactgtcatctgggttctggtcgaagggctggattaccactcctgaccctgatatccatgcactgattggtggggtttgccacctaattcctgggggccaaagaacccccttcatcaaaaagaggccaccggaattcccccaggggggggattttaaggaccttgttgggaaagggttcccggggaattacggag

SEQ ID NO: 14326 - protein, 71 aa, Zea mays
  misc_feature: Ceres CLONE 1375879-F
MADPAEENVVSPPPTPAAPAVGASDPPLQPAADSASTEKVSAPAPEVRSRRFRLLGEDTSVHKSPWGAVNC

SEQ ID NO: 14327 - DNA, 693 bp, Zea mays
  misc_feature: Ceres CLONE 1375882-F
  misc_feature: Encodes the peptide sequence at SEQ ID NO. 14328
  misc_feature (393)..(393): n is a, c, t, g, unknown, or other
  misc_feature (693)..(693): n is a, c, t, g, unknown, or other
aaagctggagctccccgcggtggcggccgctctagaactagtggatcccccgggctgcaggaattcgcacgagaccattacctagaacatcctaatcgaaaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcatcagcagccgcagccatggcaataccccactcaaccaccgcagctaagcccgtgccagcagttcgggatcctgcggcgtncgaagcgtcggcagcccgttcctgggccagtgcgtctaggtcctgaggaacagtgcagccggcggggaacccctaacggtcgccacggggcaggggctgcaacacattgctgccaccaaatcagcaggtggagcccctgccccggaaccaagaaaaaaacggggtgggccctggagtccttcctttgaaaaaaaacccccaaggtgaaaaatcccgggggtttaatggggcccccaaaaaaacgaaaccattttaaaaggggaaagggggggcttttgcaagttgaaaaaaaccaaaggn

SEQ ID NO: 14328 - protein, 36 aa, Zea mays
  misc_feature: Ceres CLONE 1375882-F
  misc_feature (22)..(22): Xaa is any aa, unknown, or other
MAIPHSTTAAKPVPAVRDPAAXEASAARSWASASRS

SEQ ID NO: 14329 - DNA, 638 bp, Zea mays
  misc_feature: Ceres CLONE 1375883-F
  misc_feature (445)..(445): n is a, c, t, g, unknown, or other
  misc_feature (452)..(452): n is a, c, t, g, unknown, or other
aagctggagtccccgcggtggcggccgctctagaatagtggatcccccgggctgcaggaattcgcacgagaccattacctagaacatcctaatcgaaaaaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgagaccatggcaagtgtcccgccaccaaggaggacctcaccatggatgatatcgtgcccgtcaagacaacacgatcgtgaagccaggcctttgcaggctgcaagcattccagactccttgggattttcagaacgagtgggatgtctcatgcttctaattngcttggnacagcagcttccacagcaggacaagacttaggcatgcactctacagcatgaccctgcctgccggggttttgcccgattaaagaggaaagagatgcccctaaagcctttttggtccaagtgaaaaacatatcctgcggcagttgaaggaccgccccccggaatttgtggttccaaagggaaaagaaa

SEQ ID NO: 14330 - DNA, 678 bp, Zea mays
  misc_feature: Ceres CLONE 1375884-F
  misc_feature (678)..(678): n is a, c, t, g, unknown, or other
aaagctggagctccccgcggtggcggccgctctataactagtggatcccccgggctgcaggaattcgcacgagaccattacctagaacatcctaatcgaaaaatttccattcctcgctcaccaagccaacagccaaatccaattcgccgacgactctctttattcctcccgctcgccgccgccgccaccgcctgagggcaagaagcgagcgagcgcaccgcggatctccctcccggccccgccgcgcgcaccggtgaagacgacgagcccctcgtgaatggtgggagcccgcgcgacgtccgtcgcctcgcagccgcagccggaggaggcctccttccgcggcttcggttactgcatgcagggctggtaccaccgctgcatcggtctcgacccctgaaccccgccgccacttgcttctttgatttgatttcattcgggtcggtcggggccccctccgtcctgtatctggtgcgcgagagcgcggcagcgcgcgagattcccccccttctcttctcctaggaagcaggaaacaagcccaccgctcgctgagcgcccccgccgatggccgtcccggggcccatgaaagctctggaggggggagaaccgccggcaagggcccccgccgcgggggcccccacgacccccctgggcggtccggggggaagggcgaaccccccn

SEQ ID NO: 14331 - DNA, 666 bp, Zea mays
  misc_feature: Ceres CLONE 1375885-F
  misc_feature: Translation starting site: 210
  misc_feature (339)..(339): n is a, c, t, g, unknown, or other
  misc_feature (440)..(440): n is a, c, t, g, unknown, or other
aaagctggagctccccgcggtggcggccgctctagaactagtggatcccccgggctgcaggaattcgcacgagaccattacctagaacatcgtaatcgaaaaatccccaatatatccccactcttcgcctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacnacggcatccctcttcctaacgttaactccaagatcctatccgaggtaatcgagtactgcaacaagcacgtacatggcgccgccgccgccgccgccgcctcngaggccggttccgacgacgtgggtgccgcctccgccaacagcaccgccgcctcccggtgagaccctcagaactgggatgcggacttcgtcaaggtcgaccagcccacgcttttcgacctcatcttggctgcaactatctgaacatcaggggtctgctcgacctgacctgtcagactgttgctgacatgatcaagggcagacaccaaagagattcccagaccttcaa

SEQ ID NO: 14332 - DNA, 669 bp, Zea mays
  misc_feature: Ceres CLONE 1375886-F
  misc_feature: Translation starting site: 280
  misc_feature: Pfam Name: DUF793 Pfam Description: Protein of unknown function (DUF793)
  misc_feature (323)..(323): n is a, c, t, g, unknown, or other
  misc_feature (326)..(326): n is a, c, t, g, unknown, or other
  misc_feature (497)..(497): n is a, c, t, g, unknown, or other
  misc_feature (535)..(535): n is a, c, t, g, unknown, or other
aaagctggagctccccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggccaccgactcctcctcctcctcctcctcctcgccggnggnggcgccgctgtcctccatcggccgctccatccgctcgctccgccgtgagcagaaccagatccactccttcccgccgccgccagacgccacagacgccttccagcgccgcgccgcccaactcctggccgacctcccggcaggcgacgacgtcctctcccctcgctggacgcngcgcctcctcgaatcttccctcctctgcctcgaggagntccgcgccctgctcttcgggctccggggactcgcccgctgctcgggccccgctcgaccggctcgtcggcgacttctccggacgcggcggcaagggggtcgacttctgcaacgccgtccgggacgggctcgacct

SEQ ID NO: 14333 - DNA, 645 bp, Zea mays
  misc_feature: Ceres CLONE 1375889-F
  misc_feature: Encodes the peptide sequence at SEQ ID NO. 14334
  misc_feature (340)..(340): n is a, c, t, g, unknown, or other
  misc_feature (496)..(496): n is a, c, t, g, unknown, or other
aaagctggagctccccgcggtggcggccgctctagaactagtggatcccccgggctgcaggaattcgcacgagaccattacctagaacatcctaatcgaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggncactgggagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgancaggacaaggctgctgcacatctcaagggtggtgccaaggagggtgttatctctggccccaagcaagatgcacccatggtttgggtgtgggggcaatgaggacagtacccctcggatggttaacattgtttccaatggtagcctgcacc

SEQ ID NO: 14334 - protein, 138 aa, Zea mays
  misc_feature: Ceres CLONE 1375889-F
  misc_feature (4)..(133): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (106)..(106): Xaa is any aa, unknown, or other
MGKIKIGINGFGRIGRLVARVALQSEDVELVAVNDPFITTDYMTYMFKYDTVHGHWEHSDITLKDSKTLLFGDKPVTVFGIRNPEEIPWGEAGAEYVVESTGVFTXQDKAAAHLKGGAKEGVISGPKQDAPMVWVWGQ

SEQ ID NO: 14335 - DNA, 688 bp, Zea mays
  misc_feature: Ceres CLONE 1375891-F
  misc_feature: Pfam Name: Cofilin_ADF Pfam Description: Cofilin/tropomyosin-type actin-binding protein
agagctggagctcaccgcggtggcggccgctctagaactagtggatcccccgggctgcaggaattcgcacgagaccattacctagaacatcctaatcgaaaaattcgggacgcaggtggaggcagcacaggagtagccagctccatccatcctcttacctctcctagtttcgattcgtcgggggatacatcatcactcgaacgaccccgtccccatttacggggagggaggtggccagagacggcaaacacaagatagatggccacttcgaatgacgagagcatgcttatgtcacgagagactacatgcaataggtgtgcacgtattcataactttcacgatgaatgacaagatccaagacatccctctcagagcactccagaggatcgctctacgaggtacgggggacttcacgaactagtctcctcagagactcgactgccagataccgcgagctatgatgctcgactcttgacactggcagaagatgtcaacgaagagcatcatctgactataaccaaggggccccatcctccaccaagggggacaagcaagatggtttattcaagctcaaaacaaaaaatcaagagtgggtgtcatgggattcaggaggaactgcacgctactgatgctagggaaatcacccatgatgagatcaaggaaagtgtctgtagccactaggaaagta

SEQ ID NO: 14336 - DNA, 662 bp, Zea mays
  misc_feature: Ceres CLONE 1375893-F
  misc_feature: Encodes the peptide sequence at SEQ ID NO. 14337
  misc_feature (573)..(573): n is a, c, t, g, unknown, or other
  misc_feature (588)..(588): n is a, c, t, g, unknown, or other
  misc_feature (591)..(591): n is a, c, t, g, unknown, or other
tggagctccccgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaagccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacacacccgcctcaacttcgacgccttccacggngacaaggaccacggnggngtgcacgaacggcaccgccgtcgtgctctgggagtggtgcagggcaagaaccagagtggaagatcctgccg

SEQ ID NO: 14337 - protein, 169 aa, Zea mays
  misc_feature: Ceres CLONE 1375893-F
  misc_feature (140)..(140): Xaa is any aa, unknown, or other
  misc_feature (145)..(145): Xaa is any aa, unknown, or other
  misc_feature (146)..(146): Xaa is any aa, unknown, or other
MSWFGHHHHNQPAPPASGPNQVFKIFCRANENYCLAVRDGAVVLAPVNPKDDHQHWYKDMRFSTRVKDEEGMPAFALVNKPRGSQSSTPSASPTRSSSRLSARTRRTRRCCGRRARTWARASAASAWSTHPPQLRRLPRXQGPRXXARTAPPSCSGSGAGQEPEWKILP

SEQ ID NO: 14338 - DNA, 657 bp, Zea mays
  misc_feature: Ceres CLONE 1375897-F
  misc_feature: Encodes the peptide sequence at SEQ ID NO. 14339
  misc_feature (641)..(641): n is a, c, t, g, unknown, or other
aaagctggagctccccgcggtggcggccgctctagaactagtggatcccccgggctgcaggaattcgcacgagaccattacctagaacatcctaatccaaaaaggccctagcaacaaatccgtatcccgagtccggcgacggcagtatccgagctcgcactcgcgcacccgtccatcgcatcgcatctgtcctcccatcccctcagcgccaccgtaccgcaatcacacgcgcgccacccgcgatgacgccggcgatggcgatctccggctcctgcagccacgacgtcgtctcctccgcccgcctcaggcagccgttcacgctccctccgagcaccggttgcccaatcgccgccgccgactcgcccgtgacccgccgcggcgtcgcggacgccgccgcgtctagccccgttgtgtctgccgccgacgggaatgatgccacacaggctcctaaggatttccttcgaatcattgattttgacaagatacaagaatgaagattcttagtcgagccatcgaggtcagggattgatacagtctggagactagagcttccaaccgttcaagggacatcaatggccatgattgttgcaagccatcaaggaggacccgcgtttcatttgaaacgcattgcttttactggntgggcatgctgatgaa

SEQ ID NO: 14339 - protein, 79 aa, Zea mays
  misc_feature: Ceres CLONE 1375897-F
MAISGSCSHDVVSSARLRQPFTLPPSTGCPIAAADSPVTRRGVADAAASSPVVSAADGNDATQAPKDFLRIIDFDKIQE

SEQ ID NO: 14340 - DNA, 661 bp, Zea mays
  misc_feature: Ceres CLONE 1375898-F
  misc_feature: Encodes the peptide sequence at SEQ ID NO. 14341
  misc_feature (346)..(346): n is a, c, t, g, unknown, or other
aagctggagctccccgcggtggcggccgctctagaactagtggatcccccgggctgcaggaattcgcacgagaccattacctagaacatcctaatcgaaaaatcgacaccaccatgtccaccgccactccgccacagttcgaatattcctagcttgagattgcaagaggaggggaggggagccgagcgctcagctctaattttgtccatctattgctaacagcagctcagacctcagaggcaagggaggtacaatgcccagagcaaatgagatgttgagggcagattcaagaatgatggtggtctttggtgccttgacatcgaaaccagagcaactgacatttggngaatccctcatatttgtcaagaaaagtaaagccggtgactacatgctgtacctgtcattattcgacggtctcggcagaacgaaataccccaggtcgacgcctaccgaggagtacagcagatgtttcaaacccccccaaatctgcccgaagaactccagaggttcaaaaccgccgccaccggtgcctaccaccaaggcagggagcaaacaacatctggcccctgggtcatcccctggcgctggttgccccgtggggtaaaaacaagcttgttcccgttaattttgaaacccgggggtgggggccggcccacccccc

SEQ ID NO: 14341 - protein, 116 aa, Zea mays
  misc_feature: Ceres CLONE 1375898-F
MPRANEMLRADSRMMVVFGALTSKPEQLTFGESLIFVKKSKAGDYMLYLSLFDGLGRTKYPRSTPTEEYSRCFKPPQICPKNSRGSKPPPPVPTTKAGSKQHLAPGSSPGAGCPVG

SEQ ID NO: 14342 - DNA, 636 bp, Zea mays
  misc_feature: Ceres CLONE 1375900-F
  misc_feature (636)..(636): n is a, c, t, g, unknown, or other
aaagctggagctccccgcggtggcggccgctctagaactagtggatcccccgggctgcaggaattcgcacgagaccattacctagaacatcctaatcgaaaagttatatctcctcaaggcacgttcaccacagtcctctctttccccggcaccaccaccacccaggctaaccggactggaccgagtgttgaacaacactgagggcgaggcagatagagcgacggcaggcatggtgagccgtgaaaatttgcccctggtgctgaaccccggcgtctctggggcgggcggtgggcccaaccggtcccgcggagaaatcccggcggcagtccttcgcggggtgggagaggacctctcctccacccgcaccgaaggaggacaccgtcgggagggacgctcaccaccatctcatgaagcacgagttcaatgttcggcgtaggccccggggccccaaaccacgaccggagggggggccccctaccgccacccgggggaaggaccggggcaacctcaccccgggagaggagggctattcagggggagcaacaccgggactctggaggccgcttatggggggggaaaaaaaaggggcacccaaaactctagatagggctcttaggggccacctgtccttaaaan

SEQ ID NO: 14343 - DNA, 718 bp, Zea mays
  misc_feature: Ceres CLONE 1375901-F
  misc_feature: Encodes the peptide sequence at SEQ ID NO. 14344
  misc_feature (219)..(219): n is a, c, t, g, unknown, or other
  misc_feature (718)..(718): n is a, c, t, g, unknown, or other
aagctggagctccccgcggtggcggccgctctagaactagtggatcccccgggctgcaggaattcgcacgagaccattacctagaacatcctaatccaaaaaggccctagcaacaaatccgtatcccgagtccggcgacggcagtatccgagctcgcactcgcgcacccgtccatcgcatcgcatctgtcctcccatcccctcagcgccaccgcaccgnaatcacacgcgcgccacccgcgatgacgccgggggcggcgatctccggggtcagcagccacgtcgtcgtctcctccggcggcctcagggaggcgttcacgctccctccgggcacccggttggccaatcggcgtcggcggcctcgcccgggacccggcggggggggggggggtccgcccccggtccaaacccccttttgggcccgccgccccggggggaaaaattggcaaaaagggttcccaagggaatttcctttcaaatcattggattttggacaagggaaaccaataagggaaaaattttaaaaccgagccttcgaggggtagggggttttgaaaaaggtgtggaaaaaaagaagttttccaaccgggtaaaaggggaaaaacaaggggccattatttttttgccagggccactcaggggggggccccggggttttatttaaagaacggtatttttttttaattggggggggaatgcatattttatttggggcgcan

SEQ ID NO: 14344 - protein, 93 aa, Zea mays
  misc_feature: Ceres CLONE 1375901-F
MTPGAAISGVSSHVVVSSGGLREAFTLPPGTRLANRRRRPRPGPGGGGGGPPPVQTPFWARRPGGKNWQKGFPREFPFKSLDFGQGKPIREKF

SEQ ID NO: 14345 - DNA, 670 bp, Zea mays
  misc_feature: Ceres CLONE 1375902-F
  misc_feature: Encodes the peptide sequence at SEQ ID NO. 14346
tggagctccccgcggtggcggccgctctagaactagtggatcccccgggctgcaggaattcgcacgagaccattacctagaacatcctaatcgaaaaagtctgcacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaacttctaggaagatgatccgatctacggaaggctgtgcaaagagcattactttggagaggaacaacaaatcagacgatgtgcagcttcacgatgtgccgaatgacatcctaggtagcatactatcacggttgacattcagagaatcctcacagatgggccttgtttctcatacctggcggcggctgtggagaagctgttgccggaaactggtcttcaccagtgccaccatgttccaacccggaaataggagcatcaaacatacgaggaccaactttgccatgagagtcaacagtttcttgggtcagctacgcactcatcctactcttaataagtttggtattaggtgtcgggctgcgcaggaaacacactcggcatgtcaacagatgg

SEQ ID NO: 14346 - protein, 140 aa, Zea mays
  misc_feature: Ceres CLONE 1375902-F
  misc_feature (38)..(85): Pfam Name: F-box Pfam Description: F-box domain
MAKQKEGVDKRTSRKMIRSTEGCAKSITLERNNKSDDVQLHDVPNDILGSILSRLTFRESSQMGLVSHTWRRLWRSCCRKLVFTSATMFQPGNRSIKHTRTNFAMRVNSFLGQLRTHPTLNKFGIRCRAAQETHSACQQM

SEQ ID NO: 14347 - DNA, 666 bp, Zea mays
  misc_feature: Ceres CLONE 1375903-F
  misc_feature (239)..(239): n is a, c, t, g, unknown, or other
  misc_feature (240)..(240): n is a, c, t, g, unknown, or other
  misc_feature (268)..(268): n is a, c, t, g, unknown, or other
  misc_feature (270)..(270): n is a, c, t, g, unknown, or other
  misc_feature (271)..(271): n is a, c, t, g, unknown, or other
  misc_feature (317)..(317): n is a, c, t, g, unknown, or other
  misc_feature (318)..(318): n is a, c, t, g, unknown, or other
  misc_feature (320)..(320): n is a, c, t, g, unknown, or other
aaagctggagctccccgcggtggcggccgctctagaatagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagcttcggcgcagcggcagcttgcgcactgctcgtgggcgccgccgtgnncgtgtcccgtcctgtgggtggccgcgcngnncgtgtccacatgaacacggacagttcatggtcctgcagcccggcgnngncaagacacggacccgccggcgggcccgtccaggggtcttccacccctggggggggggggactcaagtgcctgtgcgcttacaaactcggcggggatggggtctacacatcgacccccaggggccatggagttccggcaagtgggcctccccccccgccaattggtaaagggggttaccaaccaagccaggggggaggccccggtttggtaatttacagggttggggggctttcccaaagggggggggggggggccccaaaggaaaggttttttttctctccctcttgggccgcgaaaattgaggggggggggggcccaaaaaaaaaagagtgttttgcgcccgcgg

SEQ ID NO: 14348 - DNA, 692 bp, Zea mays
  misc_feature: Ceres CLONE 1375904-F
  misc_feature: Encodes the peptide sequence at SEQ ID NO. 14349
  misc_feature (420)..(420): n is a, c, t, g, unknown, or other
aaagctggagctccccgcggtggcggccgctctagaactagtggatcccccgggctgcaggaattcgcacgagaccattacctagaacatcctaatcgaaaaattcccctcccgaagtcccgatcctgtcctcaaatcccattgctctatcttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaaccctaatcctagcgctcatcaagcagatgttcgggggccgggggggagaaggttaagctggagaacaagacatggaanatcgatactggaacaaggacatttgagatagaattggcgatgttgtcaagtgctcaccatgtggagatgacccccagggatgctggctttcaggacaggtatgttggtcaggaggtcatcaaagagatggcgaagaacaggccaattgatggcaaaggcaagagaacatttaaaggcctttgtggttaaatgaggccgaccaagctctccaggagaaagcccagcatttccctccggcggggattatgggaaaagtataagctcattcgtgg

SEQ ID NO: 14349 - protein, 66 aa, Zea mays
  misc_feature: Ceres CLONE 1375904-F
MLWVDKYRPKTLDKVTVHDQVAQNLRKFVSEQDCPHLLFYGPSGSGKKTLILALIKQMFGGRGGEG

SEQ ID NO: 14350 - DNA, 615 bp, Zea mays
  misc_feature: Ceres CLONE 1375906-F
  misc_feature: Translation starting site: 334
  misc_feature (396)..(396): n is a, c, t, g, unknown, or other
  misc_feature (487)..(487): n is a, c, t, g, unknown, or other
  misc_feature (523)..(523): n is a, c, t, g, unknown, or other
  misc_feature (525)..(525): n is a, c, t, g, unknown, or other
  misc_feature (526)..(526): n is a, c, t, g, unknown, or other
aaagctggagctccccgcggtggcggccgctctagaactagtggatcccccgggctgcaggaattcgcacgagaccattacctagaacatcctaatcgaaaaaaccgagacaccgcgtgcgaaccaagcagaccccagcagaagaagcgaagtcgtagccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaactttcccgagttaagcctgaggaggttgctgggatgataaaggactttgatgaacctggaactcttgcaccaactggtctttttgttggaggtacnaagtacatggtgatccaaggtgaacccggagttgtcatccgaggaaagaagggcactggaggcattactatcaagaaaactggcatgtccnttgattatcggtatctatgatgagccaatgactccngnngcatgcaatatgggtggtggagaggctcggcgattacctgatcggacagggcttctaagtttgtcataatgctattttggtcatgggcc

SEQ ID NO: 14351 - DNA, 653 bp, Zea mays
  misc_feature: Ceres CLONE 1375907-F
  misc_feature: Encodes the peptide sequence at SEQ ID NO. 14352
  misc_feature (276)..(276): n is a, c, t, g, unknown, or other
  misc_feature (386)..(386): n is a, c, t, g, unknown, or other
  misc_feature (397)..(397): n is a, c, t, g, unknown, or other
  misc_feature (398)..(398): n is a, c, t, g, unknown, or other
  misc_feature (401)..(401): n is a, c, t, g, unknown, or other
  misc_feature (416)..(416): n is a, c, t, g, unknown, or other
  misc_feature (421)..(421): n is a, c, t, g, unknown, or other
  misc_feature (422)..(422): n is a, c, t, g, unknown, or other
  misc_feature (432)..(432): n is a, c, t, g, unknown, or other
aaagctggagctccccgcggtggcggccgctctagaactagtggatcccccgggctgcaggaattcgcacgagaccattacctagaacatcctaatcgaaaaatttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtcaggcggncatgcgctcgcgcttgcgcttgggccccctcgcagcgaccgcagcaaggggcactcgtcagcctcaagccttgcgcctcactggcacacaagctcctctgtggcgcgcgnagtcgatgccnnggnggggtgggggcggcnccggnnatgtcatggncctcctcctccgggagggcatagtcttctcggcaacgagatcgaggattccttccgggaggcggggttagccagttcctccccctgggcccctttgaccggggatttgaattccgcctttttgaaaattaaacgggggggacccctttagggacacagggccctcttttaaggaaaaggggctttggggagggcaacaccgccccccctttgggggggggg

SEQ ID NO: 14352 - protein, 85 aa, Zea mays
  misc_feature: Ceres CLONE 1375907-F
  misc_feature (27)..(27): Xaa is any aa, unknown, or other
  misc_feature (67)..(67): Xaa is any aa, unknown, or other
  misc_feature (75)..(75): Xaa is any aa, unknown, or other
  misc_feature (79)..(79): Xaa is any aa, unknown, or other
MATGSASAIASFSVAAAAAAALRVRRXCARACAWAPSQRPQQGALVSLKPCASLAHKLLCGARSRCXGGVGAAPXMSWXSSSGRA

SEQ ID NO: 14353 - DNA, 632 bp, Zea mays
  misc_feature: Ceres CLONE 1375908-F
  misc_feature: SWISSPROT Homolog: EC 1.1.1.219 Dihydrokaempferol 4-reductase
catagctggagctccccgcggtggcggccgctctagaactagtggatcccccgggctgcaggaattcgcacgagaccattacctagaacatcctaatcgaaaactcccaccgtcccacgttgttcctcccgaccctcgccgtccctcccgccgcgacccgccctcctcctcccgaccacgccgcccagcccgtgtaccactccctcccagcctcgccctcccacgccgtccctcccgccgtgacccttcctcctcctcccgacctcgccgcctagcccgtgtcgtcgccgtcgcccgtgccactctgctgctgcgaccacataatggggatgtggaagggtggtgtgcgtcaccgacgcatcagcgtacatcgcgtgctggatcgtcaggctcctcctcgaccgtggctacaccgtccgcgccaccgtgcgagacacagagcccacctcagttgatctattcaagaacttccattatagcaaaaacaatggatttaccgagtttgtacagaaagcaattgatgatatggaagggatcatgagtggaaccagtacagatggacatgaaccaagttagcaaatgaagctgtttctcagggtggcaaaacactacttttcttcgggtgggagggg

SEQ ID NO: 14354 - DNA, 671 bp, Zea mays
  misc_feature: Ceres CLONE 1375910-F
  misc_feature: Encodes the peptide sequence at SEQ ID NO. 14355
  misc_feature (106)..(106): n is a, c, t, g, unknown, or other
gctctagaactagtggatcccccgggctgcaggaattcgcacgagaccattacctagaacatcctaatcgaaaacactactctggtcgtcctcgcgccgccgcagnagcatcagcgacgcgaccgccggtaatggcttccaccgttgaggtccggaaccccggctcccgccgactcttctgctactccactctccgtctcgccgcaatattgggacccgccgcgccacctgatgagcccgcgggggtctcagccatccagcaccgatgataagaaccctctggtcgcagtccatggccactttcacgcgcactaaccacatgtgaacgtccgcaccccgggggggggggggggggggcaaaccacactcactgctggcattaccaaggtactagaacaggctggaaaggccaaccaatttacttttgacgaaatcgacgagtgccgctgaaaagagagccagaggaatcaccttttgcacagttcctgggggagtatgagacggctcacaaggaataatgctcatggttattgtccaagggcccccaagttatggcgaggaacttactccctggggccttctcaaatgagatggggggttttcctgtggggggtcaggttccctgaggggccccatcgcccccaagaaagggaacacttttccttctttcc

SEQ ID NO: 14355 - protein, 58 aa, Zea mays
  misc_feature: Ceres CLONE 1375910-F
MRRLTRNNAHGYCPRAPKLWRGTYSLGPSQMRWGVFLWGVRFPEGPHRPQEREHFSFF

SEQ ID NO: 14356 - DNA, 746 bp, Zea mays
  misc_feature: Ceres CLONE 1375914-F
  misc_feature: Encodes the peptide sequence at SEQ ID NO. 14357
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (21)..(21): n is a, c, t, g, unknown, or other
  misc_feature (22)..(22): n is a, c, t, g, unknown, or other
  misc_feature (25)..(25): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (746)..(746): n is a, c, t, g, unknown, or other
nnnnnnnnncccccccccccnnccnccccgggggtgggtctaannnnnccaaactggggctccccgcggtggcggccgctctataatagtggatcccccgggctgcaggaattcgcacgagaccattacctagaacatcctaatcgaaaaatcccctcagtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccgggtcagccccatcaagaggtccatcgtgtcccgcgagatgacccggcgctacatgacggacatgatcacccacgcccgacaccgaccttggtgatcgtggggcgccggggtccgcgggcctgtcctgggcgtacgagctgtccaaggacccccaccgggagcgtggccatccgtggagcagtccgtgtcccccgggcgggcgggcgcggtggctggcccggccagctgtctccggccccagggggggggggcgcagagccgggggaactggggtcccgggaaggagactggggcggggggcttaacaaccgagggcn

SEQ ID NO: 14357 - protein, 91 aa, Zea mays
  misc_feature: Ceres CLONE 1375914-F
MATTAASSLLKSSFAGSRLPSATRTTTPSSVAVATPRAGGGPIRASISSSPTPPYDLTSFRVSPIKRSIVSREMTRRYMTDMITHARHRPW

SEQ ID NO: 14358 - DNA, 674 bp, Zea mays
  misc_feature: Ceres CLONE 1375915-F
  misc_feature: Translation starting site: 218
  misc_feature: SWISSPROT Homolog: EC 5.5.1.4 Inositol-3-phosphate synthase
  misc_feature (421)..(421): n is a, c, t, g, unknown, or other
  misc_feature (568)..(568): n is a, c, t, g, unknown, or other
  misc_feature (606)..(606): n is a, c, t, g, unknown, or other
tggagctccccgcggtggcggccgctctagaactagtggatcccccgggctgcaggaattcgcacgagaccattacctagaacatcctaatcgaaaaacacacaacccaaagcagccacagcagcctccttcctcctctcactctcgctcgtgctgcgctcgctacctcgcttcgcattccattcgaggagagcggtgagaggggaggaaaggcaagatgttcatcgagagcttccgcgtcgagagcccccacgtgcggtacggcccgacggagatcgagtcggagtaccggtacgacacgacggagctggtacacgagggcaaggacggcgcctcacgctgggtcgtccgccccaagtccgtcaagtacaacttccggaccagaaccgccgtccccaagctcggggtgatgcttggtggngtggggaggcaacaacgggtccacgctgacggctggggtcattgccaacaggggaggggatctcatgggcgaccaaggacaaggtgcagcaagccaactactacggctccctcacccaggcctccaccatcagagtcggcagctacnacgggggaggagatctatgcgccgttcaagagcctccnttccatggtgaacccagacgacattgtgttacgagggctggacattagcacatggaccctggcgactc

SEQ ID NO: 14359 - DNA, 712 bp, Zea mays
  misc_feature: Ceres CLONE 1375916-F
  misc_feature: Encodes the peptide sequence at SEQ ID NO. 14360
  misc_feature (348)..(348): n is a, c, t, g, unknown, or other
  misc_feature (437)..(437): n is a, c, t, g, unknown, or other
  misc_feature (438)..(438): n is a, c, t, g, unknown, or other
agagctggagctccccgcggtggcggccgctctagaactagtggatcccccgggctgcaggaattcgcacgagaccattacctagaacatcctaatcgaaaaaacaaaaaccaacgctccccctgcccccctctttcctccccagacccgcgctcccctccgtggcgtgcaacgcgttcctcggctcctgcaggcggcgacctcggaaaggcgggggcgtctcgtcgcgaggcatttgaggccaggattttttggtgctctcattgttagctgactggtgagggtctggatctagcaatggcggaaaacacccacggtagtggtcgccacgtgcttggggacttgacnaatgttatttgcaagcgagcagccacatcagatctggaggagagtacaggtgggataaagatcagacggatttgaaagactgggactanngaagagtacgatgcaaatgcaaaagctagcagtattgggaaaggaattgtatttggccatttgtttgatggatgtgccagagagaaatttcaaagccattctatctttcagaatagaagggttcaacacatagctggcgaagcagctggactcttatcaagggaagcaatgactcgaaaaccactatgcatcatcgggccattaaatctcgggaaaaggagcaggatcttcccttgaatctgaagacgactatgtggttgaaataatggtggga

SEQ ID NO: 14360 - protein, 41 aa, Zea mays
  misc_feature: Ceres CLONE 1375916-F
MAENTHGSGRHVLGDLTNVICKRAATSDLEESTGGIKIRRI

SEQ ID NO: 14361 - DNA, 865 bp, Zea mays
  misc_feature: Ceres CLONE 1375917-F
  misc_feature: Encodes the peptide sequence at SEQ ID NO. 14362
  misc_feature (7)..(7): n is a, c, t, g, unknown, or other
ttctttntttcctttttttttagttctcctactttcttttttttcaaagtggagctccccgcggtggcggccgctctagaactagtggatcccccgggctgcaggaattcgcacgagaccattacctagaacatcctaatcgaaaatcgcctttccgatcccatccctctccagccaccttcctccgctcgccgtgcttctgcttcctccgccaccaccgccggcatggctgcgcgctgcccctacttcgccgtcgaggagtcctcccgcggcatccgcttcgggggagtccccggacgcggcgctccgcccggatcctcgcgacggcctggtgcgcaccaggcgccctgctgctacgacgcgctcgggcgcgcgcctccttcaagggggcgggggttcccgatcggagttcctggcgccgcttccgggggttccgggcccggcgaattgggtttggcccggatgtttgcccctcaattccccaatggaagaaaaggggaagaatcaaggggcggcctccctccaatggaaagtggttttcaaatcccccagtggatttggtgggatgggaaaaaaaattggtctacccgaaaaacctcttttggaactaccccaggaagaaccccctaaaaaggggatcttttccaatgggtgtggtttcttgcggggaaattaatcctttcaaggaaccaggggggcgcaccccaaaagccagggggggacctttcctgtgaggcaagggaaaccgtcttatccagaggggaggaaaactttgccaatgcccaaaaacaaaacccggctggcaaaaatccatagagaaaaaaagagggggctcccgcgaattcggttatttggtacccagggg

SEQ ID NO: 14362 - protein, 134 aa, Zea mays
  misc_feature: Ceres CLONE 1375917-F
MAARCPYFAVEESSRGIRFGGVPGRGAPPGSSRRPGAHQAPCCYDALGRAPPSRGRGFPIGVPGAASGGSGPGELGLARMFAPQFPNGRKGEESRGGLPPMESGFQIPQWIWWDGKKNWSTRKTSFGTTPGRTP

SEQ ID NO: 14363 - DNA, 624 bp, Zea mays
  misc_feature: Ceres CLONE 1375918-F
  misc_feature: Encodes the peptide sequence at SEQ ID NO. 14364
  misc_feature (271)..(271): n is a, c, t, g, unknown, or other
  misc_feature (286)..(286): n is a, c, t, g, unknown, or other
  misc_feature (391)..(391): n is a, c, t, g, unknown, or other
  misc_feature (588)..(588): n is a, c, t, g, unknown, or other
aagctggagctccccgcggtggcggccgctctagaactagtggatcccccgggctgcaggattcgcacgagaccattacctagaacatcctaatcgaaaagcaaaccctagtgcttcccaccgatccatttcagccgccgccgcgcgtagcaagcaggagcagcaaggatgccggctggccacgggctgcgctcgcggacgcgcgacctgttcgcgcgccccttccgcaagaagggctacatcccgctcaccacctacctccgcacctacnagatcggcgactacntcgacgtcaaggtgaacggcgccgtccacaaggggatgccgcacaagttctaccacggccgcaccggtcgcgtctgggacgtcaccgagcgcgccatcggcgtcnagataaacaggcagtgaatggtcgcatcatcaggaagcgtatccctgtccgcgtggagcatgtgcagccatcccgctgcacagaagaagtccgcctgaggagggtgagaaatgaccagctggaggcggatgcaaaggaccgcggtgaggtcatcaccacaagagggcagccgttggccccaagcctgttttcagggntggagggaataccatcggagaccgccatcccatccc

SEQ ID NO: 14364 - protein, 79 aa, Zea mays
  misc_feature: Ceres CLONE 1375918-F
  misc_feature (2)..(80): Pfam Name: Ribosomal_L21e Pfam Description: Ribosomal protein L21e
  misc_feature (35)..(35): Xaa is any aa, unknown, or other
  misc_feature (40)..(40): Xaa is any aa, unknown, or other
  misc_feature (75)..(75): Xaa is any aa, unknown, or other
MPAGHGLRSRTRDLFARPFRKKGYIPLTTYLRTYXIGDYXDVKVNGAVHKGMPHKFYHGRTGRVWDVTERAIGVXINRQ

SEQ ID NO: 14365 - DNA, 776 bp, Zea mays
  misc_feature: Ceres CLONE 1375920-F
  misc_feature: Encodes the peptide sequence at SEQ ID NO. 14366
  misc_feature (776)..(776): n is a, c, t, g, unknown, or other
aatgtggagctccccgcggtggcggccgctctagaactagtggatcccccgggctgcaggaattcgcacgagaccattacctagaacatcctaatcgaaaaacattcgacccagccatctcctcaccctcgttcaccacacaggtccgccactcctttagtagcttgtgatttgtacgtcgacgagatcactggtcggggtgggcggaccaacgacccttggggaaagggtagtgtgggtgcttcagggggggcggtccctccctgctcgccgggggtgctgcttgtccgaaacagccacggcctgggggggaggacggaagtgggccaaacgggacccccagggaggaccttgcggcgggtgcaagcaaggctggcaatgcgcccccaccggagggggcggcccgggggaaaaagggaatgcgagaagccaaggccccgggaactggacccaggaaggttgaccccgatcaaaggacaggaaacggcggtgtttgaccccttagtgttcccccctccgggaggggacgaagtgcccagccccatggccctgcgcccctcccccagggcccagcccggggaaaaacccaagaatttgattgggggggggggccccccacccaaggtattgtgcgcgctcaacttgaagcgaagaagttacgcggccccggcacacaggaagcgcgagcacaggcccgggagaaagggggaactccccccgcccccctggtactgggtggagagggctacgttccttagtgcgcctagacgaggagn

SEQ ID NO: 14366 - protein, 132 aa, Zea mays
  misc_feature: Ceres CLONE 1375920-F
MRPHRRGRPGGKRECEKPRPRELDPGRLTPIKGQETAVFDPLVFPPPGGDEVPSPMALRPSPRAQPGEKPKNLIGGGGPPPKVLCALNLKRRSYAAPAHRKREHRPGRKGELPPPPWYWVERATFLSAPRRG

SEQ ID NO: 14367 - DNA, 659 bp, Zea mays
  misc_feature: Ceres CLONE 1375922-F
  misc_feature: Translation starting site: 200
  misc_feature: SWISSPROT Homolog: EC 5.3.1.1 Triose-phosphate isomerase
aaagctggagctccccgcggtggcggccgctctagaactagtggatcccccgggctgcaggaattcgcacgagaccattacctagaacatcctaatcgaaaacacaagcagcgaaatccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttggatgttgctgctcaaaactgctgggtgaagaaaggaggtgctttcactggtgaagtcagtgctgagatgctcgtcaaccttggtgtccctgggtcattcttgaacactctgaaaggagagctctgctgggagatcaaatgaatttgttggagacaggttgcgtatgccctgtctcagggacaaaagtcattggctgtggtggtgagacccttgacagaggggagctgggtcaaccatggatgttgttgctggccaacaaaagcattggtgaaaaaatcag

SEQ ID NO: 14368 - DNA, 680 bp, Zea mays
  misc_feature: Ceres CLONE 1375923-F
  misc_feature: Encodes the peptide sequence at SEQ ID NO. 14369
  misc_feature (344)..(344): n is a, c, t, g, unknown, or other
  misc_feature (413)..(413): n is a, c, t, g, unknown, or other
  misc_feature (466)..(466): n is a, c, t, g, unknown, or other
aaagctggagctccccgcggtggcggccgctctagaactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacttgagcaacgagcaggttcatgtcgtgccagcccgcggcggccaagacgacggacccgccggncgcggccgtcgcaggcgtgctgcgaacggctgggcgggggcggacctcagtggctggggcgctacaggnctccgcgttggatggcggctacacatcgaccccaagcggcgcatggagcttcngggcaagtggcggcttcgcacggcggccgactggtagcagtggggtagccaagccaagcccagcagggagggccccggcattgctagctggacgtgggctgtgggggcatctgcagcagggtggaggcaggggccccgtacggacggggctctttctctctctcatcttggcccggacctatctgggagggggggggggtcggactaattaaaa

SEQ ID NO: 14369 - protein, 115 aa, Zea mays
  misc_feature: Ceres CLONE 1375923-F
  misc_feature (104)..(104): Xaa is any aa, unknown, or other
MAATSSKSSSSSSSAQRAAAALLVAAAVAVSVLVVGAAAVCDLSNEQVHVVPARGGQDDGPAGRGRRRRAANGWAGADLSGWGATGLRVGWRLHIDPKRRMELXGKWRLRTAADW

SEQ ID NO: 14370 - DNA, 719 bp, Zea mays
  misc_feature: Ceres CLONE 1375926-F
  misc_feature (436)..(436): n is a, c, t, g, unknown, or other
  misc_feature (437)..(437): n is a, c, t, g, unknown, or other
  misc_feature (494)..(494): n is a, c, t, g, unknown, or other
  misc_feature (503)..(503): n is a, c, t, g, unknown, or other
  misc_feature (627)..(627): n is a, c, t, g, unknown, or other
  misc_feature (635)..(635): n is a, c, t, g, unknown, or other
  misc_feature (656)..(656): n is a, c, t, g, unknown, or other
  misc_feature (719)..(719): n is a, c, t, g, unknown, or other
aaagctggagctccccgcggtggcggccgctctagaactagtggatcccccgggctgcaggaattcgcacgagaccattacctagaacatcctaatcgaaaagtcatcacaaactcactacacgatcggctatagcgagctaacagaagctctatcaagtactgtgtaggccatggccggagccctcgtcttcgtcgctgttctcctcgccgcaagcgtcggcgctacgacggctaccacgctgaccatccacaacctctgcccccacccggtgtggccgctggtgaccccgagctcgggcttcccctccatctccaccaacaccgcgcggctgggccccaacgcgctgctctccctctccttccgcccaccttctgggccggccgcgtcgccgcgcgcacgggctgcgacgccgccgcgtccggctgctggacgnngaccacgccgcccgccaccgtcgtgcaggtcaccgtccacgacggcgggaacctggnaccagccanctacagcgtgtctctcgtcgacggcttcaacgtgccatggtggtcagcccgcaggcccgtcgcgggcggcagtgcccggcgctcgggtgcccatcaatctcaactgcgactgccctcccagaanccgcacgncgagggcgccgcgtgccgcgncccgccggagtactacaagaacgggtgccgctcacaggacacggcccacgacgtcgagcccgn

SEQ ID NO: 14371 - DNA, 678 bp, Zea mays
  misc_feature: Ceres CLONE 1375927-F
  misc_feature: Encodes the peptide sequence at SEQ ID NO. 14372
  misc_feature (447)..(447): n is a, c, t, g, unknown, or other
  misc_feature (462)..(462): n is a, c, t, g, unknown, or other
  misc_feature (503)..(503): n is a, c, t, g, unknown, or other
  misc_feature (606)..(606): n is a, c, t, g, unknown, or other
aaagctggagctccccgcggtggcggccgctctagaactagtggatcccccgggctgcaggaattcgcacgagaccattacctagaacatcctaatcgaaaacattttctcggccgggagccgcaattccatcctgctgctagagttacatactcacccaatagaacaattctatgcccggtgattgtacctcctgaagtagaagagcatactgaagcagaactcgagtggtgttggatcgaaatggaaggcgggatgtcaagtttggaagccgccatgaaagcttcttcatcgatggcaagcagcatggcaaggaatgctgaccctaaccaacagactctccgccccaatttagtggagcagttctattttccaagacctggcaatctttgccaggcattcctccatttttttgggctccctctagtttgtatcttcctaatgacnatgaagctaaatttngcaacaactttggatcaaatccttcacagaatacagattgnaacccacaggcaatagtgagcaacctaaccttccttgagcagaagatcaagcaggtaaaggatattgtgcagtccatgagtaaccgagagaacaagtagctgntggttcctgggaggtagctggaagcagcagctcataaccgctgacctcactagcataatatcagctcatatt

SEQ ID NO: 14372 - protein, 91 aa, Zea mays
  misc_feature: Ceres CLONE 1375927-F
  misc_feature (73)..(73): Xaa is any aa, unknown, or other
  misc_feature (87)..(87): Xaa is any aa, unknown, or other
MEGGMSSLEAAMKASSSMASSMARNADPNQQTLRPNLVEQFYFPRPGNLCQAFLHFFGLPLVCIFLMTMKLNXATTLDQILHRIQIXTHRQ

SEQ ID NO: 14373 - DNA, 557 bp, Zea mays
  misc_feature: Ceres CLONE 1375928-F
  misc_feature (157)..(157): n is a, c, t, g, unknown, or other
  misc_feature (226)..(226): n is a, c, t, g, unknown, or other
  misc_feature (390)..(390): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (493)..(493): n is a, c, t, g, unknown, or other
  misc_feature (494)..(494): n is a, c, t, g, unknown, or other
  misc_feature (529)..(529): n is a, c, t, g, unknown, or other
  misc_feature (530)..(530): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (541)..(541): n is a, c, t, g, unknown, or other
  misc_feature (542)..(542): n is a, c, t, g, unknown, or other
  misc_feature (544)..(544): n is a, c, t, g, unknown, or other
aagtggagtccccgcggggcggcgctctaaatagtggatcccccgggctgcaggaattcgcacgagaccattacctagaacatcctaatcgaaaaacgagagcacccggaccagacgcccaagtcgatcgccatggcgatgaagccggcggcggcgnctccccctacccccggcgcgggcaagcgtggtcgtctaacgcagcctgatggccggacgaggtggcccnaaccatccttaaaggggggttccggccgggcggccccggggcctttctcccaaaattaaccaccgggtttacacataaggggcccgattttatacccggggattctttgccccttttaaaaaaaaaaaaaaggtttttcttgggaaaggtttttttacgggggngttttttacaggggggggagaaaccccctcccccgnnntttttgtgtggggggnnnggttgttttttaaaaaaaacccgggggttataaaccccccccccccnnagggggggagaggggggggggaatttttcctttgnntgggccnnnanncncccgcccccgtcg

SEQ ID NO: 14374 - DNA, 714 bp, Zea mays
  misc_feature: Ceres CLONE 1375930-F
  misc_feature (338)..(338): n is a, c, t, g, unknown, or other
  misc_feature (339)..(339): n is a, c, t, g, unknown, or other
aaagctggagctcaccgcggtggcggccgctctagaactagtggatcccccgggctgcaggaattcgcacgagaccattacctagaacatcctaatcgaaaaacgattcaaaatctttccccccttgttgcctgttgtgttcttccacgttctttgccaaattccggcttccttttccatgcccaagcatctcgttatccaagaccgtgacaagcaccacggcaccagtccgcgacaagtcaaccaaacgaaccaaaggcagagctgaacgcgaaagggagggagctcggatcggatgcggcggcgcgcgaaggtggccgtggtgggcgcgggcgcgnncgggctggtggccgcgcgcgagctgctccgcgaggccacaccgtgtccgtcttcgaagagtcaggccgcgtggggggcacctgggcgtacagtccgcgcgcggacgcggacccgctgggcagcgacccgggcgcccccggcgccgtgcacagcagcctgtatgcgtcgctgcgcaccaaccctgcgcgcgagctcatgggcttctcgggcttccgctggccggggcgggcgttcgccggcgatccgcgcacgttcccggggccaccgggaggtcctcgcctaactcggacgcttcgccggggattccggcgtcgccccgcacgtcaggctccgagccaagttgcttggggtgaggccctcttgtcgggtcgggaa

SEQ ID NO: 14375 - DNA, 746 bp, Zea mays
  misc_feature: Ceres CLONE 1375932-F
  misc_feature: Encodes the peptide sequence at SEQ ID NO. 14376
  misc_feature (224)..(224): n is a, c, t, g, unknown, or other
  misc_feature (250)..(250): n is a, c, t, g, unknown, or other
  misc_feature (251)..(251): n is a, c, t, g, unknown, or other
  misc_feature (323)..(323): n is a, c, t, g, unknown, or other
  misc_feature (417)..(417): n is a, c, t, g, unknown, or other
  misc_feature (418)..(418): n is a, c, t, g, unknown, or other
  misc_feature (436)..(436): n is a, c, t, g, unknown, or other
  misc_feature (460)..(460): n is a, c, t, g, unknown, or other
  misc_feature (706)..(706): n is a, c, t, g, unknown, or other
aaagctggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgncatgcagatgccctgcccctgcgcgnngctgcagggcttgtacggcgctggcgccggcctgacgacgatgatgggcgcccggcggctgtacccctacgncgagtaccctgagcagccgcagtgcagcccgctggcggcggcgccctactacgccggggtgtgggcagacgagcgccatgtaccagccgctccnngcacagtgctgccagcancagatgaggatgatggacgtgcantccgtcgcgcagcagctgcagatgatgatgcagctttgagcgtgccgctgcccgcagcagcaagctgtacgagccagctctgatgcagcagcagcagcagctgctggcagcccagggtctcaaccccatggccatgatgatggcgcaaaaatgccggccatgggtggactctaccagtaccagtaccagttggccagttaccgcaccaacccctgttggggtctccgctgccatttcggcctactnactgattcatgaatttggggaaaccccttctatccatccc

SEQ ID NO: 14376 - protein, 125 aa, Zea mays
  misc_feature: Ceres CLONE 1375932-F
  misc_feature (20)..(20): Xaa is any aa, unknown, or other
  misc_feature (29)..(29): Xaa is any aa, unknown, or other
  misc_feature (53)..(53): Xaa is any aa, unknown, or other
  misc_feature (85)..(85): Xaa is any aa, unknown, or other
  misc_feature (91)..(91): Xaa is any aa, unknown, or other
  misc_feature (99)..(99): Xaa is any aa, unknown, or other
MKMVIVLVVCLALSAASASXMQMPCPCAXLQGLYGAGAGLTTMMGARRLYPYXEYPEQPQCSPLAAAPYYAGVWADERHVPAAPXTVLPAXDEDDGRAXRRAAAADDDAALSVPLPAAASCTSQL

SEQ ID NO: 14377 - DNA, 722 bp, Zea mays
  misc_feature: Ceres CLONE 1375933-F
  misc_feature: Encodes the peptide sequence at SEQ ID NO. 14378
  misc_feature (393)..(393): n is a, c, t, g, unknown, or other
  misc_feature (394)..(394): n is a, c, t, g, unknown, or other
  misc_feature (585)..(585): n is a, c, t, g, unknown, or other
  misc_feature (708)..(708): n is a, c, t, g, unknown, or other
caaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctggggcggctgctgctgnntgctgtcgggctggcgctgaacgcctccgtggtggggctggccgtggccacgccggtggtcctgatcttcagccccgtgctggtcccccgcgcgctgctcatcgggacggccgtcatggggtccctcacgtcgggcgcgctgggggctcgggggctgtcctcgctcacgtgcctcgccaacacgcggcggnaggcgtccagcgcaccccggactaccgtggaggaggcgcaccgcaggatggcggagggccgcgcgcacgcgggccacaggacggcgcaggcagccaggccatccaggcagggcgcagaagcgnccccccggggaaag

SEQ ID NO: 14378 - protein, 172 aa, Zea mays
  misc_feature: Ceres CLONE 1375933-F
  misc_feature (44)..(161): Pfam Name: Oleosin Pfam Description: Oleosin
  misc_feature (63)..(63): Xaa is any aa, unknown, or other
  misc_feature (127)..(127): Xaa is any aa, unknown, or other
  misc_feature (168)..(168): Xaa is any aa, unknown, or other
MADRDRSGIYGGAHATYGQQQQQGGGGRPMGEQVKGMLHDKGPTASQALTVATLFPLGRLLLXAVGLALNASVVGLAVATPVVLIFSPVLVPRALLIGTAVMGSLTSGALGARGLSSLTCLANTRRXASSAPRTTVEEAHRRMAEGRAHAGHRTAQAARPSRQGAEAXPRGK

SEQ ID NO: 14379 - DNA, 733 bp, Zea mays
  misc_feature: Ceres CLONE 1375935-F
  misc_feature: Encodes the peptide sequence at SEQ ID NO. 14380
  misc_feature (729)..(729): n is a, c, t, g, unknown, or other
aaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcacgaggcccccgtggaagcgaaagcagcgctctactcgagggacctcgctcgcaactgcgcttcgcctccacttcgacctcttcagggctgctgcggcgactggcgcgacacgctcttctgcgaggtggctccgaaccccgcggcgcgggaggagctgccggagccactcaggaacgtgatgctggagtacggcgcggcggtgacaaagctgccgcggntcgg

SEQ ID NO: 14380 - protein, 180 aa, Zea mays
  misc_feature: Ceres CLONE 1375935-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFTRPPWKRKQRSTRGTSLATALRLHFDLFRAAAATGATRSSARWLRTPRRGRSCRSHSGT

SEQ ID NO: 14381 - DNA, 735 bp, Zea mays
  misc_feature: Ceres CLONE 1375938-F
  misc_feature: Translation starting site: 104
  misc_feature: Pfam Name: RGP Pfam Description: Reversibly glycosylated polypeptide
atagctggagctccccgcggtggcggccgctctataactagtggatcccccgggctgcaggaattcgcacgagaccattacctagaacatcctaatcgaaaagatgcgaccgccctcgctgctctccctcaccctcgacgccgcgctcctccgcatcgccaatatcgccgacctctcccacctcccagaccacctcctcatcgacctcttccgtagaaccctcagtgctggtaagctgacagagaaagttctcaagttgtttctagcaaccggctgtgaggatatcatattggctgttcggttgctcaacattaagcagccactcgtaccagtccttcccacaaggtgctctgagagattctagatctgctgccgcccacatcgttttgattacctgagaggatgcctttggaaattcaagatagtgaggttgacatagtgattgcgggactccagcccaaccttgacactttctttgaggcatggcgaccttttttctcccgtttccacatcaatgtcgtcaaagatccaaacatgggagaggatcttcaaatccctgcagggttttgatctccagggttaacccaaggccaaaaaataaagggggtggcttgggggccccccccataccaaaaaactaaatctggggacctccggggcggtaacacttgggggaatcttgggcctcacccacaaaaagtattggggatttccctgtgaggggacaaatggccc

SEQ ID NO: 14382 - DNA, 668 bp, Zea mays
  misc_feature: Ceres CLONE 1375941-F
  misc_feature: Encodes the peptide sequence at SEQ ID NO. 14383
  misc_feature (482)..(482): n is a, c, t, g, unknown, or other
  misc_feature (599)..(599): n is a, c, t, g, unknown, or other
ggagctccccgcggtggcggccgctctagaactagtggatcccccgggctgcaggaattcgcacgagaccattacctagaacatcctaatcgaaaaactcacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcggacaccatccgcacggccatcggcgtcatcggtgggtagtagtcaatacctgcttagcaatgggaccgccctagtgctcttcctctcgccggtgcctacgttcatccgcatctggaagaaggggtcggtggagcagtactcgccgatcccgtacgtggcgacncttctgaactgcatgatggtgggtgttgtacgggcttgccgctggtgcacccgcacagcatggctggtgatcaccatcaaacggcaccgggatgctcatccagctggactacgtggngctcttctcgtctactccgggggggcgcgccgccgcaaggtgtccttctgtttgcccgcgagttcgctt

SEQ ID NO: 14383 - protein, 58 aa, Zea mays
  misc_feature: Ceres CLONE 1375941-F
MMVGVVRACRWCTRTAWLVITIKRHRDAHPAGLRGALLVYSGGARRRKVSFCLPASSL

SEQ ID NO: 14384 - DNA, 612 bp, Zea mays
  misc_feature: Ceres CLONE 1375942-F
  misc_feature: SWISSPROT Homolog: EC 4.1.1.33 Diphosphomevalonate decarboxylase
  misc_feature (127)..(127): n is a, c, t, g, unknown, or other
  misc_feature (388)..(388): n is a, c, t, g, unknown, or other
  misc_feature (389)..(389): n is a, c, t, g, unknown, or other
  misc_feature (425)..(425): n is a, c, t, g, unknown, or other
aaagctggagctccccgcggtggcggccgctctagaatagtggatcccccgggctgcaggaattcgcacgagaccattacctagaacatcctaatcgaaaaaatccatttacctgtccaccaaaccnagtctgtagtgttttttccctccctaatgaacagaccacggaggtgacgaagcagcggtagagacaaattagcgagcagagaaggggtactggcgatgacacaccttgccattgagccacatgcggtcggaagggaatgaggggctgacggcgacagtggtggtggcgcaaagaatggtcgggtcgagcggtacgctgatgctgtcgttgatggggagatgagcgctcgtccgcttccccagtactgatcggcgcatggtnngtcgcgtccgccccgtgcatgagaccactgcccctnccgcgcgcatgggactctcgctcgcgctgtctatgccgatattcctggcaaggggagtagaggcatatccctactactcataagcacgggtggaggcgtggacccggggccattcgtctgccagcttcgaatgtcccctggcaggatcgttaaactttttggggcccaaatattgggtaactggccc

SEQ ID NO: 14385 - DNA, 669 bp, Zea mays
  misc_feature: Ceres CLONE 1375943-F
  misc_feature: Translation starting site: 120
  misc_feature: Pfam Name: Pyr_redox_2 Pfam Description: Pyridine nucleotide-disulphide oxidoreductase
  misc_feature: SWISSPROT Homolog: EC 1.8.1.9 Thioredoxin-disulfide reductase
  misc_feature: SWISSPROT Homolog: EC 6.3.3.1 Phosphoribosylformylglycinamidine cyclo-ligase
aaagctggagctccccgcggtggcggccgctctagaactagtggatcccccgggctgcaggaattcgcacgagaccattacctagaacatcctaatcgaaaaaaactgagtaagcagctatggagggatccgccgccgctccgctccgcacgcgcatctgcatcatcgggagcggtcccgctgcgcacacggcagccatctacgcggcccgcgcggagctcaagcctgtgctcttcgagggctggatggccaacgacatcgccgcgggcgggcagctcaccaccaccaccgacgtcgagaacttcccgggcttccccaacggcatcatgggcgccgacctcatggacaactgccgcgcgcagtccctggcgctttggcagcaacatcctctccgagaccgtcaccgccgtcgacttttcgggctgccccattcgagttagtgcagactccacaaccgtcctcgccgatgcggttatcgttgccacgggagccgtcgcgcggcgcctccacttccccgggtccgatgcatactggaaccgcggcatctccgcctggggcgtctgggacggtgccgcccccatcttccgaaacagcccatcgccggcataggcggggggactcggctatggaggagtccaatttcctcaccaggtacgggtcccacgtcta

SEQ ID NO: 14386 - DNA, 754 bp, Zea mays
  misc_feature: Ceres CLONE 1375945-F
  misc_feature: Encodes the peptide sequence at SEQ ID NO. 14387
  misc_feature (426)..(426): n is a, c, t, g, unknown, or other
  misc_feature (446)..(446): n is a, c, t, g, unknown, or other
  misc_feature (459)..(459): n is a, c, t, g, unknown, or other
  misc_feature (523)..(523): n is a, c, t, g, unknown, or other
aaagctggagctccccgcggtggcggccgctctagaactagtggatcccccgggctgcaggaattcgcacgagaccattacctagaacatcctaatcgaaaaaagacgatctgcgaaacaaacactagtgcgtttgcgagagaaaccgagaaagagaagctacagagtcactgaccgaccgctatggcatcgaggcagaacacgcgtgaggcgcgcgccgaggccgacgcgcggcgcgccgtggaggagctggctcgggcgcgggacgagcacctcgagaaggcggaggtgaacgcccgctcggccgcggacgagatcgcgcgctcccgcgccgaccgcggtgccgccggtggcggcggcatcctggagagcgtgcaggagggcgccaggtcctttggcagcgccgtgggccgcacctttcgtggncgccaggacgcgaccgtggnacagacctcgcangacgcgcacaccgcgggcgaacagctcggcgagtacagggactacaccgccgacaggcccgggnaggcaaacgacagcgtctccccgtaaaaggggcgaaaacggggaagcccacccggaacaagttgggcgaatacaaggaacaccccccgggaaaaaaggggagggaaaccagggcccgggggggcccaaaaacaaggggaaccccggaggggccccaaaacaaatctcggaaaaaacagagacccgcgccccccaagaggggggaaccccgcaaaccccccccgcggggggg

SEQ ID NO: 14387 - protein, 121 aa, Zea mays
  misc_feature: Ceres CLONE 1375945-F
  misc_feature (88)..(88): Xaa is any aa, unknown, or other
  misc_feature (92)..(92): Xaa is any aa, unknown, or other
  misc_feature (114)..(114): Xaa is any aa, unknown, or other
MASRQNTREARAEADARRAVEELARARDEHLEKAEVNARSAADEIARSRADRGAAGGGGILESVQEGARSFGSAVGRTFRGRQDATVXQTSXDAHTAGEQLGEYRDYTADRPGXANDSVSP

SEQ ID NO: 14388 - DNA, 702 bp, Zea mays
  misc_feature: Ceres CLONE 1375948-F
  misc_feature: Encodes the peptide sequence at SEQ ID NO. 14389
  misc_feature (424)..(424): n is a, c, t, g, unknown, or other
  misc_feature (425)..(425): n is a, c, t, g, unknown, or other
  misc_feature (427)..(427): n is a, c, t, g, unknown, or other
  misc_feature (428)..(428): n is a, c, t, g, unknown, or other
  misc_feature (431)..(431): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (440)..(440): n is a, c, t, g, unknown, or other
  misc_feature (457)..(457): n is a, c, t, g, unknown, or other
  misc_feature (568)..(568): n is a, c, t, g, unknown, or other
  misc_feature (569)..(569): n is a, c, t, g, unknown, or other
aaagctggagctccccgcggtggcggccgctctagaactagtggatcccccgggctgcaggaattcgcacgagaccattacctagaacatcctaatcgaaaaatcatagtgagtttgaggacattggaccgcaccctgcagaggccaagcgtcgaacacatggcgtgcaccttcctccgccgcgcgttctccctcaccgccgccggcacccacgcgaccccccgagttgccgccgccttcgcttccacttcctcctcatcctccgtcgtcgtgcctctgcgctccccactagaccaccgtcttctccgccacctccgctccgagatcacctacctcgcggagcgccgccctccccacgtgccgccgagtagcttcagttcgttcgccgtggagggacgcccgggggagcagtggggcgctcggnngnnccnannnngggnaaggggaggcgaggaangtgaaggtcaaggccaccattgttccaacgcgctgcgggagctggtcccggacaaccgcccctcttcccgccgcgtggagtcgctcgagcggggccccgctccactcactnnaaattcagcagagtcgccgggggcgaccgcgtcctcggttcgtctgttccgctggccgaaaaaactcgcggtccgccagtgtcacctcccagttgcgtggaagcaatggtggccctcggggtgacgatttcaa

SEQ ID NO: 14389 - protein, 177 aa, Zea mays
  misc_feature: Ceres CLONE 1375948-F
  misc_feature (89)..(89): Xaa is any aa, unknown, or other
  misc_feature (90)..(90): Xaa is any aa, unknown, or other
  misc_feature (91)..(91): Xaa is any aa, unknown, or other
  misc_feature (92)..(92): Xaa is any aa, unknown, or other
  misc_feature (93)..(93): Xaa is any aa, unknown, or other
  misc_feature (94)..(94): Xaa is any aa, unknown, or other
  misc_feature (100)..(100): Xaa is any aa, unknown, or other
  misc_feature (137)..(137): Xaa is any aa, unknown, or other
MACTFLRRAFSLTAAGTHATPRVAAAFASTSSSSSVVVPLRSPLDHRLLRHLRSEITYLAERRPPHVPPSSFSSFAVEGRPGEQWGARXXXXXXRGGEEXEGQGHHCSNALRELVPDNRPSSRRVESLERGPAPLTXNSAESPGATASSVRLFRWPKKLAVRQCHLPVAWKQWWPSG

SEQ ID NO: 14390 - DNA, 654 bp, Zea mays
  misc_feature: Ceres CLONE 1375949-F
aagctggagctccccgcggtggcggccgctctagaactagtggatcccccgggctgcaggaattcgcacgagaccattacctagaacatcctaatcgaaaactctccttatcaccggctaccttctgcaccttaatttcgagattccagtattgacaattgagtctcaccggcgaccatgatattttccatccttatgttccttgttctttcagcgtgtgtggctaccctgacaattttacctcaatgttgacaagttactatagattcgcttcttcccccataccttccatcaatgatagcttcagtatgtgatgatccagttcttcagccctcttcgctcacacaagctttctcaacaagcacatacctgttaggggcaaggtgtctcaacaatcgctcgtcttatgtatggtgcatccattggtactactgatcgggcataggagctgctgcatctcgtgctacctgtgataacgcagcacttctgctaacattttgtcctactctcaatacactatctcttccatgatcaattgacgacgctgaaccctgctgtgtatttaccgtaaaactgatatccttcgccccctcgtactggcaactctgatttcatcaacttcttctttgagcaactggtcccaatgaatcccgt

SEQ ID NO: 14391 - DNA, 734 bp, Zea mays
  misc_feature: Ceres CLONE 1375952-F
  misc_feature: Encodes the peptide sequence at SEQ ID NO. 14392
  misc_feature (222)..(222): n is a, c, t, g, unknown, or other
  misc_feature (223)..(223): n is a, c, t, g, unknown, or other
  misc_feature (227)..(227): n is a, c, t, g, unknown, or other
  misc_feature (228)..(228): n is a, c, t, g, unknown, or other
  misc_feature (523)..(523): n is a, c, t, g, unknown, or other
aagctggagctccccgcggtggcggccgctctagaactagtggatcccccgggctgcaggaattcgcacgagaccattacctagaacatcctaatcgaaaagaggtggagagatcgcacgcgccctctgccgcttgttcgttcctcgcgcttgccaccaggcaccaccacacacatcccaatctcgcgaggcggcgagggcaagcagaggggtctgcggcgnnaccnncaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgccgtgttcgatgatttcgagaggttcgcacccacgacggccacagtgagctcgtcgctgctgcttgggatcactgggctcccagacactaagttcaagagtgcgatagatactgcactggcagatggtgagtgcaacgcactggagaaggctgnagacaggatgtcctggtacctcaccaaggctcttgcaaatgttggcgctgaactgcctcatcaagcccctgggagagtttcgacggaaatagatggtcgggtagcttatgacacccagggcataatccacaaggtacatgaactgttgaatctatccaccaacatgatgtctcaactgaccgcctggtattcaaaatcctgctacatggaa

SEQ ID NO: 14392 - protein, 244 aa, Zea mays
  misc_feature: Ceres CLONE 1375952-F
  misc_feature: SWISSPROT Homolog: EC 2.2.1.2 Transaldolase
  misc_feature (74)..(74): Xaa is any aa, unknown, or other
  misc_feature (76)..(76): Xaa is any aa, unknown, or other
  misc_feature (174)..(174): Xaa is any aa, unknown, or other
AGAPRGGGRSRTSGSPGLQEFARDHYLEHPNRKEVERSHAPSAACSFLALATRHHHTHPNLARRRGQAEGSAAXPXKPATFSLRRPHLAARAAAGNAPTSPVREVVTELDAVAGFSEIVPDTAVFDDFERFAPTTATVSSSLLLGITGLPDTKFKSAIDTALADGECNALEKAXDRMSWYLTKALANVGAELPHQAPGRVSTEIDGRVAYDTQGIIHKVHELLNLSTNMMSQLTAWYSKSCYME

SEQ ID NO: 14393 - DNA, 667 bp, Zea mays
  misc_feature: Ceres CLONE 1375954-F
  misc_feature (350)..(350): n is a, c, t, g, unknown, or other
  misc_feature (369)..(369): n is a, c, t, g, unknown, or other
  misc_feature (392)..(392): n is a, c, t, g, unknown, or other
agagctggagctccccgcggtggcggccgctctataactagtggatcccccgggctgcaggaattcgcacgagaccatacctagaacatcctaatcgaaaaaacgcccccatccgtttcttcctccttgccaggacaggagtctcaactctcaagtctcaaccacgtggagagtggagtagtggaccgaccatggccaccgccgccgacatccgcgtctccatcggctaccagacccgcttcgggctccgcctcgccgccgcgctctcctccccacccccatccgccgccagcaactccgccttctccccgctctccctccacgtcgagctcatcctcctcggcgccggngatggtagctgtacgcccnatcacctcggcgggcgcgtcagnacgataaccgcccgcagggttcgagggtttattggcactcaacatcagggtacagcaactacagctcgtcgagcaatcaagctttggggcccacccccagcaccaccggttcgttccattcaaccaactagcttgcgtagagctctgcttcctagttgaaagaaccacaactaaattccggccgggtatccagttgcgtacccccccaatttactccattcaaccaactgagaacaatgaactcttcgggctaatttatcacagcagagaatact

SEQ ID NO: 14394 - DNA, 618 bp, Zea mays
  misc_feature: Ceres CLONE 1375956-F
  misc_feature: Encodes the peptide sequence at SEQ ID NO. 14395
  misc_feature (457)..(457): n is a, c, t, g, unknown, or other
  misc_feature (460)..(460): n is a, c, t, g, unknown, or other
  misc_feature (544)..(544): n is a, c, t, g, unknown, or other
aagctggagctccccgcggtggcggccgctctagaactagtggatcccccgggctgcaggaattcgcacgagaccattacctagaacatcctaatcgaaaagactcctcccgaacttccacatctctgctctgccttcccagtctcacatccctgaaaacctcacaaaaccctcgtttgctccccaccaccccgccgcgccgccgcctgtaccagctgcgtcaagatgagtcggcaccctgaggtgaagtgggctcagaggatcgacaaggtttacatcactgtacagttacctgacgcagaggatgctaaggtcaatttggatccagatggtgtcttcacattctctggcagtgctggtacaaacttgtatgaattggaactagatctgaatgacaaagtaaacgttgaggctagcaaaataagtgtgggggtcaggtccatattctgtatcgtanaanaagctgaaggcaaatggtggaagaaactcgttcgagatgatcaaggggcacctcactttgtgaaaggtgattggaacaatgggntgatgaagatgatgatggtgctgatatcaacatggatgggatggactcctcaaatttcgggggcatgggtggaa

SEQ ID NO: 14395 - protein, 131 aa, Zea mays
  misc_feature: Ceres CLONE 1375956-F
  misc_feature (5)..(79): Pfam Name: CS Pfam Description: CS domain
  misc_feature: SWISSPROT Homolog: EC 5.3.99.3 Prostaglandin-E synthase
  misc_feature (78)..(78): Xaa is any aa, unknown, or other
  misc_feature (79)..(79): Xaa is any aa, unknown, or other
  misc_feature (107)..(107): Xaa is any aa, unknown, or other
MSRHPEVKWAQRIDKVYITVQLPDAEDAKVNLDPDGVFTFSGSAGTNLYELELDLNDKVNVEASKISVGVRSIFCIVXXAEGKWWKKLVRDDQGAPHFVKGDWNNGXMKMMMVLISTWMGWTPQISGAWVE

SEQ ID NO: 14396 - DNA, 719 bp, Zea mays
  misc_feature: Ceres CLONE 1375963-F
  misc_feature: Encodes the peptide sequence at SEQ ID NO. 14397
  misc_feature (460)..(460): n is a, c, t, g, unknown, or other
  misc_feature (477)..(477): n is a, c, t, g, unknown, or other
  misc_feature (478)..(478): n is a, c, t, g, unknown, or other
  misc_feature (488)..(488): n is a, c, t, g, unknown, or other
  misc_feature (506)..(506): n is a, c, t, g, unknown, or other
  misc_feature (514)..(514): n is a, c, t, g, unknown, or other
  misc_feature (627)..(627): n is a, c, t, g, unknown, or other
  misc_feature (631)..(631): n is a, c, t, g, unknown, or other
caaagctggagctccccgcggtggcggccgctctagaactagtggatcccccgggctgcaggaattcgcacgagaccattacctagaacatcctaatcgaaaagctttcttagaggtgggttggcttctcctccccctccggttcgggttcgggttcgtgaggttctccggggttcgggttcgtgggtgagcggatcgagatggcggcgtcggatgttgagtaccgctgcttcgtcggcgggctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccngcgcggccgtggaggcnngcgcggtggntaccgtggtggccgtggnaggcgcgnctaacgcggtggcgggcgccgtgatgggcgttgcggctaccgcggtggcggcggctacggtggcgggggcggctacggtggtgggggcggggctacggcggtggcaacggggngggnggtaacgaaactcgacgggactggaggaatgggcggtgggcccgcgcgccaagtatctggtccctacggggagttaccctagtcagag

SEQ ID NO: 14397 - protein, 104 aa, Zea mays
  misc_feature: Ceres CLONE 1375963-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (87)..(87): Xaa is any aa, unknown, or other
  misc_feature (93)..(93): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSXRGRGGXRGGYRGGRGRR

SEQ ID NO: 14398 - DNA, 668 bp, Zea mays
  misc_feature: Ceres CLONE 1375964-F
  misc_feature: Encodes the peptide sequence at SEQ ID NO. 14399
  misc_feature (396)..(396): n is a, c, t, g, unknown, or other
  misc_feature (412)..(412): n is a, c, t, g, unknown, or other
  misc_feature (419)..(419): n is a, c, t, g, unknown, or other
  misc_feature (420)..(420): n is a, c, t, g, unknown, or other
  misc_feature (424)..(424): n is a, c, t, g, unknown, or other
caaagctggagctccccgcggtggcggccgctctagaactagtggatcccccgggctgcaggaattcgcacgagaccattacctagaacatcctaatcgaaaagacatcacagatcacacacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatggtcaagtatgacactgtgcacggacagtggaagcaccatgagggtcaggtgaaggactccnagaccctttctcttgntgagaanngagntgctgtgtttggctgcaggaaccctgaggagatcccatgggggttcgttggcgctgaattatgtggtgagtctactggtgttttcactgaccagaagaagctgcagctcactggaagggtggggcaagaaaggtgcattttctgctcctaacaggatgcccccaggttcgttggtggtggcaccaaaagggaggacaggctggactcaaaattggctctaaagggagctgggcaaccaaatggc

SEQ ID NO: 14399 - protein, 125 aa, Zea mays
  misc_feature: Ceres CLONE 1375964-F
  misc_feature (4)..(121): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (67)..(67): Xaa is any aa, unknown, or other
  misc_feature (72)..(72): Xaa is any aa, unknown, or other
  misc_feature (74)..(74): Xaa is any aa, unknown, or other
  misc_feature (75)..(75): Xaa is any aa, unknown, or other
  misc_feature (76)..(76): Xaa is any aa, unknown, or other
MAKIKIGINGFGRIGRLVARVALQSDDVELVAVNDPFISTDYMTYMVKYDTVHGQWKHHEGQVKDSXTLSLXEXXXAVFGCRNPEEIPWGFVGAELCGESTGVFTDQKKLQLTGRVGQERCIFCS

SEQ ID NO: 14400 - DNA, 742 bp, Zea mays
  misc_feature: Ceres CLONE 1375967-F
  misc_feature: Translation starting site: 216
  misc_feature: Pfam Name: Hin1 Pfam Description: Harpin-induced protein 1 (Hin1)
  misc_feature (394)..(394): n is a, c, t, g, unknown, or other
  misc_feature (421)..(421): n is a, c, t, g, unknown, or other
  misc_feature (442)..(442): n is a, c, t, g, unknown, or other
  misc_feature (528)..(528): n is a, c, t, g, unknown, or other
  misc_feature (557)..(557): n is a, c, t, g, unknown, or other
  misc_feature (570)..(570): n is a, c, t, g, unknown, or other
  misc_feature (571)..(571): n is a, c, t, g, unknown, or other
  misc_feature (619)..(619): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaaaatccagccccatccgtcgattggaacccagatccgcaggccgcagcacaagagggtgggatcggatcggatcggagcagagggggaccgaccagaatccgccggcgaccaccatgggctccgcgagccgtgccgtctcgtgcctgtgctgcccctgcaagtgcctggcgtgcgggctcctgagctgcctgtgcagcatcctcgtctcgctcgccgtcgtcctcggcgtcgtcgccctcatcctctacttcatcttcaagccgcacatgatcgccgccaccgtggactcggnctcgctctcccagttcgcgctgtcggngtcctccacgctcttctacgnactcaacgtcaccatgacggtgcgcaccccaacacgcgggtggggctcttactacacgacgtccaggcgctggccctgttcagcgnacagcgcttcggctacgccccgctcgacngcttctacagggnnaccatggcgtcaccagctcagccccgggttccgcgcacgcagctcctncagggcgacgtcacccgccgcgagttcaggcagagcagtccgggnaacttttcgcgtcgacgtcgactcacgcaagtttcaggtgaaagtctggcgttcaaagtccggggccccagggtaggt

SEQ ID NO: 14401 - DNA, 745 bp, Zea mays
  misc_feature: Ceres CLONE 1375968-F
  misc_feature: Encodes the peptide sequence at SEQ ID NO. 14402
  misc_feature (687)..(687): n is a, c, t, g, unknown, or other
  misc_feature (709)..(709): n is a, c, t, g, unknown, or other
aagctggagctccccgcggtggcggccgctctagaactagtggatcccccgggctgcaggaattcgcacgagaccattacctagaacatcctaatcgaaaaaatcgcaagctcaggcaaaaacacaaagcgcttaaaccacactcaaaccaaccgccagccaacaaacaggcctcctagtcccgaccagaactcgctcgtagccccgagaacccgacagcgcgagatggctcccgagctgatgacagccaagatgaccgccaaggccgccgcggtgtcggcggcggcggtgtcgtccaagactgccacgagggcgtacgtgacgttcctggcggccgacggcgactactgtaagggcgtggtgtggctgcacaaggacctgcgcagagtccgctcggcctaccacctgatggtgtccgtgctgccagacgtgtccgagtcccaccggcgaatcctcgtatcgtagggatgcgtcttacaagagatcgagcccgtgtacccgcctgagaaacagacgcatttcagcatggctgactacgtcatcaactactcgcagcttcgaatcctgggagtacgtggagtacgataggatgatgtacctggacgcgtacatccatgtggtacaagaaatcgacgacctgtacgagctcgaaaggggacttctacgcggagatggactggtcttgcnacaaacgtggtcccacccccgnaggacgggatcggctactgccagagggccagaaaag

SEQ ID NO: 14402 - protein, 79 aa, Zea mays
  misc_feature: Ceres CLONE 1375968-F
MAPELMTAKMTAKAAAVSAAAVSSKTATRAYVTFLAADGDYCKGVVWLHKDLRRVRSAYHLMVSVLPDVSESHRRILVS

SEQ ID NO: 14403 - DNA, 712 bp, Zea mays
  misc_feature: Ceres CLONE 1375971-F
  misc_feature: Encodes the peptide sequence at SEQ ID NO. 14404
  misc_feature (546)..(546): n is a, c, t, g, unknown, or other
  misc_feature (600)..(600): n is a, c, t, g, unknown, or other
  misc_feature (644)..(644): n is a, c, t, g, unknown, or other
  misc_feature (646)..(646): n is a, c, t, g, unknown, or other
  misc_feature (677)..(677): n is a, c, t, g, unknown, or other
  misc_feature (678)..(678): n is a, c, t, g, unknown, or other
aaagctggagctccccgcggtggcggccgctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacgcagcggcgccagcctgcaggaagccagcccctattcgagacaaggtcgatctttgctgccttggcgagcttcagccgaatcaaggtcgagcatggcggcaggccagtaaatagagcaacacaaaacccttcaaattaatggagacctctgcagaacccccgacccggggccgcacacaggnggccacttcccccatcgcatcgccctcgtcgtcgttgaggctgtggaggccagncgcgcagcgcaacatgcgcaatcagttgtcccatctgagcgcgncnaggagcagtggctggccgccgttgctgacgnncgtgcccacgcctccgcgttcgtcaacgtccact

SEQ ID NO: 14404 - protein, 70 aa, Zea mays
  misc_feature: Ceres CLONE 1375971-F
  misc_feature (15)..(15): Xaa is any aa, unknown, or other
  misc_feature (33)..(33): Xaa is any aa, unknown, or other
  misc_feature (48)..(48): Xaa is any aa, unknown, or other
  misc_feature (59)..(59): Xaa is any aa, unknown, or other
METSAEPPTRGRTQXATSPIASPSSSLRLWRPXAQRNMRNQLSHLSAXRSSGWPPLLTXVPTPPRSSTST

SEQ ID NO: 14405 - DNA, 718 bp, Zea mays
  misc_feature: Ceres CLONE 1375972-F
  misc_feature: Encodes the peptide sequence at SEQ ID NO. 14406
  misc_feature (550)..(550): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (599)..(599): n is a, c, t, g, unknown, or other
  misc_feature (639)..(639): n is a, c, t, g, unknown, or other
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcacaccttcttcagtgagactggtgctgggaagcacgtgccccgtgctgtttttgttgaccttgacccactgtcatcgatgaggtgaggactggcacctaccgccagctcttccaccctgagcagctcatcagtgggaagggagatgcagccaacaactttgcccgtggtcactacaccattggncaggagattgtnnngactatgcttgatcgcatcaggaagctttgcgacnactgcactggtctccagggcttcctcgtctttcacgctgntggntggagaaacggctcttggcttgggttccctctcctagaagcgctgtctgtgactacggcaagaagcccagcttgt

SEQ ID NO: 14406 - protein, 50 aa, Zea mays
  misc_feature: Ceres CLONE 1375972-F
  misc_feature (11)..(11): Xaa is any aa, unknown, or other
  misc_feature (24)..(24): Xaa is any aa, unknown, or other
MLDRIRKLCDXCTGLQGFLVFHAXGWRNGSWLGFPLLEALSVTTARSPAC

SEQ ID NO: 14407 - DNA, 729 bp, Zea mays
  misc_feature: Ceres CLONE 1375973-F
  misc_feature: Encodes the peptide sequence at SEQ ID NO. 14408
  misc_feature (423)..(423): n is a, c, t, g, unknown, or other
  misc_feature (434)..(434): n is a, c, t, g, unknown, or other
  misc_feature (461)..(461): n is a, c, t, g, unknown, or other
  misc_feature (466)..(466): n is a, c, t, g, unknown, or other
  misc_feature (527)..(527): n is a, c, t, g, unknown, or other
  misc_feature (560)..(560): n is a, c, t, g, unknown, or other
  misc_feature (567)..(567): n is a, c, t, g, unknown, or other
  misc_feature (600)..(600): n is a, c, t, g, unknown, or other
  misc_feature (601)..(601): n is a, c, t, g, unknown, or other
  misc_feature (650)..(650): n is a, c, t, g, unknown, or other
  misc_feature (654)..(654): n is a, c, t, g, unknown, or other
aaagctggagctccccgcggtggcggccgctctagaactagtggatcccccgggctgcaggaattcgcacgagaccattacctagaacatcctaatcgaaaaacatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcaggtgaggcacgcnggcgggacggntggcttcttctggctggtgaaccacgncgtgncggaggagctgatggggcgcatgctccgcggggtgcgcccagtcaacgagggccccgtggnagcgaaagcagcgctctactcccagggactggntcgcaanctgcgctttcgctccacttcgacctcttcaggnncgctgcgccgactggcgcacacgctcttctgcgaggtggctcgaacccngcgncgcgggagagctgcccgagcactgaggacgtgatgctggatacggcgcggcgtgagaaactgccgcggtcgggtc

SEQ ID NO: 14408 - protein, 179 aa, Zea mays
  misc_feature: Ceres CLONE 1375973-F
  misc_feature: SWISSPROT Homolog: EC 1.14.11.20 Desacetoxyvindoline 4-hydroxylase
  misc_feature (96)..(96): Xaa is any aa, unknown, or other
  misc_feature (105)..(105): Xaa is any aa, unknown, or other
  misc_feature (107)..(107): Xaa is any aa, unknown, or other
  misc_feature (127)..(127): Xaa is any aa, unknown, or other
  misc_feature (138)..(138): Xaa is any aa, unknown, or other
  misc_feature (140)..(140): Xaa is any aa, unknown, or other
  misc_feature (152)..(152): Xaa is any aa, unknown, or other
  misc_feature (168)..(168): Xaa is any aa, unknown, or other
MAPTTATKDDSGYGDERRRELQAFDDTKLGVKGLVDSGVKSIPSIFHHPPEALSDIISPAPLPSSPPSGAAIPVVDLSVTRREDLVEQVRHAGGTXGFFWLVNHXVXEELMGRMLRGVRPVNEGPVXAKAALYSQGLXRXLRFRSTSTSSGXLRRLAHTLFCEVARTXRRGRAARALRT

SEQ ID NO: 14409 - DNA, 717 bp, Zea mays
  misc_feature: Ceres CLONE 1375975-F
  misc_feature: Translation starting site: 172
  misc_feature: Pfam Name: ATP-synt_G Pfam Description: Mitochondrial ATP synthase g subunit
  misc_feature (252)..(252): n is a, c, t, g, unknown, or other
  misc_feature (343)..(343): n is a, c, t, g, unknown, or other
  misc_feature (344)..(344): n is a, c, t, g, unknown, or other
  misc_feature (394)..(394): n is a, c, t, g, unknown, or other
  misc_feature (419)..(419): n is a, c, t, g, unknown, or other
  misc_feature (433)..(433): n is a, c, t, g, unknown, or other
  misc_feature (450)..(450): n is a, c, t, g, unknown, or other
aaagctggagctccccgcggtggcggccgctctagaactagtggatcccccgggctgcaggaattcgcacgagaccattacctagaacatcctaatcgaaaaatcgatctcctcgcacctcgtggcggcacctctccccttcgatccaccaagggtttaggatcggcggcgatggcggcgaggctggcacagctgcgcgctcaggcggtgcaggcggcggagttcgcctcgaagcacggcggctcctactancaggagctcatggagaagaacagcagtacgtcgtgcagccccccacatcgagaaatggcaggagctctccaagcagctcttctacacccgnnctcgcagcctaccaggtcggtatgagtcattctggaagggagctgatggntgtcagcaggtatggaagaacaggnaaggacctcaaggntggaggacttggggatngccacttttatttggaggtgagctttatgcatggttctgggaaagccaaattggtggcagaagtttccccttaacgggttatagggctaggttgattcccggggattaaaaacgggtttaaaaaaccgaccttttaagtggggggttgggcaaaacaaaaaagaaaacccggccctcccttccaaattttggtttttttggaagagctcccctaggggggaagggcccacaaaaaggggccctgggggggaaactttgccccaaaaa

SEQ ID NO: 14410 - DNA, 701 bp, Zea mays
  misc_feature: Ceres CLONE 1375977-F
  misc_feature: Encodes the peptide sequence at SEQ ID NO. 14411
  misc_feature (1)..(1): n is a, c, t, g, unknown, or other
  misc_feature (322)..(322): n is a, c, t, g, unknown, or other
  misc_feature (382)..(382): n is a, c, t, g, unknown, or other
  misc_feature (394)..(394): n is a, c, t, g, unknown, or other
  misc_feature (408)..(408): n is a, c, t, g, unknown, or other
naaagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcatcagcggtgtcttcggtatgtgaaaacccaatccttcanccctacaggatccaacaggcaatcgcagctggcatcttacctttatcacccttgttcctnccacatcatcangcctattacacagntaccctttggtgcattattggcacaaacatcagggaacaacactacacaacttgtgctagcaaccttgctgcctactccagcaacagagtttctccattcaaccactaggtcattgactctgcttctaattgaaaaaaaaaaattacatttcgccaggtacggttggctacccccaaaatttttccttaaaaccaatggaaaattgaacttccgggtaattaaaaggaaaaaaataatactttgccccctttggtggggggacccctgaactcttttaaaacacccagtttgt

SEQ ID NO: 14411 - protein, 118 aa, Zea mays
  misc_feature: Ceres CLONE 1375977-F
  misc_feature (54)..(54): Xaa is any aa, unknown, or other
  misc_feature (78)..(78): Xaa is any aa, unknown, or other
  misc_feature (83)..(83): Xaa is any aa, unknown, or other
MAAKIFCLLMLLGLSASAATATIFPQCSQAPIASLLPPYLSSAVSSVCENPILXPYRIQQAIAAGILPLSPLFLPHHXAYYTXTLWCIIGTNIREQHYTTCASNLAAYSSNRVSPFNH

SEQ ID NO: 14412 - DNA, 721 bp, Zea mays
  misc_feature: Ceres CLONE 1375978-F
  misc_feature: Encodes the peptide sequence at SEQ ID NO. 14413
  misc_feature (574)..(574): n is a, c, t, g, unknown, or other
  misc_feature (583)..(583): n is a, c, t, g, unknown, or other
  misc_feature (584)..(584): n is a, c, t, g, unknown, or other
  misc_feature (591)..(591): n is a, c, t, g, unknown, or other
  misc_feature (699)..(699): n is a, c, t, g, unknown, or other
aaagctggagctccccgcggtggcggccgctctataactagtggatcccccgggctgcaggaattcgcacgagaccattacctagaacatcctaatcgaaaatcccaccgaattcattccacccccgtctcctccgatcggaccaccgggccagcagcggggcggatcgtgacgtcagcagccatggtgaaggcctaccccacggtgaacgaggactacctcaaggcggtcgacaaggccaagcgcaagctccgcggcctcatcgccgagaagaattgcgccccgctcatgctccgcctcgcatggcactccgcgggcaccttcgatgtggccaccaaaaccgggggccccttcggcaccatgaagaaccccgccgagcaggcgcacggagccaacgccggactggaaattgccatcaggctgctagagcccatcaaggagcagttccccatcctatcctacgctgacttctaccagcttgctggagtcgtggcagtcgaggtaaccggcggacctgatgtccccttccaccccgggaggcaggacaagcctgagcctccaccggaaggccgtncttctgatnngcaccangttctgatcacctcaagcaggttttctcgacacagatgggtttgagcgaccaggacatgttgcgcttttctggtgtcacaccctgggaagatgcacaggacaggtctngtttgagggagcctggacctca

SEQ ID NO: 14413 - protein, 150 aa, Zea mays
  misc_feature: Ceres CLONE 1375978-F
  misc_feature (19)..(147): Pfam Name: peroxidase Pfam Description: Peroxidase
  misc_feature: SWISSPROT Homolog: EC 1.11.1.11 L-ascorbate peroxidase
  misc_feature (131)..(131): Xaa is any aa, unknown, or other
  misc_feature (134)..(134): Xaa is any aa, unknown, or other
  misc_feature (136)..(136): Xaa is any aa, unknown, or other
MVKAYPTVNEDYLKAVDKAKRKLRGLIAEKNCAPLMLRLAWHSAGTFDVATKTGGPFGTMKNPAEQAHGANAGLEIAIRLLEPIKEQFPILSYADFYQLAGVVAVEVTGGPDVPFHPGRQDKPEPPPEGRXSDXHXVLITSSRFSRHRWV

SEQ ID NO: 14414 - DNA, 629 bp, Zea mays
  misc_feature: Ceres CLONE 1375981-F
  misc_feature: Encodes the peptide sequence at SEQ ID NO. 14415
  misc_feature (569)..(569): n is a, c, t, g, unknown, or other
  misc_feature (570)..(570): n is a, c, t, g, unknown, or other
aaagctggagctccccgcggtggcggccgctctagaactagtggatcccccgggctgcaggaattcgcacgagaccattacctagaacatcctaatcgaaaaatccactgagcactcgcacaagcagggacaaggaagtgcaccggcggcgtcgccatcgatcgagtagatactagatagtgtgtcaggttgctgtcagctagagccatggcgtccatgcagaagagccgcgagcagcgcgcccaggccgcggcgcagaaggcggccgacgagctccacgcgtcgaggcaggacagagtccccgaggaggcgcccgtcagcccccgcggcggcggcggcatcctgggcagcctgcaggaggggaaggcgaacgccaggggcgtggcggacgccgccatgggcaaggccagcgagacgaaggacgcggcggcggacaaggcgggtggcgtcagggacgcggcggcggacaggacgggaaataataaggcgggggccgccgagtcggaggaggacgtgatgctaagggtgaaggcggcggaccagatgacggggcagggtcaagccccccnncccccaaagagggggggaggaggacaccggcgttccgcggagacgacgttctggctgat

SEQ ID NO: 14415 - protein, 140 aa, Zea mays
  misc_feature: Ceres CLONE 1375981-F
  misc_feature (121)..(121): Xaa is any aa, unknown, or other
MASMQKSREQRAQAAAQKAADELHASRQDRVPEEAPVSPRGGGGILGSLQEGKANARGVADAAMGKASETKDAAADKAGGVRDAAADRTGNNKAGAAESEEDVMLRVKAADQMTGQGQAPXPPKRGGGGHRRSAETTFWL

SEQ ID NO: 14416 - DNA, 630 bp, Zea mays
  misc_feature: Ceres CLONE 1375986-F
  misc_feature: Encodes the peptide sequence at SEQ ID NO. 14417
aagctggagctccccgcggtggcggccgctctagaactagtggatcccccgggctgcaggaattcgcacgagaccattacctataacatcctaatcgaaaaagcccgatctcgcgtcgaacgatgtgaaagaactcctttcttctacgcggacggattcgtctcgtctcgagcagctcgcttcgagagttctctctcctctcgatcgattgcttcctccaccgaggcgtgggaaagcgccgcccagatcgccgtaggcaagcggcgatcactccagctctgagcataagtttctgcagggaggctcgtgaagtcagtagtctgtatctggcagtggcagcacagcgcaccatggaatgtgtgagctggagaacggtgtgttgtttatcagtgctgtgcaccgtgctgttcttgcgcccggtcgagggcattcgcttcgtgatcgatagagaagagtgcttctcgcataacgtggaggatgagggggatactgtccatgtatccttcggcgtcatcaaggatgacaccccgtggtattacagcgaagaaggcgatgatcttgtggataaggatcctaatggcgctcaagtccgtgattctcgagataagactagtgataagtttgagttcg

SEQ ID NO: 14417 - protein, 93 aa, Zea mays
  misc_feature: Ceres CLONE 1375986-F
MECVSWRTVCCLSVLCTVLFLRPVEGIRFVIDREECFSHNVEDEGDTVHVSFGVIKDDTPWYYSEEGDDLVDKDPNGAQVRDSRDKTSDKFEF

SEQ ID NO: 14418 - DNA, 614 bp, Zea mays
  misc_feature: Ceres CLONE 1375992-F
tggagctccccgcggtggcggccgctctagatactagtggatcccccgggctgcaggaattcgcacgagaccattacctagaacatcctaatcgaaaaagaccgtgacaagttcatcatccagccccgcttgcgcttgaccccttcaagtccaagcattccattccatccagtaccttccttgtcaccttgaccttccccctcccttcctagtcccctactcgccagtccacaggacctcgaccccgctaagcaagctccaagagcgatcgccgcagaagatcccgcgatgcaggccccgccggcgccctcctccgtcgacctgccgctggcggtggcgccgccgccggtgaaggcgccgaccccgcggcccccgcccccggcctcgctgcagcccgagtccccgggggtcttcttctccgccgccgccgccgccgcgcccctgggcaccgcccaccgccgcatcgccatcgccgtcgaacctctcggacgagtcccgcctacgcccgtgcgctgggccgtcccccacctaccctccccccccggggaagccggtaatccctgctccacgggggcccccaccttcctggctctaacgggcccaaatggggcgcc

SEQ ID NO: 14419 - DNA, 639 bp, Zea mays
  misc_feature: Ceres CLONE 1375994-F
  misc_feature: Encodes the peptide sequence at SEQ ID NO. 14420
  misc_feature (556)..(556): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcggctccgaagggggcgaagtggcggcgccagtgcctgcgcccgcacgaggggcagggcgtggaggacccagagtggnttggaggcggtgccgccgccgggggactggccgtcgacttggagcaaagagtacggtccgcggaagcaaaaccgcgggaagtg

SEQ ID NO: 14420 - protein, 142 aa, Zea mays
  misc_feature: Ceres CLONE 1375994-F
  misc_feature (115)..(115): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSAPKGAKWRRQCLRPHEGQGVEDPEWXGGGAAAGGLAVDLEQRVRSAEAKPREV

SEQ ID NO: 14421 - DNA, 615 bp, Zea mays
  misc_feature: Ceres CLONE 1376001-F
  misc_feature: Encodes the peptide sequence at SEQ ID NO. 14422
  misc_feature (489)..(489): n is a, c, t, g, unknown, or other
  misc_feature (601)..(601): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctcggnaaaggggcgagtgccggcgccagtgcctgcgccgccacgagggccagccgtggaggacctcagagtggcatgaggcggtgccgccgccgccggactggccgtcgactggagncaaagagtacggtc

SEQ ID NO: 14422 - protein, 115 aa, Zea mays
  misc_feature: Ceres CLONE 1376001-F
  misc_feature (92)..(92): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSXKGRVPAPVPAPPRGPAVEDLRVA

SEQ ID NO: 14423 - DNA, 639 bp, Zea mays
  misc_feature: Ceres CLONE 1376020-F
  misc_feature: Encodes the peptide sequence at SEQ ID NO. 14424
aagctggagctccccgcggtggcggccgctctagaactagtggatcccccgggctgcaggaattcgcacgagaccataactaaaacacttctaatccgaactccaaagtctcgtccaccatttcgctcccgcaagcaccgatttgtttactgctctctccgacgcgcggcggccaacctccctacgactactgaaccatgtgcggagccgagatccttgtcaacctttacgagccgtcgccgctccggttcacagagcgggacatctgcgcacagaatatgaatctcacgagggctgctgcatcggagaggcgttcgctcgcggcgcaggacgatgtaggacttcgaggccgactttgaggccttcgaggccgactccagtgattcacatttgtagctcagggaggctactgacgacgacctctgcgagatcaagcccttcactgccaagaggactttctccagcgatgctttaggcaccatgactagtgctgtacctaggtcagccaagaggaagagaaagaatctataccggggtatccgcctgcgaccttggggcaagtgggctgctgagatcagagatcctcggaaggccgttcgtgtttgtgttggtactttcgatagtcctgaggaagatgca

SEQ ID NO: 14424 - protein, 53 aa, Zea mays
  misc_feature: Ceres CLONE 1376020-F
  misc_feature: The sequence is a functional homolog of SEQ ID NO 135 in the 11/479,226 US patent application
  misc_feature: The sequence is a functional homolog of SEQ ID NO 212 in the 10/225,068 US patent application
  misc_feature: The sequence is a functional homolog of SEQ ID NO 22 in the 10/412,699 US patent application
  misc_feature: The sequence is a functional homolog of SEQ ID NO 4 in the 10/374,780 US patent application
  misc_feature: The sequence is a functional homolog of SEQ ID NO 151 in the 11/479,226 US patent application
  misc_feature: The sequence is a functional homolog of SEQ ID NO 32 in the 10/412,699 US patent application
  misc_feature: The sequence is a functional homolog of SEQ ID NO 34 in the 10/225,068 US patent application
  misc_feature: The sequence is a functional homolog of SEQ ID NO 348 in the 10/374,780 US patent application
  misc_feature: The sequence is a functional homolog of SEQ ID NO 155 in the 11/479,226 US patent application
  misc_feature: The sequence is a functional homolog of SEQ ID NO 2216 in the 10/374,780 US patent application
  misc_feature: The sequence is a functional homolog of SEQ ID NO 34 in the 10/412,699 US patent application
  misc_feature: The sequence is a functional homolog of SEQ ID NO 52 in the 10/903,236 US patent application
  misc_feature: The sequence is a functional homolog of SEQ ID NO 780 in the 10/225,066 US patent application
  misc_feature: The sequence is a functional homolog of SEQ ID NO 1251 in the 11/479,226 US patent application
  misc_feature: The sequence is a functional homolog of SEQ ID NO 202 in the 10/225,068 US patent application
  misc_feature: The sequence is a functional homolog of SEQ ID NO 2436 in the 10/374,780 US patent application
  misc_feature: The sequence is a functional homolog of SEQ ID NO 558 in the 10/225,066 US patent application
  misc_feature: The sequence is a functional homolog of SEQ ID NO 576 in the 10/412,699 US patent application
  misc_feature: The sequence is a functional homolog of SEQ ID NO 1781 in the 11/479,226 US patent application
  misc_feature: The sequence is a functional homolog of SEQ ID NO 270 in the 10/374,780 US patent application
  misc_feature: The sequence is a functional homolog of SEQ ID NO 4 in the 10/225,066 US patent application
  misc_feature: The sequence is a functional homolog of SEQ ID NO 10 in the 10/412,699 US patent application
  misc_feature: The sequence is a functional homolog of SEQ ID NO 124 in the 11/479,226 US patent application
  misc_feature: The sequence is a functional homolog of SEQ ID NO 1448 in the 10/666,642 US patent application
  misc_feature: The sequence is a functional homolog of SEQ ID NO 1789 in the 11/479,226 US patent application
  misc_feature: The sequence is a functional homolog of SEQ ID NO 1862 in the 10/412,699 US patent application
  misc_feature: The sequence is a functional homolog of SEQ ID NO 274 in the 10/374,780 US patent application
  misc_feature: The sequence is a functional homolog of SEQ ID NO 998 in the 10/225,066 US patent application
  misc_feature: The sequence is a functional homolog of SEQ ID NO 16 in the 10/903,236 US patent application
  misc_feature: The sequence is a functional homolog of SEQ ID NO 2209 in the 10/666,642 US patent application
  misc_feature: The sequence is a functional homolog of SEQ ID NO 76 in the 10/714,887 US patent application
  misc_feature: The sequence is a functional homolog of SEQ ID NO 76 in the 11/435,388 US patent application
  misc_feature: The sequence is a functional homolog of SEQ ID NO 242 in the 10/225,066 US patent application
  misc_feature: The sequence is a functional homolog of SEQ ID NO 2494 in the 10/374,780 US patent application
  misc_feature: The sequence is a functional homolog of SEQ ID NO 154 in the 10/225,068 US patent application
  misc_feature: The sequence is a functional homolog of SEQ ID NO 1716 in the 10/412,699 US patent application
  misc_feature: The sequence is a functional homolog of SEQ ID NO 1952 in the 10/374,780 US patent application
  misc_feature: The sequence is a functional homolog of SEQ ID NO 200 in the 11/375,241 US patent application
  misc_feature: The sequence is a functional homolog of SEQ ID NO 4 in the 10/666,642 US patent application
  misc_feature: The sequence is a functional homolog of SEQ ID NO 572 in the 11/435,388 US patent application
  misc_feature: The sequence is a functional homolog of SEQ ID NO 1442 in the 10/666,642 US patent application
  misc_feature: The sequence is a functional homolog of SEQ ID NO 1858 in the 10/412,699 US patent application
  misc_feature: The sequence is a functional homolog of SEQ ID NO 206 in the 11/375,241 US patent application
  misc_feature: The sequence is a functional homolog of SEQ ID NO 2104 in the 10/374,780 US patent application
  misc_feature: The sequence is a functional homolog of SEQ ID NO 292 in the 10/225,066 US patent application
  misc_feature: The sequence is a functional homolog of SEQ ID NO 654 in the 11/435,388 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 1194 in the 10/666,642 US patent application
  misc_feature: The sequence is a functional homolog of SEQ ID NO 610 in the 11/435,388 US patent application
  misc_feature: The sequence is a functional homolog of SEQ ID NO 628 in the 11/479,226 US patent application
  misc_feature: The sequence is a functional homolog of SEQ ID NO 212 in the 10/666,642 US patent application
  misc_feature: The sequence is a functional homolog of SEQ ID NO 2600 in the 10/374,780 US patent application
  misc_feature: The sequence is a functional homolog of SEQ ID NO 2706 in the 10/374,780 US patent application
  misc_feature: The sequence is a functional homolog of SEQ ID NO 294 in the 10/225,066 US patent application
  misc_feature: The sequence is a functional homolog of SEQ ID NO 352 in the 10/225,066 US patent application
  misc_feature: The sequence is a functional homolog of SEQ ID NO 159 in the 11/479,226 US patent application
  misc_feature: The sequence is a functional homolog of SEQ ID NO 2218 in the 10/374,780 US patent application
  misc_feature: The sequence is a functional homolog of SEQ ID NO 36 in the 10/412,699 US patent application
  misc_feature: The sequence is a functional homolog of SEQ ID NO 466 in the 11/435,388 US patent application
  misc_feature: The sequence is a functional homolog of SEQ ID NO 492 in the 10/225,066 US patent application
  misc_feature: The sequence is a functional homolog of SEQ ID NO 1872 in the 10/412,699 US patent application
  misc_feature: The sequence is a functional homolog of SEQ ID NO 324 in the 10/374,780 US patent application
  misc_feature: The sequence is a functional homolog of SEQ ID NO 544 in the 11/435,388 US patent application
  misc_feature: The sequence is a functional homolog of SEQ ID NO 78 in the 10/225,066 US patent application
  misc_feature: The sequence is a functional homolog of SEQ ID NO 1528 in the 10/374,780 US patent application
  misc_feature: The sequence is a functional homolog of SEQ ID NO 1289 in the 10/374,780 US patent application
  misc_feature: The sequence is a functional homolog of SEQ ID NO 1435 in the 10/412,699 US patent application
  misc_feature: The sequence is a functional homolog of SEQ ID NO 1352 in the 10/666,642 US patent application
  misc_feature: The sequence is a functional homolog of SEQ ID NO 167 in the 11/479,226 US patent application
  misc_feature: The sequence is a functional homolog of SEQ ID NO 1718 in the 10/412,699 US patent application
  misc_feature: The sequence is a functional homolog of SEQ ID NO 198 in the 10/374,780 US patent application
  misc_feature: The sequence is a functional homolog of SEQ ID NO 52 in the 11/375,241 US patent application
  misc_feature: The sequence is a functional homolog of SEQ ID NO 642 in the 10/412,699 US patent application
  misc_feature: The sequence is a functional homolog of SEQ ID NO 860 in the 11/435,388 US patent application
  misc_feature: The sequence is a functional homolog of SEQ ID NO 996 in the 10/225,066 US patent application
  misc_feature: The sequence is a functional homolog of SEQ ID NO 106 in the 11/375,241 US patent application
  misc_feature: The sequence is a functional homolog of SEQ ID NO 2876 in the 10/374,780 US patent application
  misc_feature: The sequence is a functional homolog of SEQ ID NO 44 in the 10/903,236 US patent application
  misc_feature: The sequence is a functional homolog of SEQ ID NO 474 in the 10/225,066 US patent application
  misc_feature: The sequence is a functional homolog of SEQ ID NO 560 in the 11/435,388 US patent application
  misc_feature: The sequence is a functional homolog of SEQ ID NO 172 in the 11/375,241 US patent application
  misc_feature: The sequence is a functional homolog of SEQ ID NO 800 in the 11/435,388 US patent application
  misc_feature: The sequence is a functional homolog of SEQ ID NO 1290 in the 10/374,780 US patent application
  misc_feature: The sequence is a functional homolog of SEQ ID NO 1436 in the 10/412,699 US patent application
  misc_feature: The sequence is a functional homolog of SEQ ID NO 446 in the 10/666,642 US patent application
  misc_feature: The sequence is a functional homolog of SEQ ID NO 894 in the 11/435,388 US patent application
  misc_feature: The sequence is a functional homolog of SEQ ID NO 1291 in the 10/374,780 US patent application
  misc_feature: Functional homolog of the protein sequence given in SEQ ID NO 96874
  misc_feature: Useful for making plants with altered tocopherol content
  misc_feature: The sequence is a functional homolog of SEQ ID NO 116 in the 11/479,226 US patent application
  misc_feature: The sequence is a functional homolog of SEQ ID NO 1712 in the 10/412,699 US patent application
  misc_feature: The sequence is a functional homolog of SEQ ID NO 1948 in the 10/374,780 US patent application
  misc_feature: The sequence is a functional homolog of SEQ ID NO 256 in the 11/375,241 US patent application
  misc_feature: The sequence is a functional homolog of SEQ ID NO 6 in the 10/412,699 US patent application
  misc_feature: The sequence is a functional homolog of SEQ ID NO 722 in the 10/225,066 US patent application
  misc_feature: The sequence is a functional homolog of SEQ ID NO 906 in the 11/435,388 US patent application
  misc_feature: The sequence is a functional homolog of SEQ ID NO 1415 in the 11/479,226 US patent application
  misc_feature: The sequence is a functional homolog of SEQ ID NO 1426 in the 10/666,642 US patent application
  misc_feature: The sequence is a functional homolog of SEQ ID NO 1830 in the 10/412,699 US patent application
  misc_feature: The sequence is a functional homolog of SEQ ID NO 666 in the 10/412,699 US patent application
  misc_feature: Functional homolog of the protein sequence given in SEQ ID NO 96875
  misc_feature: Useful for making plants with altered lutein content
  misc_feature: The sequence is a functional homolog of SEQ ID NO 179 in the 11/479,226 US patent application
  misc_feature: The sequence is a functional homolog of SEQ ID NO 1288 in the 10/374,780 US patent application
  misc_feature: The sequence is a functional homolog of SEQ ID NO 1434 in the 10/412,699 US patent application
  misc_feature: The sequence is a functional homolog of SEQ ID NO 4 in the 10/225,068 US patent application
  misc_feature: The sequence is a functional homolog of SEQ ID NO 406 in the 10/374,780 US patent application
  misc_feature: The sequence is a functional homolog of SEQ ID NO 90 in the 10/225,066 US patent application
  misc_feature: The sequence is a functional homolog of SEQ ID NO 1 in US patent 7253342
  misc_feature: The sequence is a functional homolog of SEQ ID NO 2602 in the 10/374,780 US patent application
  misc_feature: The sequence is a functional homolog of SEQ ID NO 656 in the 11/435,388 US patent application
  misc_feature: The sequence is a functional homolog of SEQ ID NO 68 in the 10/225,066 US patent application
  misc_feature: The sequence is a functional homolog of SEQ ID NO 1380 in the 11/479,226 US patent application
  misc_feature: The sequence is a functional homolog of SEQ ID NO 646 in the 10/412,699 US patent application
  misc_feature: The sequence is a functional homolog of SEQ ID NO 40 in the 10/903,236 US patent application
  misc_feature: The sequence is a functional homolog of SEQ ID NO 1262 in the 11/479,226 US patent application
  misc_feature: The sequence is a functional homolog of SEQ ID NO 144 in the 10/225,066 US patent application
  misc_feature: The sequence is a functional homolog of SEQ ID NO 172 in the 10/374,780 US patent application
  misc_feature: The sequence is a functional homolog of SEQ ID NO 224 in the 10/225,068 US patent application
  misc_feature: The sequence is a functional homolog of SEQ ID NO 582 in the 10/412,699 US patent application
  misc_feature: Functional homolog of the protein sequence given in SEQ ID NO 96876
  misc_feature: Useful for making plants with altered sterol content
  misc_feature: The sequence is a functional homolog of SEQ ID NO 1474 in the 10/666,642 US patent application
  misc_feature: The sequence is a functional homolog of SEQ ID NO 16 in the 10/225,066 US patent application
  misc_feature: The sequence is a functional homolog of SEQ ID NO 2144 in the 10/374,780 US patent application
  misc_feature: The sequence is a functional homolog of SEQ ID NO 1302 in the 10/374,780 US patent application
  misc_feature: The sequence is a functional homolog of SEQ ID NO 1447 in the 10/412,699 US patent application
  misc_feature: The sequence is a functional homolog of SEQ ID NO 150 in the 11/375,241 US patent application
  misc_feature: The sequence is a functional homolog of SEQ ID NO 908 in the 10/666,642 US patent application
MTSAVPRSAKRKRKNLYRGIRLRPWGKWAAEIRDPRKAVRVCVGTFDSPEEDA

SEQ ID NO: 14425 - DNA, 646 bp, Zea mays
  misc_feature: Ceres CLONE 1376024-F
  misc_feature: Encodes the peptide sequence at SEQ ID NO. 14426
  misc_feature (554)..(554): n is a, c, t, g, unknown, or other
  misc_feature (569)..(569): n is a, c, t, g, unknown, or other
aaagctggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcgtctccatcggcgtggagtacatcgtggtcgaggaagatcttcgactcgctgccggcggaggagcagcggctgtggcactcgcacgcgcacaagatcaagtcatggnctgtggacgagacgncacgtgcgcgatctggctggagaaaggcggagctggaccacatgcccgcacggttcgggaaaagtctggtcaaacct

SEQ ID NO: 14426 - protein, 163 aa, Zea mays
  misc_feature: Ceres CLONE 1376024-F
  misc_feature (26)..(154): Pfam Name: DUF1264 Pfam Description: Protein of unknown function (DUF1264)
MASSDGKPLPTPASVGGGGGSSTAPPGQPTTVASKVLDMGAAAMQSLRPVKQAKQHMCTFALYAHDPKRQVETHHYVSRLNQDFLQCAVYDSDKADARLHRRGVHRGRGRSSTRCRRRSSGCGTRTRTRSSHGLWTRRHVRDLAGERRSWTTCPHGSGKVWSN

SEQ ID NO: 14427 - DNA, 603 bp, Zea mays
  misc_feature: Ceres CLONE 1376027-F
  misc_feature: Encodes the peptide sequence at SEQ ID NO. 14428
  misc_feature (556)..(556): n is a, c, t, g, unknown, or other
  misc_feature (570)..(570): n is a, c, t, g, unknown, or other
aagctggagctccccgcggtggcggccgctctagaactagtggatcccccgggctgcaggaattcgcacgagaccattacctagaacatcctaatcgaaaagtcacgcgaccgcttcccacactcccttccccaccagccgaaaccgaggctgacgctgcgcgagccaaccggcggtgatgcaggcggcagtcggacaccgcggcgccaaccttgactccccgtcactctcgcgcttccggtatggcttccgcctccccgggcggacccgcctcttctctgcaggcgtggcggcggcgtcactccgcgtcggctctctgcccagccaggacccatggcagcggcggtttcgcgcacctccgggccatgggtggggaagcgtccaagctgacgacgccctcacgaggatgcttatcgatcatcagaaaatggcatgtccccaccttctggaagctggtggactttccaacatggacttgctttctggacctcctgaagcggcagcggaagatggtggccagcactagttcattgcgccatatgccaattttaatggntgtagcactaatangagctgctggtgccggataatagcacgcccaag

SEQ ID NO: 14428 - protein, 115 aa, Zea mays
  misc_feature: Ceres CLONE 1376027-F
MQAAVGHRGANLDSPSLSRFRYGFRLPGRTRLFSAGVAAASLRVGSLPSQDPWQRRFRAPPGHGWGSVQADDALTRMLIDHQKMACPHLLEAGGLSNMDLLSGPPEAAAEDGGQH

SEQ ID NO: 14429 - DNA, 629 bp, Zea mays
  misc_feature: Ceres CLONE 1376029-F
  misc_feature: Encodes the peptide sequence at SEQ ID NO. 14430
  misc_feature (629)..(629): n is a, c, t, g, unknown, or other
aaagctggagctccccgcggtggcggccgctctagatactagtggatcccccgggctgcaggaattcgcacgagaccattacctagaacatcctaatccaaaaaaacgtcaaaggcacacccaagaagagagatcaactactcatgcaagcactgcgccatttaatttagattcttaggaacaagaacaccaagcaccaactttgtacatattaatggacgccatgcacatggtgatcgatcgacctatatagaaagacaggcggatactacagaagttgtgaggtgtccaaggtacacacgggatgctactaactagctgcaggcaaggtcgaggaatggcaagcctttcatgtgctcggacggacggcgttgtccgttccggcgctctgcccgccaagctgttgctgtgcgccagctgctgcttccctacggcgactccagtcgcggacggagaggtgcaggtgcttgcctgccgtcagcatctccaccgcttggcgaggcgtcaggatctccgtcgccagcgcccgcgccgtcgccatcctcaggtcgtcggcctccaccatcatacgcgacagcgcggccttgtagctgtccagcgcctcgtccacctcggcgtccgcgactccn

SEQ ID NO: 14430 - protein, 108 aa, Zea mays
  misc_feature: Ceres CLONE 1376029-F
MLLTSCRQGRGMASLSCARTDGVVRSGALPAKLLLCASCCFPTATPVADGEVQVLACRQHLHRLARRQDLRRQRPRRRHPQVVGLHHHTRQRGLVAVQRLVHLGVRDS

SEQ ID NO: 14431 - DNA, 645 bp, Zea mays
  misc_feature: Ceres CLONE 1376034-F
  misc_feature: Encodes the peptide sequence at SEQ ID NO. 14432
  misc_feature (487)..(487): n is a, c, t, g, unknown, or other
  misc_feature (536)..(536): n is a, c, t, g, unknown, or other
  misc_feature (542)..(542): n is a, c, t, g, unknown, or other
  misc_feature (585)..(585): n is a, c, t, g, unknown, or other
  misc_feature (600)..(600): n is a, c, t, g, unknown, or other
aagctggagctccccgcggtggcggccgctctagaactagtggatcccccgggctgcaggaattcgcacgagaccattacctagaacatcctaatcgaaaaatcgcttgtttgctgctgccttttcctttccgccgcggcaaaagtgaggagcgcgcgggcgagttgggggagacgaacccgtcataactccttcgcttaatcgcgtctcgtgctcctgcctcctgcgtatataaacgcggcaatcgcgacgcccggggaggcgttcgttctccttctccatcccacgcgcgcgcagtccaaggccggatcggcggcctctcagatctcgccggccgccgtgagacagagaccgaagggggggttgaccggtgctccggaggaagatgtttagcgggacgcagcagaagtgcaaggtgtgcaccaagacggtgtacccgatggaccagctctccaccgacggcgtcgtcttccaccgctcctgcttncagtgccagcactgcaagtctaccctctcactgagcaactattcctcgntcgaangggagtgcgtactgcaagacccatttcgagcagctgttcaggnaagacgggagttacnacaagagcttccaatcacagtcacctgcaaagattactcccggaa

SEQ ID NO: 14432 - protein, 86 aa, Zea mays
  misc_feature: Ceres CLONE 1376034-F
  misc_feature (34)..(34): Xaa is any aa, unknown, or other
  misc_feature (51)..(51): Xaa is any aa, unknown, or other
  misc_feature (53)..(53): Xaa is any aa, unknown, or other
  misc_feature (67)..(67): Xaa is any aa, unknown, or other
  misc_feature (72)..(72): Xaa is any aa, unknown, or other
MFSGTQQKCKVCTKTVYPMDQLSTDGVVFHRSCXQCQHCKSTLSLSNYSSXEXECVLQDPFRAAVQXRRELXQELPITVTCKDYSR

SEQ ID NO: 14433 - DNA, 652 bp, Zea mays
  misc_feature: Ceres CLONE 1376035-F
  misc_feature: Translation starting site: 178
  misc_feature (409)..(409): n is a, c, t, g, unknown, or other
  misc_feature (467)..(467): n is a, c, t, g, unknown, or other
  misc_feature (497)..(497): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (621)..(621): n is a, c, t, g, unknown, or other
  misc_feature (624)..(624): n is a, c, t, g, unknown, or other
aagctggagctccccgcggtggcggccgctctagaactagtggatcccccgggctgcaggaattcgcacgagaccattacctagaacatcctaatcgaaagtgtttctgctgccgtctccaagaccgctgctgctcctattgagcgtgtcaagcttttgattcagaaccaggatgagatgcttaaggctggcaggctctctgagccttacaagggtattggtgactgtttcggcaggaccattaaggatgagggttttggttctttgtggaggggaaacactgctaatgttatccgttacttccccactcaggcgttgaactttgcgttcaaagattacttcaagaggcttttcaacttcaagaaggacagggatggttactgggaagtggtttgctgggaacttgggnatctggaggttgcagctggtgcctcttccccttctcttcgtgtactctcttgactagncacgtacccgtctcgccaatgactccaggntgcaaaaaaagggagnnngaaagcagttccaatggcccctttgtcgatgtctacagaagaccctcaagcttgatggggggaattgctggactcttaccgtggatcacatcccccccccggggtnggnaacatgggggcctaccgtgggctcccat

SEQ ID NO: 14434 - DNA, 752 bp, Zea mays
  misc_feature: Ceres CLONE 1376037-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (405)..(405): n is a, c, t, g, unknown, or other
  misc_feature (406)..(406): n is a, c, t, g, unknown, or other
  misc_feature (414)..(414): n is a, c, t, g, unknown, or other
  misc_feature (429)..(429): n is a, c, t, g, unknown, or other
  misc_feature (434)..(434): n is a, c, t, g, unknown, or other
  misc_feature (437)..(437): n is a, c, t, g, unknown, or other
  misc_feature (438)..(438): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctggggctccccgcggtggcggccgctctagaactagtggatcccccgggctgcaggaattcgcacgagaccattacctagaacatcctaatcgaaaaatacatttcgactctcaactcccaaggtcccctttttttttctcgatctggaagcgccgcagtagcagccatggacgtgagcgnnagcagcgntaaggcgaaaaaggncgcgncgnngcgcaagggccgcggccgagaaaaaagcggggggcccggtccttcaaggccccgggcttgagttccccgtcagccggggtggggggggacctcaaaaaaaggcccggaacccgcaacggggaaaaaaccggggggcccccctttacactcgccgccggtccccggaaaaacccccggggggcggagggggttccaaaatttcccccgaaaaacggggaaagggggaaaaaaaaaaaagggggggttattttcccgggccccacgggggtcctctcccaacccccaaaaaaaaaaaagaaaatcccccaaagatt

SEQ ID NO: 14435 - DNA, 644 bp, Zea mays
  misc_feature: Ceres CLONE 1376040-F
  misc_feature: Encodes the peptide sequence at SEQ ID NO. 14436
  misc_feature (603)..(603): n is a, c, t, g, unknown, or other
  misc_feature (605)..(605): n is a, c, t, g, unknown, or other
aagctggagctccccgcggtggcggccgctctagaactagtggatcccccgggctgcaggaattcgcacgagaccattacctagaacatcctaatcgaaaaatatcatctctgctttgttggtctctttcattcattcataatatttgtgtgttactgagattgtgtgtaatggatactttgggtgtccgacgactcctctgttgctgctgctagcgcctcgctcgagccctccagcgatcttgtccgcgaagatccagcttccaacggtgtacgcgtacgtcatgcgtcataccgtcgagtctactcctcacagcatctggtacggaccagaccgtcccaagtacttaggtccattctcagagaacacgccgtcgtacctagccgccgaataccccggagactacgggtgggacagcgccggtctctccggcgaacctgaagcctttgacaagaaccgtgaagctcagagttatccacagcagatgcgcaatgcgtacgcgctctagatatgcaccttcccagagattctctccaaaaacggagtacaattctctgaaatccgtcgtgggtacaagccaggatctcagagtcttctcagacngnagcactatgactgacctcggtaaactctaagttgctcca

SEQ ID NO: 14436 - protein, 74 aa, Zea mays
  misc_feature: Ceres CLONE 1376040-F
MRHTVESTPHSIWYGPDRPKYLGPFSENTPSYLAAEYPGDYGWDSAGLSGEPEAFDKNREAQSYPQQMRNAYAL

SEQ ID NO: 14437 - DNA, 646 bp, Zea mays
  misc_feature: Ceres CLONE 1376041-F
  misc_feature: Translation starting site: 260
  misc_feature (455)..(455): n is a, c, t, g, unknown, or other
  misc_feature (484)..(484): n is a, c, t, g, unknown, or other
  misc_feature (485)..(485): n is a, c, t, g, unknown, or other
  misc_feature (596)..(596): n is a, c, t, g, unknown, or other
aaagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctggggaagcacgttccccgtgcnaatcttcgttgatctagaacccactgtgnnatcgatgaggtgcgcactggcacgtaccgccagctcttccaccctgagcagctcatcagtgggcaagggaggatgccgctaacattttcgcccgtggcactacacattggnaaggggaagattggtgatctggtgccttgacccgtatcgcaagcttgctg

SEQ ID NO: 14438 - DNA, 622 bp, Zea mays
  misc_feature: Ceres CLONE 1376044-F
  misc_feature: Encodes the peptide sequence at SEQ ID NO. 14439
  misc_feature (441)..(441): n is a, c, t, g, unknown, or other
tccccgcggtggcggccgctctagaactagtggatcccccgggctgcaggaattcgcacgagaccattacctagaacatcctaatcgaaaaattgatccctgaaacccatccacaattggtagctcgttgatccaaatccaagacctcacgtcaacgcactgtctcgcctgttaattagtcgtcgacgtcgtcgtctatgtccaggctgatggctgccatgctgctcgtaggcgcgcgcgtcgccggcgccgcaaagctcaccggtaacggcaacgctgctggcatgcaggctcttcccatgccggcgtgcttccttccgccgcgcccgcagggagcgacctggacccgcctctgcttgcaggctgcgccaagatcgtcccaggtatactacaacgcgccggaagaccggagagaaataggggacaagtacaaggacgcgncggaggaggcgaaggacgccaccggcgacgccaaggagcacgccaagaggatggccggggagacgaaaagcaggtcgcaggacaaggccggccgcgtgccggaccagaagtcgtgcttggccgaccgcccaaggaccagccgatagtcgggcggggaggacccagccaagaccttctccga

SEQ ID NO: 14439 - protein, 129 aa, Zea mays
  misc_feature: Ceres CLONE 1376044-F
  misc_feature (82)..(82): Xaa is any aa, unknown, or other
MSRLMAAMLLVGARVAGAAKLTGNGNAAGMQALPMPACFLPPRPQGATWTRLCLQAAPRSSQVYYNAPEDRREIGDKYKDAXEEAKDATGDAKEHAKRMAGETKSRSQDKAGRVPDQKSCLADRPRTSR

SEQ ID NO: 14440 - DNA, 662 bp, Zea mays
  misc_feature: Ceres CLONE 1376046-F
  misc_feature: Translation starting site: 169
  misc_feature (321)..(321): n is a, c, t, g, unknown, or other
  misc_feature (505)..(505): n is a, c, t, g, unknown, or other
aaagctggagctccccgcggtggcggccgctctagaactagtggatcccccgggctgcaggaattcgcacgagaccattacctagaacatccaatcgaaaaaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctacccgccgccggtgcatctgcccacctccggttcacctggccaccntccggtgctctcccccaccgccggtccactggggcggccgccggtccactggggcaccggcccggtccatgggcccccccgccccggtttctttttgccggccgcccaccatgcccactaaccctactcaacccgcccccgggcctcagccctcatccccagccacacccccatggcccgtggncaacagccgcatcccaagcccgtggcaaagctgcagggaaacccgggggggggggttgcaaagaaccccgatcctggggccgaggggggcgccaggtcccgggaggaatcaggggaaaccccgaacggcgacgccctatggctcggccagggggccg

SEQ ID NO: 14441 - DNA, 626 bp, Zea mays
  misc_feature: Ceres CLONE 1376055-F
  misc_feature (263)..(263): n is a, c, t, g, unknown, or other
  misc_feature (281)..(281): n is a, c, t, g, unknown, or other
  misc_feature (285)..(285): n is a, c, t, g, unknown, or other
  misc_feature (315)..(315): n is a, c, t, g, unknown, or other
  misc_feature (322)..(322): n is a, c, t, g, unknown, or other
  misc_feature (368)..(368): n is a, c, t, g, unknown, or other
aaagctggagctccccgcggtggcggccgctctagaactagtggatcccccgggctgcaggaattcgcacgagaccattacctagaacatcctaatcgaaaaaatcgaaaaccatcaccaccactgggtcttcagaccattagctttatctactccagagcgcagaagaacccgatcgacaccatgagggtggtgctcgttgccctcgctctcctggctctcgctgcgagcgccacctccacgcataccagcgggcggctgcngctgccagcacccggcgncggntcattaaccggcggcggtgcatctggcaancttcggntcactggccaactcgggtgattccccaacgcccggtcactgtgcgnccggcccgtccactgtccaacggcgggttcatgggccccccccccgggttctttggtggggggccccatgtgattaacctaaattaaccggcccggggcttaagcttattcccaggccaaccattgggcggggcaaaaggccgatttaaggcccggcccaggtgggaggaaattgggggggttgggaacaccccgattctgggggcaagggggctaaagtttttttaagattatagtggaacccgaaagggaaccccc

SEQ ID NO: 14442 - DNA, 635 bp, Zea mays
  misc_feature: Ceres CLONE 1376056-F
  misc_feature: Pfam Name: Aminotran_1_2 Pfam Description: Aminotransferase class I and II
  misc_feature: SWISSPROT Homolog: EC 2.6.1.1 Aspartate transaminase
  misc_feature (288)..(288): n is a, c, t, g, unknown, or other
  misc_feature (428)..(428): n is a, c, t, g, unknown, or other
  misc_feature (459)..(459): n is a, c, t, g, unknown, or other
  misc_feature (480)..(480): n is a, c, t, g, unknown, or other
  misc_feature (483)..(483): n is a, c, t, g, unknown, or other
  misc_feature (507)..(507): n is a, c, t, g, unknown, or other
aaagctggagctccccgcggtggcggccgctctagaactagtggatcccccgggctgcaggaattcgcacgagaccattacctagaacatcctaatcgaaaaacgaagagcagcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaagtcaacctcggggtcggcgccaccggnaccgaggaagggaagcccctagtgctgaacgtggtcaggcgcgccgagcaaatgttgatcaataatccgtcacgtgtcaaggagtacctaccaatcaccgggtctggctgaattcaataagctgagcgctaagcttatcntttggcgctgacagccctgctattcaggagnaatagggttgctaccgtgagnggnctattcggggtactggttctttangaagtcgggaggtggaatttcttgcaaggcactatcacgagcgcactatctacatcccacaaccaacctggggaaatcacccaaaagtcttcaccctatctgggcttgaacgttaggagctaccgcta

SEQ ID NO: 14443 - DNA, 654 bp, Zea mays
  misc_feature: Ceres CLONE 1376067-F
  misc_feature: Encodes the peptide sequence at SEQ ID NO. 14444
  misc_feature (565)..(565): n is a, c, t, g, unknown, or other
  misc_feature (608)..(608): n is a, c, t, g, unknown, or other
  misc_feature (643)..(643): n is a, c, t, g, unknown, or other
  misc_feature (644)..(644): n is a, c, t, g, unknown, or other
aaagctggagctccccgcggtggcggccgctctagaactagtggatcccccgggctgcaggaattcgcacgagaccattacctagaacatcctaatcgaaaaaggttaaagcgacgccgccgccgcaagccgtccgccttgcccttcacgaaggcttggtcctcctccttgtatctccactccccccttcacagatccgttcctccagctagggttagcgttcctctgcagcgatggcgatcaagcggactaaggcggagaagaagatcgcgtacgacaagaagctgtgcagcctgctcgatgagtacaccaaggtgctcatcgccctggccgacaacgtcggttccaagcagctccaggacatccgccggggcctcaggggcgactcggtggtgcttcatggggaagaacacgctcatcaggcgttgcatcaaggtgaacgccgagaagaccggtaaccacacctttgacccgctcatggaccctcctggtcgggcaacgtaggcctcatcttcaccaaggagacccctcaaggaggggcccccgaggaggtcccaagtaaacnaaggtggggctcctggcttccgggttgggctggttgctccaanttgggatgttgttgtgccccctggcaaaacctggnnctggaatccg

SEQ ID NO: 14444 - protein, 74 aa, Zea mays
  misc_feature: Ceres CLONE 1376067-F
  misc_feature (6)..(75): Pfam Name: Ribosomal_L10 Pfam Description: Ribosomal protein L10
  misc_feature: SWISSPROT Homolog: EC 4.2.99.18 DNA-(apurinic or apyrimidinic site) lyase
MAIKRTKAEKKIAYDKKLCSLLDEYTKVLIALADNVGSKQLQDIRRGLRGDSVVLHGEEHAHQALHQGERREDR

SEQ ID NO: 14445 - DNA, 650 bp, Zea mays
  misc_feature: Ceres CLONE 1376072-F
  misc_feature: Encodes the peptide sequence at SEQ ID NO. 14446
  misc_feature (422)..(422): n is a, c, t, g, unknown, or other
  misc_feature (487)..(487): n is a, c, t, g, unknown, or other
  misc_feature (535)..(535): n is a, c, t, g, unknown, or other
  misc_feature (581)..(581): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (619)..(619): n is a, c, t, g, unknown, or other
  misc_feature (634)..(634): n is a, c, t, g, unknown, or other
  misc_feature (641)..(641): n is a, c, t, g, unknown, or other
aaagctggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcgncaccagcaagctgacgcgggcgaggacggcgacagcggcgtggacgcctacgtctcccgctcggnaagggggcgagtgccggcgccagtgcctgcgccgccacgagggccagnccgtggaggaccccagagtggcatgagccggtgccgccgccgccgnactggccgtcgacatggaannnaagagtacggtcgcgncagcgagagcgcggncaaggtnccgggaaaa

SEQ ID NO: 14446 - protein, 146 aa, Zea mays
  misc_feature: Ceres CLONE 1376072-F
  misc_feature (92)..(92): Xaa is any aa, unknown, or other
  misc_feature (108)..(108): Xaa is any aa, unknown, or other
  misc_feature (130)..(130): Xaa is any aa, unknown, or other
  misc_feature (131)..(131): Xaa is any aa, unknown, or other
  misc_feature (136)..(136): Xaa is any aa, unknown, or other
  misc_feature (141)..(141): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSXRGRVPAPVPAPPRGPXRGGPQSGMSRCRRRRTGRRHGXXEYGRXSESAXKVPGK

SEQ ID NO: 14447 - DNA, 668 bp, Zea mays
  misc_feature: Ceres CLONE 1376074-F
  misc_feature: Encodes the peptide sequence at SEQ ID NO. 14448
  misc_feature (532)..(532): n is a, c, t, g, unknown, or other
  misc_feature (540)..(540): n is a, c, t, g, unknown, or other
  misc_feature (541)..(541): n is a, c, t, g, unknown, or other
aagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcaaccactaaccccggggcgtggcggaaaaggggcgcgacgtcacttttcccctggtgtccgcacctgggccccccccngggggggnnccccccccccctcccaaaagggggggggggggggggcacccacggtggcgcggccctgggggcccacggaccgggcctgggcccaccaaagcgcccgggggtcggtccgctttcatccggcctggga

SEQ ID NO: 14448 - protein, 108 aa, Zea mays
  misc_feature: Ceres CLONE 1376074-F
  misc_feature (64)..(64): Xaa is any aa, unknown, or other
  misc_feature (67)..(67): Xaa is any aa, unknown, or other
MAGIGRNMVAPLLVLNLIMYIIVIGFASWNLNHFINGQPLTPGRGGKGARRHFSPGVRTWAPPXGGXPPPSQKGGGGGAPTVARPWGPTDRAWAHQSARGSVRFHPAW

SEQ ID NO: 14449 - DNA, 633 bp, Zea mays
  misc_feature: Ceres CLONE 1376075-F
  misc_feature: Encodes the peptide sequence at SEQ ID NO. 14450
  misc_feature (287)..(287): n is a, c, t, g, unknown, or other
  misc_feature (306)..(306): n is a, c, t, g, unknown, or other
  misc_feature (307)..(307): n is a, c, t, g, unknown, or other
  misc_feature (384)..(384): n is a, c, t, g, unknown, or other
  misc_feature (469)..(469): n is a, c, t, g, unknown, or other
  misc_feature (499)..(499): n is a, c, t, g, unknown, or other
  misc_feature (500)..(500): n is a, c, t, g, unknown, or other
aaagctggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcgggcctgcagggctggtacggcgctggcgccggctgcanaccatgatggggccgccgnncggctgaccccctacgcggagtacctgaggcagccgcagggcagcccggctggcggcggcgcctactacaggccggntggtggccagccgagcgccatgttccagccgctccggcaacagtgctgccagcagcagatggagattgatggaacgtgcagtccngtcgcgcagcagctgcagatgatgatgcanncttgagcgtgccgctgccgccagcagcagcctgtacgagccagctctgatgcagcagcagcagcagctgctggccagcccagggtctcaacccctggggccatgattgatggcgcagaacaggcgggcccatg

SEQ ID NO: 14450 - protein, 42 aa, Zea mays
  misc_feature: Ceres CLONE 1376075-F
  misc_feature (41)..(41): Xaa is any aa, unknown, or other
MKMVIVLVVCLALSAASASAMQMPCPCAGLQGWYGAGAGCXP

SEQ ID NO: 14451 - DNA, 631 bp, Zea mays
  misc_feature: Ceres CLONE 1376079-F
  misc_feature: Encodes the peptide sequence at SEQ ID NO. 14452
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
tggagctccccgcggtggcggccgctctagaactagtggatcccccgggctgcaggaattcgcacgagaccattacctagaacatcctaatcgaaaaccatccatccatccagttagttagttagtaagttagttgagggagaagaagcaggggaggggaagcgatgagcaacatgctgcgggctcgccgccgcctggacctcctgcaggtggtgctcttcgccgctgtgctcctcgtcgtcgtcgccgacgccggcgtgacgagccagtaccggcggaagctggaggcgacggtggagatgccactggacgccgacgtcttccgcgtcccgccgnnngtacatgccccgcagcaggtgcacatcacgctgggtgaccaggagggcacggcgatgatcgtgtcgggggtgacggccaatgacctgggcaccagccccgtcctgtacgggaggggtcccccgaacccgagaaaaaaggactccggggggaggggaccccacgggggtaaaaaaatttaaaaaaacccccggttttttccccccggggcccctccaaaacccggggattacccccagaacctcccccccggggggccccccccccaggggggatttttttttttccccccccc

SEQ ID NO: 14452 - protein, 117 aa, Zea mays
  misc_feature: Ceres CLONE 1376079-F
  misc_feature: SWISSPROT Homolog: EC 3.1.3.2 Acid phosphatase
  misc_feature (58)..(58): Xaa is any aa, unknown, or other
MSNMLRARRRLDLLQVVLFAAVLLVVVADAGVTSQYRRKLEATVEMPLDADVFRVPPXVHAPQQVHITLGDQEGTAMIVSGVTANDLGTSPVLYGRGPPNPRKKDSGGRGPHGGKKI

SEQ ID NO: 14453 - DNA, 636 bp, Zea mays
  misc_feature: Ceres CLONE 1376080-F
  misc_feature (489)..(489): n is a, c, t, g, unknown, or other
  misc_feature (608)..(608): n is a, c, t, g, unknown, or other
  misc_feature (636)..(636): n is a, c, t, g, unknown, or other
aagctggagctccccgcggtggcggccgctctagaactagtggatcccccgggctgcaggaattcgcacgagaccattacctagaacatcctaatcgaaaaatccgattcactccaatacagattcatcgccttaaacccctctttaaatccattaactacgatctacccttcaattcgagtttctcatctgcaaggcggtctatctgcgattagccttcctccaataaaattcatcttcccagttcgttaaaacaacaaagtaaatttatttaccgacaaatggctgatttcaaagttcttctttctgatttgaagtcaatcgcggttgggaacttatatgctcttactagatgcaaagttgctttgttgatgacatagaagaaaagaagggagggagcagaaggagagtattgttaatggtatcagagagactgtcaaaaatataactctgtccatgtttctcttttgaaaacatgaaaaatatcanattcaaggagtttagacaacagtttagacacaacgaaaggttcttcctcggctagaacaaattgatgcagtttgctcttggtccttctgcttgggatgaaatccatcctgccatctttnaagcttcaagattcttcatggtgagatn

SEQ ID NO: 14454 - DNA, 604 bp, Zea mays
  misc_feature: Ceres CLONE 1376083-F
  misc_feature: Translation starting site: 165
  misc_feature (409)..(409): n is a, c, t, g, unknown, or other
  misc_feature (422)..(422): n is a, c, t, g, unknown, or other
aagctggagctccccgcggtggcggccgctctagaactagtggatcccccgggctgcaggaattcgcacgagaccattacctagaacatcctaatcgaaaatcacccacctccgccagccactccaaacacttgcgccgccactgcctcacaggtaaggccgccatgggtctccggttcgggcgtgtgcgcgaagcgcatcgtggtggacgcgcgccaccacatgctgggccgtctctcctcgatcatagccaaggagctgctcaatgggcagaaggtggtcgtcgtccgctgcgaggagatctgcatgtcgggcggcctcgtccgtcagaagatgaagtacctccgcttcccctcgcagcggatgaacacaagccgtcccacgggcccatccacttccgcgcccccgncaagatcctgtgncgcaccatccgcgggatgattccgcacaagaccaagaggggggagggcgctctggcgaggctcaagacgtacgagggcgtcccgccgccgtacgacaagaccaagcgtatggtcatccctgacgctcttaagggtctgaagctacaggcctggacacaagtactgcctcctcggggagtctc

SEQ ID NO: 14455 - DNA, 886 bp, Zea mays
  misc_feature: Ceres CLONE 1376094-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (46)..(46): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
nnnnnnnnnnnnnnnnnnnnnnnnnnnnaaaaggcgagcacctttntttnnnnccaattgagtaccgggccccccctcgaggtcgacggtatcgataagcttttttttttttttttttaattaaaaagtgtttttacttgcagtcatcaaaaccacaactgtaacttgcataaaacaatctcccaacgaaaatgagaaaaaattactctagatgatacgaatagaaacgacctataactccacttcaatccatgcacttcatgctgtctaagcaacaagcgtggagggagaagtatactcgtacttcctgaatggatgaagcttcttggtgcttcttgtttttgcaagcctggacggtggatcctgctctcgacgatgaatcaacctgattttagaatccttgtctatgtggttcctttcgcgatgcttgtggatggaaaccccccttcttgatcgaatgtgtaaaatggttcgagaacccccccctctcccaccgtggagtttttgtgaatacgcatagattttgcttttcaagcaaccgttaatagaacctgaaggaaataccggtaaaaaatccgcgggagaaaagcacaagcatatgctggttgtgtggagaataaaaccacgtaaagtttggaaaaccttggaagggttgaagttcattcaacactcttacgttgggtttgattttttgatagtcctgttcgcagacgttaaatcctctttaactttggggtgataaccatgtccgggtaactctcgctttttgcttttagaaaagtcctttaagctcgccagtagtttgaccctctaataatttttatttttaatgacccatcaataataaaccgaaattttttatctccccatttttaaccgacgtgta

SEQ ID NO: 14456 - DNA, 643 bp, Zea mays
  misc_feature: Ceres CLONE 1376096-F
  misc_feature: Encodes the peptide sequence at SEQ ID NO. 14457
  misc_feature (356)..(356): n is a, c, t, g, unknown, or other
  misc_feature (388)..(388): n is a, c, t, g, unknown, or other
  misc_feature (411)..(411): n is a, c, t, g, unknown, or other
  misc_feature (450)..(450): n is a, c, t, g, unknown, or other
tggagctccccgcggtggcggccgctctagaactagtggatcccccgggctgcaggaattcgcacgagaccattacctagaacatcctaatcgaaaaattcccctcccgaagtcccgatcctgtcctcaaatcccattgctctatcttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtcccggaagaaaccctaatcctagcgctcatncagcagatggtcggcgccggcgcggagaaggntaagctggagaaacagacatggnaaatcgatactggaaacagggacattgagatagaatggncgatgttgtcaagtgctcaccatgtggagatgacccccagtgatgctggctttcaggacaggtatgtttgtcaggaggtcatcaaagagatggcgaagaacagggccattgatgcccaaggcagagagcatttaaagtcttgtggttaatgaggtcgacaagctctcacgagaagcccagcattccctcgcag

SEQ ID NO: 14457 - protein, 49 aa, Zea mays
  misc_feature: Ceres CLONE 1376096-F
MLWVDKYRPKTLDKVTVHDQVAQNLRKFVSEQDCPHLLFYGPSGSRKKP

SEQ ID NO: 14458 - DNA, 597 bp, Zea mays
  misc_feature: Ceres CLONE 1376100-F
  misc_feature (179)..(179): n is a, c, t, g, unknown, or other
  misc_feature (182)..(182): n is a, c, t, g, unknown, or other
  misc_feature (183)..(183): n is a, c, t, g, unknown, or other
  misc_feature (208)..(208): n is a, c, t, g, unknown, or other
  misc_feature (214)..(214): n is a, c, t, g, unknown, or other
aaagctggagctccccgcggtggcggccgctctagaatagtggatcccccgggctgcaggaattcgcacgagaccattacctagaacatcctaatcaaaagaagagaggatgaaagacagagccagtcacaaggcgatagcagcaggtggtggcaagaatgacgtgctcacttctccgntgnnagtagagcatcgtgacctccttggngctttnctcatcctaagcaggttccatggggtccttcctcaacgagggccagaaaaacaagtggaagtggcaatcaaacttgggccccaaaaaatgcaggtgaaaattgaaacccggtttgaaaaacccggggttaagagggcaacccccaggggggccccccccaacggggatgggaattgttcccgggaaaaggggggttaaaaaaaaaggggcccccccttttttaaggggggcaaaaggggtcttttttttttccccagggggggtgtggggaaaatttgtgggaaagaagggtgttttccacccccgtgggggggggccccttttgtggggtggggggcccccccccaaaatttttgtcgccccacccgttgttaaaaaaaaaa

SEQ ID NO: 14459 - DNA, 656 bp, Zea mays
  misc_feature: Ceres CLONE 1376107-F
  misc_feature (454)..(454): n is a, c, t, g, unknown, or other
  misc_feature (483)..(483): n is a, c, t, g, unknown, or other
aaagctggagctccccgcggtggcggccgctctagaactagtggatcccccgggctgcaggaattcgcacgagaccattacctagaacatcctaatcgaaaaatatctcacaacattactacctcctacctccacgagaaggaggaatacctgaacgactgatgatggacgatgataccgtgcatcgtataggctgctcgtcctctctaccccgcgctgcgtactccgaccatcgtcgctgacggtgcagaagcctctataacttcccttctgtccatacatacctctcgccaccaccgtctatggcaagtaaaaacgagattctgcactcctaggggaatgaacagatgatctgagcacgcatcgtatctatatgacccatgatcctccgactcccttgatgcctattacagatgatacccgtggtgcatttgctgtaacaatacatcagggntacaacaactactacaacttgcgctacancagcttgattggctagtctcagcaagagacgtttcttccattcaagcaactggctgcattggaagtctgctgcttatttgaagcaacctactacgattcatgccaactagctgttgtctaccccgcagcaatttcttccattcaccaactagcagattttgaaactctgctgc

SEQ ID NO: 14460 - DNA, 615 bp, Zea mays
  misc_feature: Ceres CLONE 1376120-F
  misc_feature: Encodes the peptide sequence at SEQ ID NO. 14461
  misc_feature (417)..(417): n is a, c, t, g, unknown, or other
  misc_feature (419)..(419): n is a, c, t, g, unknown, or other
  misc_feature (420)..(420): n is a, c, t, g, unknown, or other
  misc_feature (430)..(430): n is a, c, t, g, unknown, or other
  misc_feature (436)..(436): n is a, c, t, g, unknown, or other
  misc_feature (462)..(462): n is a, c, t, g, unknown, or other
  misc_feature (464)..(464): n is a, c, t, g, unknown, or other
  misc_feature (495)..(495): n is a, c, t, g, unknown, or other
  misc_feature (513)..(513): n is a, c, t, g, unknown, or other
  misc_feature (538)..(538): n is a, c, t, g, unknown, or other
  misc_feature (565)..(565): n is a, c, t, g, unknown, or other
  misc_feature (582)..(582): n is a, c, t, g, unknown, or other
aaagctggagctccccgcggtggcggccgctctagaactagtggatcccccgggctgcaggaattcgcacgagaccattacctagaacatcctaatcgaaaaaatttgcttccggctgccgctcttctccgccgccgccccgatccccttcctccccaagcccttcaactatccactcccgcgtccccggagaagcggcgagatgtacggcatcctgacctccccctgccctcgagccccgcttctccgcgctctcccgagcccatccgcccgcgcattccccagaacactagccttccccgcgaggcccctcccccgcggtctccgcctggaccctccgcacgccgccgcggaggcatcggcggcagccacggcgttgggcgggcttctggcgtcgccgctctcgactctggaggncnngcctgcgggnctcaanctcgcgcccctttcgcgccccgtggngncggcgatgtcggcggccgtgcggtggctggnagtgtaccgggagtgtgncttcggcgcgtgctgctctcctggntccccacatcccctgggacgccagccnttctcgggcctgcgcgnactctgcgacccttcctcgcctgggggccgtgg

SEQ ID NO: 14461 - protein, 137 aa, Zea mays
  misc_feature: Ceres CLONE 1376120-F
  misc_feature (72)..(72): Xaa is any aa, unknown, or other
  misc_feature (73)..(73): Xaa is any aa, unknown, or other
  misc_feature (78)..(78): Xaa is any aa, unknown, or other
  misc_feature (87)..(87): Xaa is any aa, unknown, or other
  misc_feature (88)..(88): Xaa is any aa, unknown, or other
  misc_feature (98)..(98): Xaa is any aa, unknown, or other
  misc_feature (104)..(104): Xaa is any aa, unknown, or other
  misc_feature (127)..(127): Xaa is any aa, unknown, or other
MYGILTSPCPRAPLLRALPSPSARAFPRTLAFPARPLPRGLRLDPPHAAAEASAAATALGGLLASPLSTLEXXPAGLXLAPLSRPVXXAMSAAVRWLXVYRECXFGACCSPGSPHPLGRQPFSGLRXLCDPSSPGGR

SEQ ID NO: 14462 - DNA, 719 bp, Zea mays
  misc_feature: Ceres CLONE 1376122-F
  misc_feature: Encodes the peptide sequence at SEQ ID NO. 14463
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (369)..(369): n is a, c, t, g, unknown, or other
  misc_feature (375)..(375): n is a, c, t, g, unknown, or other
  misc_feature (378)..(378): n is a, c, t, g, unknown, or other
  misc_feature (381)..(381): n is a, c, t, g, unknown, or other
  misc_feature (395)..(395): n is a, c, t, g, unknown, or other
  misc_feature (396)..(396): n is a, c, t, g, unknown, or other
  misc_feature (436)..(436): n is a, c, t, g, unknown, or other
  misc_feature (478)..(478): n is a, c, t, g, unknown, or other
  misc_feature (513)..(513): n is a, c, t, g, unknown, or other
  misc_feature (534)..(534): n is a, c, t, g, unknown, or other
  misc_feature (544)..(544): n is a, c, t, g, unknown, or other
  misc_feature (678)..(678): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaagctggggctccccgcggtggcggccgctctagaactagtggatcccccgggctgcaggaattcgcacgagaccattacctagaacatcctaatcgaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacggncagcancancancagggaggaagcgnncgcccgatgggtgagcaggtgaagggcatgctccacgacnaggggccgacggcgtcgcaggcgctgacggtggtgacgctgntcccgctgggcggctgctgctggtgctgtccgggncttggcgctgacggctccgcngggggggggnttgggcggggcccccccccgggggttcccggttttttcggccccggggtttggccccggccgcgctgttcattggggacgcccggcctttggggggttcccccacgtcggggggggtgggggggtctctggggnccttttccccccctttcggggggccccgcccaccggggggg

SEQ ID NO: 14463 - protein, 134 aa, Zea mays
  misc_feature: Ceres CLONE 1376122-F
  misc_feature (20)..(20): Xaa is any aa, unknown, or other
  misc_feature (21)..(21): Xaa is any aa, unknown, or other
  misc_feature (22)..(22): Xaa is any aa, unknown, or other
  misc_feature (27)..(27): Xaa is any aa, unknown, or other
  misc_feature (41)..(41): Xaa is any aa, unknown, or other
  misc_feature (55)..(55): Xaa is any aa, unknown, or other
  misc_feature (77)..(77): Xaa is any aa, unknown, or other
MADRDRSGIYGGAHATYGQXXXQGGSXRPMGEQVKGMLHDXGPTASQALTVVTLXPLGGCCWCCPGLGADGSAGGGXGRGPPPGVPGFFGPGVWPRPRCSLGTPGLWGVPPRRGGWGGLWGPFPPLSGGPAHRG

SEQ ID NO: 14464 - DNA, 624 bp, Zea mays
  misc_feature: Ceres CLONE 1376128-F
  misc_feature: SWISSPROT Homolog: EC 4.1.1.33 Diphosphomevalonate decarboxylase
  misc_feature (247)..(247): n is a, c, t, g, unknown, or other
  misc_feature (251)..(251): n is a, c, t, g, unknown, or other
  misc_feature (262)..(262): n is a, c, t, g, unknown, or other
  misc_feature (435)..(435): n is a, c, t, g, unknown, or other
  misc_feature (438)..(438): n is a, c, t, g, unknown, or other
  misc_feature (441)..(441): n is a, c, t, g, unknown, or other
  misc_feature (498)..(498): n is a, c, t, g, unknown, or other
  misc_feature (538)..(538): n is a, c, t, g, unknown, or other
ggagctccccgcggtggcggccgctctagaactagtggatcccccgggctgcaggaattcgcacgagaccattacctagaacatcctaatcgaaaaaatccatttacctgtccaccaaaccagtctgtagtgttttttccctccctaatgaacagaccacggaggtgacgaagcagcggtagagacaaattagcgagcagagaaggggtactggcgatgacacaccttgccattgagccacatgcgntcgnaagggaatgangggctgacggcgaccgtggtggtggcgcaaagattgtccgggtcgagcgttacgctgatgctgtcgttgatggggaagatgagcgcctcgtcccgcttcccccagtacttgatcaccgcaatgggtggttcgcgtcccgcccccgttggcatgaggacccaatgccccttcgncgncgncatttggatctctccgcttcgcgctgctctatgccccgataattcttgccaaagggnaagttagtaagcataatccctactactctataagcacggnggtgtaggcgttgcacaccgttgcgccatcgttctggcagcctcccgatgctcccctggcaaggatccgtctcacactttttgtcg

SEQ ID NO: 14465 - DNA, 639 bp, Zea mays
  misc_feature: Ceres CLONE 1376142-F
  misc_feature: Encodes the peptide sequence at SEQ ID NO. 14466
  misc_feature (428)..(428): n is a, c, t, g, unknown, or other
  misc_feature (429)..(429): n is a, c, t, g, unknown, or other
  misc_feature (577)..(577): n is a, c, t, g, unknown, or other
aagctggagctcaccgcggtggcggccgctctagaactagtggatcccccgggctgcaggaattcgcacgagaccattacctagaacatcctaatcgaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcggaggcatgaacggcaaggagctggacggnncgcacatcaccgtcaacggagcccagtcccgcggcggacgtgggaggcggcggcggtggttacggtggtggcccgtgtagggcgcggctacggcggtggcgggcgccgtgatggcggtggccggctacggcgttggccgccgctaccngtgccggcggcgtctaacggggtgttggcggcggctaccgcggtggaaaaccgtgtcggggt

SEQ ID NO: 14466 - protein, 102 aa, Zea mays
  misc_feature: Ceres CLONE 1376142-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (77)..(77): Xaa is any aa, unknown, or other
MAASDVEYRCFVGGLAWATDDHSLHNAFSTYGEVLESKIILDRETQRSRGFGFVTFSTEEAMRNAIGGMNGKELDGXHITVNGAQSRGGRGRRRRWLRWWPV

SEQ ID NO: 14467 - DNA, 643 bp, Zea mays
  misc_feature: Ceres CLONE 1376144-F
  misc_feature: Encodes the peptide sequence at SEQ ID NO. 14468
  misc_feature (612)..(612): n is a, c, t, g, unknown, or other
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagatattngcactggtctccagggcttcctcgtcttcan

SEQ ID NO: 14468 - protein, 138 aa, Zea mays
  misc_feature: Ceres CLONE 1376144-F
  misc_feature (49)..(138): Pfam Name: Tubulin Pfam Description: Tubulin/FtsZ family, GTPase domain
  misc_feature (129)..(129): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADIXTGLQGFLVF

SEQ ID NO: 14469 - DNA, 619 bp, Zea mays
  misc_feature: Ceres CLONE 1376145-F
  misc_feature (579)..(579): n is a, c, t, g, unknown, or other
  misc_feature (619)..(619): n is a, c, t, g, unknown, or other
aagctggagctccccgcggtggcggccgctctataactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggcgccgccgctcctggtgctcaacctcatcatgtacatcatcgtcatcggcttcgcgagctgaacctgaaacacttcatcaacgggcagaccaactaccccggcgtggccggaaacggcgcgaccgtctacttcctggtgttccccctcctgccccgcggggtggccccgtcctcccaacctggcgggcgggcacccccgtgcgcgcctgggngccacgaaaggcctgggccaccaacgcccgggtcgtcccn

SEQ ID NO: 14470 - DNA, 638 bp, Zea mays
  misc_feature: Ceres CLONE 1376151-R
  misc_feature: SWISSPROT Homolog: EC 2.1.1.41 Sterol 24-C-methyltransferase
ccgggccccccctcgaggtcgacggtatcgataagcttttttttttttttttttaactaaatagaaaattatctcaatggatgatcatatataggttctgcttggctttcggctaaccccatcacaacttgactaaggttagtcggcgaaattgaaaaaacaactttagacagaaaaaagttaaccaaactgtgggcatcgaaccaaacaggctcatagtcttacaattgcacgggtgattatccgtcctgggcgtgtgcattggaagttagcccatgaaaagtagttaggatccatcgtctggtaccatgggcaaggaaaatcttgagcaagatcctttgcaaaaatgacctcgaatcctgcatctttcatagcttggacacactggcgagtggtacggatgtcaggcaggccatcgccaagctcaatctcagccttggcggtcaaatgcttagcgttgttgggatcaaatcggtcagtcaggcaccattcatccagtgcaaaatactgcccaggtttcagcacacggtagacctcactatagacaccttgtgcctctggtgcgtaacatgtagcctgtattgcataggccgcatcaaaggtgttatcagctattggcatattcatgaagtccccct

SEQ ID NO: 14471 - DNA, 658 bp, Zea mays
  misc_feature: Ceres CLONE 1376156-F
  misc_feature: Encodes the peptide sequence at SEQ ID NO. 14472
  misc_feature (197)..(197): n is a, c, t, g, unknown, or other
  misc_feature (200)..(200): n is a, c, t, g, unknown, or other
  misc_feature (221)..(221): n is a, c, t, g, unknown, or other
  misc_feature (229)..(229): n is a, c, t, g, unknown, or other
  misc_feature (237)..(237): n is a, c, t, g, unknown, or other
  misc_feature (313)..(313): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (400)..(400): n is a, c, t, g, unknown, or other
  misc_feature (412)..(412): n is a, c, t, g, unknown, or other
  misc_feature (420)..(420): n is a, c, t, g, unknown, or other
aatctggagctccccgcggtggcggccgctctagactcgagcatcccccgggctgcaggaattctcacgagaccattacctagaacatcctaatcgaaaacatttttggtcttgctcttggatacaagtcggttatcatcccgattttcgctattgctgttagcatctatgtcagtttctccattggtgcgatgtanggnattggagttgccgctcttggnatgctgancacaatcncaactggtcttgctattgatgcttatgggcccatcagtgacaatgctggtggtattgctgagatggctggaatganccacataatccgtgagagaactgatgctcttgatgctgctggtttttccccccccccccaggggaagaaagggggccattnnntccncctgctcttgtngccctggngctttttggggcccttggcagcagagctgggagggaaggcctcccacctccccctcccccacggcttttcattgggttgaatggggggaaccctgccttccccccggggcccccggcatggaccctgaaaaagggtgcggaaccgcccccccggaaaaaggggggagcgcgccccccaccccccttaccaccccacttcccgggggttgtatggtcgggcaaccccccaagcccgacc

SEQ ID NO: 14472 - protein, 102 aa, Zea mays
  misc_feature: Ceres CLONE 1376156-F
  misc_feature: SWISSPROT Homolog: EC 3.6.1.1 Inorganic diphosphatase
  misc_feature (2)..(2): Xaa is any aa, unknown, or other
  misc_feature (13)..(13): Xaa is any aa, unknown, or other
  misc_feature (16)..(16): Xaa is any aa, unknown, or other
  misc_feature (41)..(41): Xaa is any aa, unknown, or other
  misc_feature (68)..(68): Xaa is any aa, unknown, or other
  misc_feature (69)..(69): Xaa is any aa, unknown, or other
  misc_feature (70)..(70): Xaa is any aa, unknown, or other
  misc_feature (74)..(74): Xaa is any aa, unknown, or other
  misc_feature (77)..(77): Xaa is any aa, unknown, or other
MXGIGVAALGMLXTIXTGLAIDAYGPISDNAGGIAEMAGMXHIIRERTDALDAAGFSPPPQGKKGGHXXXLLLXPWXFLGPLAAELGGKASHLPLPHGFSLG

SEQ ID NO: 14473 - DNA, 633 bp, Zea mays
  misc_feature: Ceres CLONE 1376166-F
  misc_feature: Encodes the peptide sequence at SEQ ID NO. 14474
  misc_feature (566)..(566): n is a, c, t, g, unknown, or other
aaagctggagctccccgcggtggcggccgctctagtctagtggatcccccgggctgcaggaattcgcacgagaccattacctagaacatcctaatcgaaaagccacgcgacaaccgacaatccttcgcagtcccgcaccgcaccgccgcaccgcaccaccgcaccgcggccaaggccaatagcctcgcctagcgctcactcgctcgccccactaccaccgcaccacgcgctcccgtttccgccgatccgagcgcgcagatcgcggaagcccagcggctcagagtccagggggagggagctcgcggcggctgaggaaggcgttcaccaccgtcgcggatttcattgaggaagagatggggctctcctttgcgaagctgttcagccgcctcttcgccaagaaggagatgaggattctcatggtcgggctcgatgccgccggtaagaccaccatcctctataagctcaagctcggcgagatcgtcaccaccatcccccacattggattcaatgttgaaactggtgagtacaagaacattagcttcaccgtttgggatgttggtgggcangacaagatcaggccccctgtgaggcactactttcagaacacgcagggacttatttttgttgtagaca

SEQ ID NO: 14474 - protein, 93 aa, Zea mays
  misc_feature: Ceres CLONE 1376166-F
  misc_feature (1)..(93): Pfam Name: Arf Pfam Description: ADP-ribosylation factor family
  misc_feature (71)..(71): Xaa is any aa, unknown, or other
MGLSFAKLFSRLFAKKEMRILMVGLDAAGKTTILYKLKLGEIVTTIPHIGFNVETGEYKNISFTVWDVGGXDKIRPPVRHYFQNTQGLIFVVD

SEQ ID NO: 14475 - DNA, 653 bp, Zea mays
  misc_feature: Ceres CLONE 1376174-F
  misc_feature: Encodes the peptide sequence at SEQ ID NO. 14476
  misc_feature (403)..(403): n is a, c, t, g, unknown, or other
  misc_feature (404)..(404): n is a, c, t, g, unknown, or other
  misc_feature (487)..(487): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggatgcnnagagcgagtgccgcgagcggcaccagcaagctgacgcgggcgaggacggcgacagcggcgtggacgcctactctccgctcggnaaaaggggggcgaaggcccgccgccagtgcctggcgccgcacgagggccaggccgtgggagaaccccagaggggcattgaggcggtgcccgccgccgcgggactggccgtcgacatggagccaagagtacggtcgcggcagcgagaggcggcggcagtgggcccgg

SEQ ID NO: 14476 - protein, 146 aa, Zea mays
  misc_feature: Ceres CLONE 1376174-F
  misc_feature (64)..(64): Xaa is any aa, unknown, or other
MGKGSVGASWWAFLLLAGVLLVVAATAGAEDGVVERDRKEDLRWCKQACEWQYGKDTPRKRDAXSECRERHQQADAGEDGDSGVDAYSPLGKRGAKARRQCLAPHEGQAVGEPQRGIEAVPAAAGLAVDMEPRVRSRQREAAAVGP

SEQ ID NO: 14477 - DNA, 619 bp, Zea mays
  misc_feature: Ceres CLONE 1376175-F
  misc_feature: Encodes the peptide sequence at SEQ ID NO. 14478
  misc_feature (407)..(407): n is a, c, t, g, unknown, or other
  misc_feature (455)..(455): n is a, c, t, g, unknown, or other
  misc_feature (524)..(524): n is a, c, t, g, unknown, or other
aagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcatcagcggtgtcttcggtatgtgaaaacccaatccttgcaccctacaggatccaacaggcaatcgcagctggcatcttacctttatcacccttgtccctccagcatcatcagccctattacgacagntacctttgctgcatgtattgggacaaacatcagggcacaacaactacnacaacttgtgctagcaaacctttgctgctactctcagcaacagcagtttcttccattcaacaactaggnccattgaactctgcttcttaattttgaacaacaacactaccattcagccaggtacctggtgctacccccaagaatttctttcatgcaaccaactg

SEQ ID NO: 14478 - protein, 128 aa, Zea mays
  misc_feature: Ceres CLONE 1376175-F
  misc_feature (83)..(83): Xaa is any aa, unknown, or other
MAAKIFCLLMLLGLSASAATATIFPQCSQAPIASLLPPYLSSAVSSVCENPILAPYRIQQAIAAGILPLSPLSLQHHQPYYDXYLCCMYWDKHQGTTTTTTCASKPLLLLSATAVSSIQQLGPLNSAS

SEQ ID NO: 14479 - DNA, 645 bp, Zea mays
  misc_feature: Ceres CLONE 1376183-F
  misc_feature: Encodes the peptide sequence at SEQ ID NO. 14480
ccccgcggtggcggccgctctagtcccaaagaatcccccgggctgcaggaatttgcacgagaccattacctagaacatcctaatcgaaaaattttttttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcggcggcagtttcgtcgccgtcgcctccatgacgtccgccgccgtctccaccagggtggagaacaagaagccatttgtttctccgaggcaggcacatgtccaggctacacattcaatgccatctcccaagattgaaattctcaagacacttgatgatcgcgctagagataatatctcgccacatctcaagcaagtcgagaaggggtggaaggaaaagggattacctccctggaccagtattcgaaggaattagtggacgaagctagtacgttctaagcaaagcggcccctcgccaaacgcctcgaagccttatacttcactcgccccacgcaccaacactacgccactaccgataaccccccacacacg

SEQ ID NO: 14480 - protein, 105 aa, Zea mays
  misc_feature: Ceres CLONE 1376183-F
  misc_feature: SWISSPROT Homolog: EC 1.14.19.2 Acyl-[acyl-carrier-protein] desaturase
MALRLHDVALCLSPPLAARRRSGGSFVAVASMTSAAVSTRVENKKPFVSPRQAHVQATHSMPSPKIEILKTLDDRARDNISPHLKQVEKGWKEKGLPPWTSIRRN

SEQ ID NO: 14481 - DNA, 664 bp, Zea mays
  misc_feature: Ceres CLONE 1376189-F
  misc_feature: Encodes the peptide sequence at SEQ ID NO. 14482
tggagctccccgcggtggcggccgctctagaactagtggatcccccgggctgcaggaattcgcacgagaccattacctagaacatcctaatcgaaaaactagtgatcagaccagtgagctagcgactgtaccatgcagcagctgtaggagagcctggtggtaggtaggataggagtagcgccagccgccaagtgcgcgtccgggctggctgcttcgacgagcaggagggagccgcaccgccgggctcccgcaatgtcgcctcctccgcccccgccgctgctgcgcaacgagctgtcgcgcaggacggcggtgctgggcctgcgcctgtgggtgctgtggggcatcgccgtcggggccgccttcgtgctgctcctcgtgctcatctccctccacctcgccgcggtgcggaggaggcggcccaggaatgccgtcgcgcacgctgcggcggtggtgtcttcgatgaccccctctgacttatcgcctgagctctatgagacgctggaagagatcgcgaaagtggaaaggcctccaagctatcggatcgaagtctttggtcgcgaaaaaggaagattcgttctccaccacacggactcatcttcttctcacagccaggtacggagctcaagcccagtggtggttactcgaatgcacttcttcttttctt

SEQ ID NO: 14482 - protein, 137 aa, Zea mays
  misc_feature: Ceres CLONE 1376189-F
MSPPPPPPLLRNELSRRTAVLGLRLWVLWGIAVGAAFVLLLVLISLHLAAVRRRRPRNAVAHAAAVVSSMTPSDLSPELYETLEEIAKVERPPSYRIEVFGREKGRFVLHHTDSSSSHSQVRSSSPVVVTRMHFFFS

SEQ ID NO: 14483 - DNA, 709 bp, Zea mays
  misc_feature: Ceres CLONE 1376197-F
  misc_feature: Encodes the peptide sequence at SEQ ID NO. 14484
  misc_feature (663)..(663): n is a, c, t, g, unknown, or other
  misc_feature (705)..(705): n is a, c, t, g, unknown, or other
  misc_feature (706)..(706): n is a, c, t, g, unknown, or other
tggagctccccgcggtggcggccgctctagaactagtggatcccccgggctgcaggaattcgcacgagaccattacctagaacatcctaatcgaaaaaagaaagcagtccagcctgcctctgcctgtttcgtgtgtctgaggatctcctgatctccttcctccctgtccttctcctcccctccccggctacggaggtgctggtgggtgctacggaggagtactacgacgacgacggcgaggaggagcctgtctttttgtttgtggacaagtgaacccacatcctcctcaccgcccatcgcagactctgcgcggctgctgacaaagagtgcagaattgccaaagactagtacgccgacgacgaccagcagcagctgtccgggttccatggagggcggcgacggcgagacgacgctgtccgggttcggcgtcggcggcgtggacaccaaggtgctgcacgcgttccagaccagcttcgtgcaggtgcagacgctgctggaccagaaccgcctcctgatcagcgagatcaaccacaaccacgagtccaaggtgcccggcgacctctcccgcaacgtcggcctcatcagggagctcaacaacaacatccgccgcgtcgtcgacctctacgccgacctctcctcgctcttcgccgatccgacgcggtnccgaagggggggggggttccgtcggcacgttccgccaggcgnncgc

SEQ ID NO: 14484 - protein, 108 aa, Zea mays
  misc_feature: Ceres CLONE 1376197-F
  misc_feature (15)..(100): Pfam Name: DUF1313 Pfam Description: Protein of unknown function (DUF1313)
  misc_feature (93)..(93): Xaa is any aa, unknown, or other
  misc_feature (107)..(107): Xaa is any aa, unknown, or other
MEGGDGETTLSGFGVGGVDTKVLHAFQTSFVQVQTLLDQNRLLISEINHNHESKVPGDLSRNVGLIRELNNNIRRVVDLYADLSSLFADPTRXRRGGGFRRHVPPGXR

SEQ ID NO: 14485 - DNA, 731 bp, Zea mays
  misc_feature: Ceres CLONE 1376199-F
  misc_feature: Encodes the peptide sequence at SEQ ID NO. 14486
  misc_feature (624)..(624): n is a, c, t, g, unknown, or other
  misc_feature (702)..(702): n is a, c, t, g, unknown, or other
aaagctggagctcaccgcggtggcggccgctctagaactagtggatcccccgggctgcaggaattcgcacgagaccattacctagaacatcctaatcgaaaaagttcctcagacgcaaagaagatcgagtctgcagcccacaccatagtgcgagcagattgcgtccaataggctcaaagggagatgggggtggccgctggacgagcggcggccatggtggctgcggcggcggcggcggcggcggtgctgctgctgctcgcgggcggcgcgcacgcggactgctacgacgactgcttcaaggactgcatggccaggttcaagtccatgagagactactgcagctacgcgtgcgagaaggtctgcgatccggacgccacgctccagcgccccctcgccgttgtggggccagcagcagcgttggccgaccaccacccgttggacaagaagcatggtgctgtctggccggcggcgttgcccgaccatcctttccacgagacgcacggcgacgtcgagccggcaggggagccggacccagctaggcacgtcgtccgtccggcacgtgtccccgtcctcccctgaacgccgcccggagcgagagcgcgcgatgctagccgctcggctggncgcccgtatgttaagactagacgaagtggtgtgatgtgtcaaacgtataagcatgccttaactatctcacgtttatcnaagggggggaagcgggtgtcaatttaaaa

SEQ ID NO: 14486 - protein, 131 aa, Zea mays
  misc_feature: Ceres CLONE 1376199-F
MGVAAGRAAAMVAAAAAAAAVLLLLAGGAHADCYDDCFKDCMARFKSMRDYCSYACEKVCDPDATLQRPLAVVGPAAALADHHPLDKKHGAVWPAALPDHPFHETHGDVEPAGEPDPARHVVRPARVPVLP

SEQ ID NO: 14487 - DNA, 689 bp, Zea mays
  misc_feature: Ceres CLONE 1376207-F
  misc_feature: Encodes the peptide sequence at SEQ ID NO. 14488
  misc_feature (452)..(452): n is a, c, t, g, unknown, or other
tggagctccccgcggtggcggccgctctagaactagtggatcccccgggctgcaggaattcgcacgagaccattacctagaacatcctaatcgaaaaaattacaagtataactccattcccctccgtcctcccgcatcaactcgaaccgaagggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccagctggtgatcagcgagatcgactcgtcagccgctacctcgctgcnaggcgtgaagctgctcgcgctgtacctcactggagacaaggaaggtgctatctccagtctcaggaatgggtgagtggattcagcaatggaagccattcctgttcggcggttaatgctgggaatggatttaaggtgtggccaggcctccattgaggttctcaagcaacccccttggggaggaacctggatttgccgggcttgaaaggcccaaatttctccagaagggctccttcaaaa

SEQ ID NO: 14488 - protein, 92 aa, Zea mays
  misc_feature: Ceres CLONE 1376207-F
  misc_feature (69)..(69): Xaa is any aa, unknown, or other
MASPDLLFNLRNLFYLGAYQAAINNSDVPGLDADAAAERDAIVFRSYIALGSYQLVISEIDSSAATSLXGVKLLALYLTGDKEGAISSLRNG

SEQ ID NO: 14489 - DNA, 719 bp, Zea mays
  misc_feature: Ceres CLONE 1376208-F
  misc_feature (665)..(665): n is a, c, t, g, unknown, or other
tggagctccccgcggtggcggccgctctagaactagtggatcccccgggctgcaggaattcgcacgagaccatacctagaacatcctaatcgaaaaatccgtctgagaggcagaggaggagccactgaaaagccactgaaattgggactactctctcgctccctacctcaagcatagtgagtagtgactggggcttgcagtagctctgttttgatgagccattgaggcaaattgaagagggatttgtttggcttgcaagtggcatgatattcttattttattttttgcaacttaaaaactattagtttggggctactagctaggctaacgttgccatttgcttcttcaaagaaagttggaggatgtttatttgatctcaaacagaagtgtcaacgatttgggcttggagccagctttgatttaccattcctttcgacatagccaaagtgcagatccagctgcaaaggaaggcaccattaccaccaccacctgtggctgcaacagccacaactgctagctggtggagggacactagccacaatcatgtgcatccgccagaagaggaaaggggttgtctcgcccctagaagggcgtcatccctagcctcccactgtcagtttctcttatgatggcctccacatcagcttggggaagggttccttccnccgaaagtggctgtttggggggtggaatgccagtttacctaggccaagattcct

SEQ ID NO: 14490 - DNA, 646 bp, Zea mays
  misc_feature: Ceres CLONE 1376209-F
  misc_feature: Translation starting site: 341
  misc_feature (523)..(523): n is a, c, t, g, unknown, or other
  misc_feature (540)..(540): n is a, c, t, g, unknown, or other
  misc_feature (556)..(556): n is a, c, t, g, unknown, or other
tggagctccccgcggtggcggccgctctagaactagtggatcccccgggctgcaggaattcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtgttcgcatcctggccgggnggtggtggggcgccgcntccaagccttggcggncgtgcaccacgtgcgcgcctggcgccacgacagcctgggcaccaaacgcccgcgtcgtcgcttcatcggctggggcatcacggcgctcgc

SEQ ID NO: 14491 - DNA, 738 bp, Zea mays
  misc_feature: Ceres CLONE 1376210-F
  misc_feature: Encodes the peptide sequence at SEQ ID NO. 14492
  misc_feature (482)..(482): n is a, c, t, g, unknown, or other
  misc_feature (483)..(483): n is a, c, t, g, unknown, or other
  misc_feature (548)..(548): n is a, c, t, g, unknown, or other
  misc_feature (718)..(718): n is a, c, t, g, unknown, or other
  misc_feature (719)..(719): n is a, c, t, g, unknown, or other
  misc_feature (738)..(738): n is a, c, t, g, unknown, or other
ggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccggnnaggggcgagtgccggcgccagtgcctgcgccgccacgagggccagccgtgggagacccaggaggncattgaggcggtgccgccgccgcggactggccgtcgacatgagccaagagtacggtcgcggcagcgagagcgcgggcagtggccccgggagaggtgcgaggccacaccgcggggaactgggttgggagaggcagcgctgcctgtgatgaaaaaaaacccggggggggggnnaaaaaaagaggccgccacn

SEQ ID NO: 14492 - protein, 115 aa, Zea mays
  misc_feature: Ceres CLONE 1376210-F
  misc_feature (93)..(93): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGXGRVPAPVPAPPRGPAVGDPGGH

SEQ ID NO: 14493 - DNA, 679 bp, Zea mays
  misc_feature: Ceres CLONE 1376211-F
  misc_feature: Encodes the peptide sequence at SEQ ID NO. 14494
  misc_feature (496)..(496): n is a, c, t, g, unknown, or other
  misc_feature (509)..(509): n is a, c, t, g, unknown, or other
  misc_feature (565)..(565): n is a, c, t, g, unknown, or other
ggagctccccgcggtggcggccgctctagaactagtggatcccccgggctgcaggaattcgcacgagaccattacctagaacatcctaatcgaaaatccgcatttccatcctgtcgtgggatcccagccaccgccgctagaagaagagctcggcgattcccaggtcccgcgagaagatgccgaagcagatctatgagattaaggacttcctcctcaccgcgaggaggaaggatgcccgctcagtgaagatcaagaggagcaaggatgttgtcaagttcaaggtgcgctgctccaagtacttgtacacgctctgcgtcttcgatgctgagaaggcaaacaagttgaagcaatctcttcccccaggtttgaccggtcgaggaggtctgattggatacatggcaacgccgggttgaactacccaagcttctttatcagtagcagagcatgctactcatgtacttttggaacctaagctataagacctgtcagtgttggnatggtgtggatcnttgcattttttgtggagaaataccaatttacctcgttcaaggaggcacctttcggnaatatttcttgtttaactgcacattactttatattttatgcctgtttcataaaaaaaaaaaaaaaaaagcttatcgataccgcccacccccccgaggggggggggcccgggaac

SEQ ID NO: 14494 - protein, 78 aa, Zea mays
  misc_feature: Ceres CLONE 1376211-F
  misc_feature (2)..(69): Pfam Name: Ribosomal_L38e Pfam Description: Ribosomal L38e protein family
MPKQIYEIKDFLLTARRKDARSVKIKRSKDVVKFKVRCSKYLYTLCVFDAEKANKLKQSLPPGLTGRGGLIGYMATPG

SEQ ID NO: 14495 - DNA, 689 bp, Zea mays
  misc_feature: Ceres CLONE 1376213-F
  misc_feature (435)..(435): n is a, c, t, g, unknown, or other
  misc_feature (571)..(571): n is a, c, t, g, unknown, or other
tggagctccccgcggtggcggccgctctagaactagtggatcccccgggctgcaggaattcgcacgagaccattacctagaacatcctaatcgaacctattttgaaaaggtcactgcttttttatttcattctatattctatattatatttttgtaatattcagtctcgtttaattgctttcagacttaatgttagataattgtttacattttctacaattcagtctggactaattgctttgggactaatgttggagatatccatatgtatctgcgtctaagcatttttcatttgtatttatcatgttttgtcaatagggatacttgtttcttgtaagtctgttagcatgtttgaaccatagcaattggcggacgtgtgtaaaactgcagtatgatggattccactattcatcaaccgaaattatggcgcgcttncatcgtggctacgctgatggggacctgatccgttatgatgtgcttgaaatcgtgctgtggagatgtgtggaactcattggttaaagtgtgctttattataatggtgatgctgatggaactgattttgctcccgtgnacgggctgattgttaactttgccctggtgactgtttggaacgtaccgcccagtttactaatactactgctttttggacgaactggactacagttcgacaatttatttattgaaggtcc

SEQ ID NO: 14496 - DNA, 665 bp, Zea mays
  misc_feature: Ceres CLONE 1376216-F
  misc_feature: Encodes the peptide sequence at SEQ ID NO. 14497
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacccccgcggaagagggaatgccagagcgagtgccgcgagcgtcaccagtaagctgacggcgggcgaggacgggcacaggggcgtgggacgccctacgtctccgcttcccggaaggggcgaagtgtcgcccccctctctcttgcccccacagtcgccctattctggatagcgcacagtaaagcacggggactcaccttcaccattttcccctcttgtctcccggacaataagacaaattcccgggttaacacaggatatagcttaatactcctcttgagtctcgct

SEQ ID NO: 14497 - protein, 111 aa, Zea mays
  misc_feature: Ceres CLONE 1376216-F
MGKGSVGASWWAFLLLAGVLLVVAATAGAEDGVVERDRKEDLRWCKQACEWQYGKDPRGRGNARASAASVTSKLTAGEDGHRGVGRPTSPLPGRGEVSPPSLLPPQSPYSG

SEQ ID NO: 14498 - DNA, 803 bp, Zea mays
  misc_feature: Ceres CLONE 1376217-F
  misc_feature: Encodes the peptide sequence at SEQ ID NO. 14499
taccaccacccaccataaccctaccccctctccccccatcaacaatatatccagaagctggactccaccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggccgcccgatgggtgagcaggtgaagggcatgctccacgacaaggagccgacggcgtcgcaggcgctgacggcggtgacgatgctcccgctgggcggcctgctgctggagctgacggagctggcgctgacgtactccgtggtggggctggtcgtggtcacgccggagttcctgatcttcagccccgtgatcgtccccgccgcgctgctcatcgggacgcgcgctatgaagtttcctccctcggccgcgctggccgacgcaggccatgtccctccctcacggtccccgcctatcaaggtacggccagcgcttccagagaacacccggtactactgtgagaggaagctgcccccttaagtcatgacataaaggcccgccgccagactcttaccatctaacctaatacccaccgcacaggcacgtacttgttttccattttactcagcactcaccatccttccaaagcc

SEQ ID NO: 14499 - protein, 144 aa, Zea mays
  misc_feature: Ceres CLONE 1376217-F
  misc_feature (44)..(141): Pfam Name: Oleosin Pfam Description: Oleosin
MADRDRSGIYGGAHATYGQQQQQGGGGRPMGEQVKGMLHDKEPTASQALTAVTMLPLGGLLLELTELALTYSVVGLVVVTPEFLIFSPVIVPAALLIGTRAMKFPPSAALADAGHVPPSRSPPIKVRPALPENTRYYCERKLPP

SEQ ID NO: 14500 - DNA, 745 bp, Zea mays
  misc_feature: Ceres CLONE 1376225-F
  misc_feature: Encodes the peptide sequence at SEQ ID NO. 14501
  misc_feature (24)..(24): n is a, c, t, g, unknown, or other
tttttcctccttttttttttttanctccccccgcccgcgggccaaaaaacacaaagctggagctccaccgcggtggcggccgctctagaactagtggatcccccgggctgcaggaattcgcacgagaccattacctagaacatcctaatcgaaaaattattagaatccacctcgcaccccgcgagcggtgacttccctagggtttagtcgcgccgccaccgccgccgaaacagcacatcgctctctcgatctcagccatggcggaggtggagcagccccaggacgcggtgaagctcttcaaccgctggaccttcgacgatgtccaggtgaacgatatctcgctgaacgactacctggctgtgactgcggcgaagcacgcgacattcctgccgcactccgcggggcgctactccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcatccacctgctcactgacgccaatcccatcccaggtgggtcgtggacgccattatcaacagtggaccacgtgaggagcaacccccgtattgggttccgggctgggggtcggggaaaaaggaagggttgtggcatatctcacccccggaaaaaggggggaaccagggccatcctacactcctacacaaatgggtggccagggtagaa

SEQ ID NO: 14501 - protein, 161 aa, Zea mays
  misc_feature: Ceres CLONE 1376225-F
  misc_feature (44)..(145): Pfam Name: Ribosomal_S7 Pfam Description: Ribosomal protein S7p/S5e
MAEVEQPQDAVKLFNRWTFDDVQVNDISLNDYLAVTAAKHATFLPHSAGRYSKKRFRKAQCAIVERLTNSLMMHGRNNGKKVMAVRIMKHTLEIIHLLTDANPIPGGSWTPLSTVDHVRSNPRIGFRAGGRGKRKGCGISHPRKKGGTRAILHSYTNGWPG

SEQ ID NO: 14502 - DNA, 661 bp, Zea mays
  misc_feature: Ceres CLONE 1376234-F
  misc_feature: Encodes the peptide sequence at SEQ ID NO. 14503
  misc_feature (289)..(289): n is a, c, t, g, unknown, or other
tggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatnatgggcgccggcgggctgtacccctacgcggagtacctgaggcagccgcagtgcagcccgctggcggcggcgcctactaacggccgggtgtgggcagccgagcgccatgttccagccgctccggcaacagtgctgccagcagcagatgaggatgatgggacgtgcagtccgtcgcgcagcagctgcagatgatgatgcagcttgagcgtgccgctgccgccagcagcagcctgtacgaagcagctctgatgcagcagcagcagcagctgctggcagcccagggtctcaaccccatggccatgatgggtggcgcagaatatgccgggccatgggtggactctaacaggaacaggtgcccagctaccgcaccac

SEQ ID NO: 14503 - protein, 106 aa, Zea mays
  misc_feature: Ceres CLONE 1376234-F
  misc_feature (43)..(43): Xaa is any aa, unknown, or other
MKMVIVLVVCLALSAASASAMQMPCPCAGLQGLYGAGAGLTTXMGAGGLYPYAEYLRQPQCSPLAAAPTNGRVWAAERHVPAAPATVLPAADEDDGTCSPSRSSCR

SEQ ID NO: 14504 - DNA, 741 bp, Zea mays
  misc_feature: Ceres CLONE 1376236-F
  misc_feature: Translation starting site: 448
tggagctccccgcggtggcggccgctctagaactagtggatcccccgggctgcaggaattcgcacgagaccattacctagaacatcctagtcgaaaaaggaacacatgacaaaacaggaagcactgcctgctcattttcttcctgtgcgcgtacagagatactactatcgagcacgccatgtagcaaaccgaggagacgatgagcgacgcgcttggagaggtagtggaaggcgacgactagacgctgagcaaggcgctgaaagtgtttggcgtccgtgcactctagcgaagatagcctgcacgcgctgtcgcggccgctgaacaacgtcgtgcggagccacccggacgctactctcatctacgttcacgcccagtacgtcgccgaccacttcgcctaccccgtcgccgcgcacgaaggcatcgtgtacgccccgtcctcgtgggtgcatgccgtgcgtttcgatgcacgaggacagctcccgcaaggtcgtggcgcgcgcgatgaacatctgcataggagaggcaggcggacgccacggaggacgtcatgtaggacgactccaaggaggacatccgctcagccgtggagcatatgcatcccgtatcttctcgtcctcgacagccggagccatcggcgagatcagaagcgcgatcctgggcagcgtgagcgactacatcatccatcacgactgctgcacggtgctgctcgtcaggtccagtgcgaccagtgtactcgcctac

SEQ ID NO: 14505 - DNA, 811 bp, Zea mays
  misc_feature: Ceres CLONE 1376236-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (811)..(811): n is a, c, t, g, unknown, or other
nnnnnccgaattgggtaccgggccccccctcgaggtcgacggtatcgataagcttttttttttttttttttagcaacaccaacaagacaatttaaaccatgcatttttattgtttcatcacaattccatcttctcttattcgttctgacagcagcaggagacccataagtgggcccccacgtgacagagcacacggcatggcgtagctgtggcatggtactacacgaacacgacacactaacgagacagattaaagctaaccgatcgaagggaattcattcgtccaacaacaacattccagattaaaagaagaaaccccgtgatggcgccggcccagacaagacgctgcttgcatgctggcgtggatgctcgctcaggcgtccacgacctcgtcgtccttggacgcaatcacgaactcctcgcgcagcgccggcgacacctcggggatggtcccgtccacggcgttgggcctgcccagtgccttcagcgccaggtgcgccgccttctggccggagatcatcatggcgccgaacgtcgggccctgcgtcatgcaaaccaacaccaaattaatcagtgaattgataattaaggagtagcagcagctagctagctgtcttcccaatcaaatcaatcggtgggcaattaaggagtagcagcagctagctagctgtcttcctcaattaatgactgaccatcctcgggggcgccgtcgatctcggcgacctccatccccggtgacgatcatgccgggcacgaacctcgcgcgtgaggcgcacgatctcgtcctcggcggcgttcatgtcgagcgccn

SEQ ID NO: 14506 - DNA, 681 bp, Zea mays
  misc_feature: Ceres CLONE 1376238-F
  misc_feature: Encodes the peptide sequence at SEQ ID NO. 14507
  misc_feature (459)..(459): n is a, c, t, g, unknown, or other
  misc_feature (539)..(539): n is a, c, t, g, unknown, or other
  misc_feature (579)..(579): n is a, c, t, g, unknown, or other
  misc_feature (632)..(632): n is a, c, t, g, unknown, or other
  misc_feature (659)..(659): n is a, c, t, g, unknown, or other
  misc_feature (660)..(660): n is a, c, t, g, unknown, or other
ggagctccccgcggtggcggccgctctagaactagtggatcccccgggctgcaggaattcgcacgagaccattacctagaacatcctaatcgaaaacttttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcanaccctggagatcattcacctgctcaccgatgccaaccccatccaggtcggtcgtcgacgcgatcatcaacagtggccccncgtgaggatgcaaccccgtatggttcccggctggtgttgnggagaagggaagggacgtgggatatctcacgccctggagggagggtgaaccanggccatctacctcctcaccactgatgnncaagaggaagagtagctttcc

SEQ ID NO: 14507 - protein, 145 aa, Zea mays
  misc_feature: Ceres CLONE 1376238-F
  misc_feature (44)..(143): Pfam Name: Ribosomal_S7 Pfam Description: Ribosomal protein S7p/S5e
  misc_feature (90)..(90): Xaa is any aa, unknown, or other
  misc_feature (117)..(117): Xaa is any aa, unknown, or other
  misc_feature (130)..(130): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNNGKKVMAVRIIKXTLEIIHLLTDANPIQVGRRRDHQQWPXVRMQPRMVPGWCXGEGKGRGISHALEGG

SEQ ID NO: 14508 - DNA, 747 bp, Zea mays
  misc_feature: Ceres CLONE 1376240-F
  misc_feature: Encodes the peptide sequence at SEQ ID NO. 14509
  misc_feature (724)..(724): n is a, c, t, g, unknown, or other
tggagctccccgcggtggcggccgctctagaactagtggatcccccgggctgcaggaattcgcacgagaccattacctagaacatcctaatcgaaaacgaacacaccagaccagctcatcatcacattcgcatacatctcttctagcacgcaaagatcgagctatagctagctctgcaaccagagacaaggaggactacccttcgccggccggcctaaggaggagtacgtacagaacttgggacatggaaaccgtcgtgggcgacctcatggcgaccgagctgaggcttggcctggcgggcaccgtcgacgactgcagccagccccaactggtgaaggccacgccgccgtcgacgccaaggggcaagaggcgcgccaccgccgatgccgtggaggaagccgccggcgccgagaaggcaagcaagcgtgacgccgagacggcgcccccggcagccaaggcgcccgtggtgggttggccgccggtgaggtcgtaccggaagagctgcttccagcaggccagcagcaagcaggcggcggcggccaaacaggaggcggcggcggcggcgacgtcgcccggctgcacggcatcgtcagcagccgccacaaacaccagcagctgcagcagcgcccgcccgttgtcgtcggctccttcgtcaaagtggagcatggacggcgtccgtaacctgaggaaggtggtacctgaggatgtacaggggctacagggnagctccgggagaccctgaaagtt

SEQ ID NO: 14509 - protein, 165 aa, Zea mays
  misc_feature: Ceres CLONE 1376240-F
  misc_feature (7)..(165): Pfam Name: AUX_IAA Pfam Description: AUX/IAA family
METVVGDLMATELRLGLAGTVDDCSQPQLVKATPPSTPRGKRRATADAVEEAAGAEKASKRDAETAPPAAKAPVVGWPPVRSYRKSCFQQASSKQAAAAKQEAAAAATSPGCTASSAAATNTSSCSSARPLSSAPSSKWSMDGVRNLRKVVPEDVQGLQGSSGRP

SEQ ID NO: 14510 - DNA, 696 bp, Zea mays
  misc_feature: Ceres CLONE 1376241-F
  misc_feature: Encodes the peptide sequence at SEQ ID NO. 14511
  misc_feature (608)..(608): n is a, c, t, g, unknown, or other
tccccgcggtggcggccgctctagaactagtggatcccccgggctgcaggaattcgcacgagaccattacctagaacatcctaatcgaaaaattgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctgggatgcaggctcttcccatgccggcgtgcttccttccgccgcgcccgcaggcagcgacctggacccgcctctgcttgcaagctgcgccaagatcgtcccagggatacgacaacgcgccggaagaccggagagaaataggggacaagtacaaggacgcgccgcaggaggcgaaggacgccaccgttgacgccaaggagcacgccaagaggatgagcgctgagacgaagagcagggcgcaggacaaggccggccgcgtgacgaaccagtcgtcgggcatggccgagcgggctatgcacatgcgtaagacgtggcggaagacgccgcgnatacggcgtcccggccgacggagcgagctaataactaaacgcgtgacgcggcgtcgtcagccacggaaggagggggaaccgtgaagaa

SEQ ID NO: 14511 - protein, 164 aa, Zea mays
  misc_feature: Ceres CLONE 1376241-F
MSRLMAAMLLGGARVAGAAKLTGNGNAAGMQALPMPACFLPPRPQAATWTRLCLQAAPRSSQGYDNAPEDRREIGDKYKDAPQEAKDATVDAKEHAKRMSAETKSRAQDKAGRVTNQSSGMAERAMHMRKTWRKTPRIRRPGRRSELITKRVTRRRQPRKEGEP

SEQ ID NO: 14512 - DNA, 633 bp, Zea mays
  misc_feature: Ceres CLONE 1376246-F
  misc_feature (538)..(538): n is a, c, t, g, unknown, or other
ggagctccccgcggtggcggccgctctagaactagtggatcccccgggctgcaggaattcgcacgagaccattacctagaacatcctaatcgaaaattccgtcgtcgtcatcagcagcttctgcttgctctgggggggaaggagagagagagagcgagagagaatctagtagagaggctagctaggtggtcctcgaacgaagatgtggcgggttcagcgggcaggtggtggaggtgccggcggagctggtggcggcgggcagacggacgccgtcgcccaagacgaaggcgtcgcagctggtggggcgcttcctggccgcctccgagccggccgtgtccgtgcagctcggcgaccacggccacctcgcctactcccacaccaaccaggggctcctccgccccaggtcgttcgcggcgaaggacgacgtgttctgactgttcgagggggtgctggacaaccctgagtcgtctgagccagcagcacgggctgtcaagcaagggcgcccaacgaggttgctcctcgtcatcggaggcctacnaagaaggtggggggaacgcggggccttacccgggcagtttgtggttcgcccagtttcacgggtttctaaagcttggggccttttcgaaaaggccc

SEQ ID NO: 14513 - DNA, 672 bp, Zea mays
  misc_feature: Ceres CLONE 1376254-F
  misc_feature: Pfam Name: Glycolytic Pfam Description: Fructose-bisphosphate aldolase class-I
  misc_feature: SWISSPROT Homolog: EC 4.1.2.13 Fructose-bisphosphate aldolase
aagctggagctccccgcggtggcggccgctctagaactagtggatcccccgggctgcaggaattcgcacgagaccattacctagaacatcctaatcgaaaactccttcgttctgttggttgactttcttctcccgtgcgcactccgcttggagtgcgcgacggttaggtggaccggcgccgccctacgtcctacgcccaggtgaccgtgtcttcttcgggccacttgacgacggtaactcaccgagaccaggaaccgcggtgtcaacgggcgcaagtctgcggcccttcattatgcttttcctcagatgctctccactgcacttcgtgatgattcttggctcctcggtagttttctgcgtggattgctgcctttatgaaaaaacttctgtagtgatgcctatagacgagtgcctccgctagatagtcctactctccggaagcagagaggacaagtgtgcgtttgttatagaaccttcctctgttgagactctagtcaattcttagactctgttggtgatggctgccatcagtattacttggtgcgtgctcgggtttgtgcaaatggccgtgctgtcctcaagattgctgccagcgagccgagctggttctcgatccaagagaacgccacggggctgtgacgtcttgacatcatctgccatggataactgact

SEQ ID NO: 14514 - DNA, 733 bp, Zea mays
  misc_feature: Ceres CLONE 1376256-F
  misc_feature: Translation starting site: 214
  misc_feature (441)..(441): n is a, c, t, g, unknown, or other
  misc_feature (548)..(548): n is a, c, t, g, unknown, or other
  misc_feature (549)..(549): n is a, c, t, g, unknown, or other
  misc_feature (628)..(628): n is a, c, t, g, unknown, or other
ggagctccccgcggtggcggccgctctagaactagtggatcccccgggctgcaggaattcgcacgagaccattacctagaacatcctaatcgaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtggctgtttttgttgaccttgaacccactgtcatcgnatgaggtgaggactggcacctaccgccagctcttccaccctgagcagctcatcagtggggaaggaggatgcagccaacaacttttgcccgtggtcactacccattgnncaggggagattgttgacctaatgccttgatcgcatcaggaagcttgccgacaactgcactgggtcccagggcttcccgncttcaaaggctgggtggggggggagaaacggttcccgggggccttggttccctcctccagaaagggggcctgtctggtgactaaacgcagaagtccccaagagtt

SEQ ID NO: 14515 - DNA, 697 bp, Zea mays
  misc_feature: Ceres CLONE 1376257-F
  misc_feature (602)..(602): n is a, c, t, g, unknown, or other
aagctggagctccccgcggtggcggccgctctagaactagtggatcccccgggctgcaggaattcgcacgagaccattacctagaacatcctaatcgaaaaaatccgaattccaccattgatgtacgtaactgatccatccaccccggtcgagtgccacccactccacgtcgccgaatcgcagataatgtacagagcgccgcgccgtgtcgccgtggatgacaaagcctccaaacctctctgtttcgggctctccgtccccggcgtccaacacccatactctccccaggttgtgtgccacactccacactcaactatatacgaaaaccgccggagtctggcccctaaggcctagtcacatacccttgttctttcttcgacgcgcccccggtgatggcgaaccgcaatgttgccatgggcttgtccctcgcgttcgtggacatgaccgcgctctgttgcgcgccttgcgccgcgtagttgccccggctgtaccactcgacgagtagcgacggatcgctgaatctgctccatggtctgattactgctgtaggcaaggagactcacaatcagtgcccggattccgacctctaatggggaacggancccctatgaaaggctggaactatggactatcctcatttgcaaccctgggggagtgttttttaccaagaattggctctctcacggggggggcggcg

SEQ ID NO: 14516 - DNA, 715 bp, Zea mays
  misc_feature: Ceres CLONE 1376263-F
  misc_feature: Encodes the peptide sequence at SEQ ID NO. 14517
  misc_feature (471)..(471): n is a, c, t, g, unknown, or other
  misc_feature (472)..(472): n is a, c, t, g, unknown, or other
  misc_feature (494)..(494): n is a, c, t, g, unknown, or other
  misc_feature (533)..(533): n is a, c, t, g, unknown, or other
  misc_feature (539)..(539): n is a, c, t, g, unknown, or other
tggagctccccgcggtggcggccgctctagaactagtggatcccccgggctgcaggaattcgcacgagaccattacctagaacatcctaatcgaaaaacaccgcacacgcacgcacgaacgcgctcccaccccctcccgccgcaaacgccgccaaaaccccggcccgactcggcgtcctccgccaacctcctcctgggcagcgccggcggggggatatggcatcggaggacgtggtgggcaagagcaggggcgacacggccgtcaccaccatcgtcaacctggcggaggaggccaagctcgcgcgcgagggggtcaaggcgcccggccaccagatcctcaccatctgcaagtcgctcgtcgccggcggcgtagcaggcggagtgtctcgtactgctgttgctccacttgaacgattgaaaatattgcttcaggttcaaaatccgcacagcatcaagtacaatggtactggnntcaggtctcaagtatatctggnagacagaagggcctccgtggacttttcaaagggcatggntacaantgggggcaaggattgttccaatcctgcccgtgaaattttttagctacgagcaggcgtccaaagggaaattctgtgggcctacgtcaacagaaaggggtggaaaaggatgctcaggttactccgtcttggccctgaaactggaaacatgggctgaaaacaaaaacatgtctgcacta

SEQ ID NO: 14517 - protein, 121 aa, Zea mays
  misc_feature: Ceres CLONE 1376263-F
  misc_feature (86)..(86): Xaa is any aa, unknown, or other
  misc_feature (93)..(93): Xaa is any aa, unknown, or other
  misc_feature (106)..(106): Xaa is any aa, unknown, or other
  misc_feature (108)..(108): Xaa is any aa, unknown, or other
MASEDVVGKSRGDTAVTTIVNLAEEAKLAREGVKAPGHQILTICKSLVAGGVAGGVSRTAVAPLERLKILLQVQNPHSIKYNGTGXRSQVYLXDRRASVDFSKGMXTXGGKDCSNPAREIF

SEQ ID NO: 14518 - DNA, 671 bp, Zea mays
  misc_feature: Ceres CLONE 1376265-F
  misc_feature: Encodes the peptide sequence at SEQ ID NO. 14519
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (316)..(316): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaagctggggctccccgcggtggcggccgctctagaatagtggatcccccgggctgcaggaattcgcacgagaccattacctagaacatcctaatcgaaaaaacccaatccagccccatccgtcgattggaacccagatcccgcaggcgcagcacaagagggtgggatcggatcggatcggagcagagggggaccgacagaatccgcgncgaccacatgggctccgcgagccgtgccgtctcgtggctgggctgcccctgcaagtggctggggtgcgggctcctgaagctgctggggaaaatcctcgtctcgttccccggggtccctggggggggtcgcccctttcccctcaatttttttttaaagcgcaaattgattccccgccccccggggaactccggccctcctttccccaatttggggggtgggggggggctccccgggtctccctaaaaaccctcaaggggcccggggggggggggggaacccccaaagccgggggggggggggtttttaataaaaaaaaaacccccgggggggggttccttttttataaaacaaaac

SEQ ID NO: 14519 - protein, 78 aa, Zea mays
  misc_feature: Ceres CLONE 1376265-F
MGSASRAVSWLGCPCKWLGCGLLKLLGKILVSFPGVPGGGRPFPLNFFLKRKLIPRPPGNSGPPFPNLGGGGGLPGSP

SEQ ID NO: 14520 - DNA, 762 bp, Zea mays
  misc_feature: Ceres CLONE 1376266-F
  misc_feature: Encodes the peptide sequence at SEQ ID NO. 14521
  misc_feature (35)..(35): n is a, c, t, g, unknown, or other
  misc_feature (36)..(36): n is a, c, t, g, unknown, or other
  misc_feature (41)..(41): n is a, c, t, g, unknown, or other
  misc_feature (762)..(762): n is a, c, t, g, unknown, or other
gggcccgccccccgggccaggagccagaacaaaannacaanaacacccaccaaagctggagctccccgcggtggcggccgctctagaatagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataagatcgccctggggagccaccaggaggtgtaccacccgggcgccctcaaggcggcgttcggtgagttcatctccaccctcatcttcgtcttcgccggacagggctccggcatggccttcagcaagctgaccggcggcggcccgacgaccccggcgggcctgatcgcggcggcggtggcgcacgcgttcgcgctgctcaaggcggtgtctgtggggcgcgaaaatctccggcggggaaggagaaacccggccgggagcttccggcgccttcgcgggggcgacaaactccgccccggttccggagaggcccgcaagactgggcaggcgacaggaaaaagcccgcaccaccaaccacgcagaactagcagttcgcagcctcggggagccgcccacacgcagaacacgcactacgcccactatcgcacaagggcgcagctgcaagcagcgatcaggtcctacacggaccagggtggagacaggcacaacaccccccaggcccn

SEQ ID NO: 14521 - protein, 170 aa, Zea mays
  misc_feature: Ceres CLONE 1376266-F
MPINKIALGSHQEVYHPGALKAAFGEFISTLIFVFAGQGSGMAFSKLTGGGPTTPAGLIAAAVAHAFALLKAVSVGRENLRRGRRNPAGSFRRLRGGDKLRPGSGEARKTGQATGKSPHHQPRRTSSSQPRGAAHTQNTHYAHYRTRAQLQAAIRSYTDQGGDRHNTPQA

SEQ ID NO: 14522 - DNA, 632 bp, Zea mays
  misc_feature: Ceres CLONE 1376268-F
  misc_feature: Encodes the peptide sequence at SEQ ID NO. 14523
  misc_feature (304)..(304): n is a, c, t, g, unknown, or other
  misc_feature (310)..(310): n is a, c, t, g, unknown, or other
  misc_feature (315)..(315): n is a, c, t, g, unknown, or other
  misc_feature (341)..(341): n is a, c, t, g, unknown, or other
aagctggagctccccgcggtggcggccgctctagaactagtggatcccccgggctgcaggaattcgcacgagaccattacctagagcatcctaatcgaaaaaacaaaaaaaccctagaactccaaaaccttcagccccacgctatggccctcgcactgcgcctccgtcgggtcctcgcggcggcctccaccgcgagacccctgctccgcccgtccacctcggtcgcccggtcttggccgctcgttcccctcgccatcccggtcgcgccgctcctgctgccgacgtggagattcctgcccaggcncggagncgggntcaggtccacggcgacagcggctgcncggagtcggaaacgactatgggacggacgacaggaagatatcccccgacgagatactccttcgagggcttggactaacaccaatggctcatcaacatgtgaattgccggaccccaagatcgtccgcgaagagatagacttagacataacttcagactctcgccaagggccgggggggggtttttgagggaggcccaaaaaaaggatgtctgcgttttagaccaccaccttttgtttgcccttccaggttgggaaagagccccgaaaaagttaaaaaaaatcctgggggggg

SEQ ID NO: 14523 - protein, 127 aa, Zea mays
  misc_feature: Ceres CLONE 1376268-F
  misc_feature (54)..(54): Xaa is any aa, unknown, or other
  misc_feature (56)..(56): Xaa is any aa, unknown, or other
  misc_feature (58)..(58): Xaa is any aa, unknown, or other
MALALRLRRVLAAASTARPLLRPSTSVARSWPLVPLAIPVAPLLLPTWRFLPRXGXGXRSTATAAARSRKRLWDGRQEDIPRRDTPSRAWTNTNGSSTCELPDPKIVREEIDLDITSDSRQGPGGGF

SEQ ID NO: 14524 - DNA, 823 bp, Zea mays
  misc_feature: Ceres CLONE 1376271-R
gtgggaaggaggggggccgggtccctctcaacagtataattacattgtgatactaatctgcacaggtgtgtccagattccatctataagaaacattttaaaaagaaatgagcagcaaatctgcaactaacaatgaagcttctttgagtctaagttgggatcaaacagtcacctacaagaaaggatatgacggacaacttacgaggatgccaatccttagaaaccaagtagattccaaagaaaagttgcttctgctgctgccatctttaaaaaaacgcatggcatgggctaacgctctacttgagccacttatatgaaaccgaaaagtcctcgcgcaaacaagcgcgaacttctcctcctccccctgttcgcagttctggagcttctcattggtgtcagatagaaccgaagcatcccgttgtccaggttcccaggagatgtgtaatgcacgctcctgcttctgccaatcttgctgttcttgagccaatcggtccggaaactgtgcacatccacattgcttgcagcctgtgagcttcggattgagccttggcttgctctgcccggcacatgtgcgttgaggcccgggttgagtttcgcccgccccatgtctgctgcctccggatttttaccccctccgggacttccctcccgggatttccaagaagggaacccctcgaggaacatggcttcccccttttcctcaacgaaacctcccttgaagaaggaactggggtttatggcctcccgaattcccgaagacccggggggttcccaaccatgtgtttggggaaccttcccggttgtttccccaagtgcacccagga

SEQ ID NO: 14525 - DNA, 759 bp, Zea mays
  misc_feature: Ceres CLONE 1376273-F
  misc_feature: Encodes the peptide sequence at SEQ ID NO. 14526
  misc_feature (545)..(545): n is a, c, t, g, unknown, or other
  misc_feature (698)..(698): n is a, c, t, g, unknown, or other
  misc_feature (708)..(708): n is a, c, t, g, unknown, or other
aaagctggagctccccgcggtggcggccgctctagaactagtggatcccccgggctgcaggaattcgcacgagaccattacctagaacatcctaatcgaaaatcccacgagcgccccccctgccctgcccatttcgctctcctccctaggcaactaaacgccgcgctcccgcagacggtaccagccgccgcgatggggtcctcgtcctcgccaccgccaccaccgccgctgccactgcccatgattgggcgggccgggaacctcaccatcttcatcacgccgccatcccccgctagcacgccccggggcgctgggcgcacgccgccgctcgagtccccgcgctcggatatctccacacccatcccgcagagggcagccccgtcgccctccctttctccctctccgcggaaccacgagagccgggccgtggcgcctgcggtggtgttcaccccgcccccgccgcctgcttctgtgaatgtcgcgctgccgccggtgcaggtgccgccgccgcagtacgagaaggcgtccgcggggggcaagctgancgtatcggcgttcggcttcttcctgagacgcgcgtcgcgcgcgtccaggaagcgccgggagcctcgacgagacggtctaaccccggggttgcgggtgttggatcagtccaaagtaccagtgggcgcttaacgactactacgagacccataggnaagggcccgncaaagaggtcagggggatcttcgaaattcgctcatcgtcaactttggctga

SEQ ID NO: 14526 - protein, 160 aa, Zea mays
  misc_feature: Ceres CLONE 1376273-F
  misc_feature (118)..(118): Xaa is any aa, unknown, or other
MGSSSSPPPPPPLPLPMIGRAGNLTIFITPPSPASTPRGAGRTPPLESPRSDISTPIPQRAAPSPSLSPSPRNHESRAVAPAVVFTPPPPPASVNVALPPVQVPPPQYEKASAGGKLXVSAFGFFLRRASRASRKRREPRRDGLTPGLRVLDQSKVPVGA

SEQ ID NO: 14527 - DNA, 671 bp, Zea mays
  misc_feature: Ceres CLONE 1376279-F
  misc_feature: Encodes the peptide sequence at SEQ ID NO. 14528
  misc_feature (545)..(545): n is a, c, t, g, unknown, or other
aagctggagctccccgcggtggcggccgctctagaactagtggatcccccgggctgcaggaattcgcacgagaccattacctagaacatcctaatcgaaaaagccaccagtcccaccaccaccaccctctgtcttcgcctccgctgccgattcgaaagcacccgtcctgtcccctcgcaaaaccctagctccagccaccatgaagggcaaggctgacacctccaagaaggacgagggcaggctccgggcgggcggcgccgccggaaagcgcaagaaggccgccgcgagcggcaagcccaagcgcccgccctccgccttcttcgtcttcatgtctgaattcaggcaggagtatcaggcgctgcaccctgacaacaagagcgttgcgaccgtgagcaaggcagcaggcgaaaagtggcgtgctatgtcagatcaagagaagcaaccatatgtggaccaagctggacagaagaagcaggactatgagaagactaaggcaaactttgataagaaggagagcacaagctcaaagaaggctaagactgagngatgaggatgtctcgaagtcagaggatgatgacgaggatggcagcagtgacgaggaaaacgatgacgatgagtacacagtctccgaggtcacgaggtatgcaatccgagtgttacgtcccaattaa

SEQ ID NO: 14528 - protein, 115 aa, Zea mays
  misc_feature: Ceres CLONE 1376279-F
  misc_feature (33)..(102): Pfam Name: HMG_box Pfam Description: HMG (high mobility group) box
MKGKADTSKKDEGRLRAGGAAGKRKKAAASGKPKRPPSAFFVFMSEFRQEYQALHPDNKSVATVSKAAGEKWRAMSDQEKQPYVDQAGQKKQDYEKTKANFDKKESTSSKKAKTE

SEQ ID NO: 14529 - DNA, 717 bp, Zea mays
  misc_feature: Ceres CLONE 1376284-F
  misc_feature: Encodes the peptide sequence at SEQ ID NO. 14530
  misc_feature (633)..(633): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcgaaaaaccctacactgagaaccgcagagacaggagtcttcgtactcgcctatctccgcgactcagagctttccccaattcccccccttctcccatttctcaccaccggcgccgctccccccgatcaacaacaccatgagggagtgcatctcgatccacatcggccaggctggtatccaggtcggaaacgcgtgctgggagctgtactgcctcgagcatggaattcaggctgatggccagatgcccggtgacaagaccattggcggaggtgatgatgctttcaacaccttcttcagggagactggcgctgcgaagcacgtcccccgtggtggttttgttgaccttgagcccactgtcatcgatgaggtgaggactggcacctaccgccagctcttccatcctgagcagctcatcagcggcaaggaggatgcagccaacaacttcgctcgtggtcactacaccattggcaaggagattgttgacctgtgccttgaccgcatcaggaagcttgcagataattgcactggtctccagggnttcctcgtcttcaacgctggtggtggagnaacgaggctctgggcttggctctcctcctcctgaagcgcctgtctgttgactatg

SEQ ID NO: 14530 - protein, 154 aa, Zea mays
  misc_feature: Ceres CLONE 1376284-F
  misc_feature (49)..(155): Pfam Name: Tubulin Pfam Description: Tubulin/FtsZ family, GTPase domain
  misc_feature (144)..(144): Xaa is any aa, unknown, or other
MRECISIHIGQAGIQVGNACWELYCLEHGIQADGQMPGDKTIGGGDDAFNTFFRETGAAKHVPRGGFVDLEPTVIDEVRTGTYRQLFHPEQLISGKEDAANNFARGHYTIGKEIVDLCLDRIRKLADNCTGLQGFLVFNAGGGXTRLWAWLSSS

SEQ ID NO: 14531 - DNA, 799 bp, Zea mays
  misc_feature: Ceres CLONE 1376287-F
  misc_feature: Encodes the peptide sequence at SEQ ID NO. 14532
  misc_feature (799)..(799): n is a, c, t, g, unknown, or other
atacatcccacccccttttttctccccccggaccggaacccgcacggcgccgccgccgctccccacgctgccgtgcgcctctctaactactggatcccccggggtgcgggaattcgcacgagcacattacctagaacaacctaatcgaaaaaaaacggaccaccgcaccatggaatcgctgacgcttcgcgcttcaacggacgcctcgccgctgcggcgacgccggctgctccccggacggcagcgcgcgatgaacgtccgcgccacggtctccgccggcgagccggacctctccgtgcgcgagaacgggatgcagatgacaaacccgatagtgattagaggtggggaaacaggagaaccaactatcacgttatgaagcgcgccttacaagaggactgaggcatcgaaaatagccaacactgtgacaacaggatgattaaaaaaaataataacgatactacccgatacgaaaagattacgagaaacaagcaaaaggggtctacacattgacgacccaacactgacaccgaccaaaaataaaacaacaacagtgagccagggccactgtagcatctcgcccgcaaatgagcgcgaagcagagtagaaaaaaacgagtaagcgtgtccggttataagttaccgggttacacttagagctagagtactaccacccaacaccctacactcacacaccaccatcaatcaacaccaatagaaaagaagcaatgccagccgatcgtcaagggaagcgcctggtggttatcgtgtatggacattcggccaaagcaaaaccagaagan

SEQ ID NO: 14532 - protein, 68 aa, Zea mays
  misc_feature: Ceres CLONE 1376287-F
MESLTLRASTDASPLRRRRLLPGRQRAMNVRATVSAGEPDLSVRENGMQMTNPIVIRGGETGEPTITL

SEQ ID NO: 14533 - DNA, 676 bp, Zea mays
  misc_feature: Ceres CLONE 1376291-F
  misc_feature: Encodes the peptide sequence at SEQ ID NO. 14534
  misc_feature (183)..(183): n is a, c, t, g, unknown, or other
  misc_feature (215)..(215): n is a, c, t, g, unknown, or other
  misc_feature (223)..(223): n is a, c, t, g, unknown, or other
tccccgcggtggcggccgctctagaactagtggatcccccgggctgcaggaattcgcacgagaccattacctagaacatcctaatcgaaaaagctagctacatccactgatccacgcgcattccgcgtatcaccgccaccgcgccgcgtcacggaaagagaagcatgtcgtcgtctccctcgncagagagcacccgactggatctggatgggaancccatcgntcccatcacatttgcatggatcgaggcgggggggttcttcggttccccctctgggggaaattaatggcggagaagaaccacaacggtctcccttgttgacccctattggggaaaaaatccgcccccttgttttacccccgggccgccgaaattcgccggggggttttttttttcccggcgcttttttaaaaaaacaacccccccgttaaggggggtcttccgaaggggggggttttggggttaaaccgggcggggtttttgcgcccgggcggattaaataatttctcccccttttaggaatttttttaaaatttttttcccaacccccccccggggaaagaattggtcccccaaaaaaacaagggggttttttaaatttttccccccgggggggggtcccccgagggaaaactcctggggtttttttcccccaaaaaaaccaccccctggtgg

SEQ ID NO: 14534 - protein, 40 aa, Zea mays
  misc_feature: Ceres CLONE 1376291-F
  misc_feature (7)..(7): Xaa is any aa, unknown, or other
  misc_feature (17)..(17): Xaa is any aa, unknown, or other
  misc_feature (20)..(20): Xaa is any aa, unknown, or other
MSSSPSXESTRLDLDGXPIXPITFAWIEAGGFFGSPSGGN

SEQ ID NO: 14535 - DNA, 595 bp, Zea mays
  misc_feature: Ceres CLONE 1376293-F
  misc_feature: Encodes the peptide sequence at SEQ ID NO. 14536
  misc_feature (119)..(119): n is a, c, t, g, unknown, or other
  misc_feature (320)..(320): n is a, c, t, g, unknown, or other
  misc_feature (346)..(346): n is a, c, t, g, unknown, or other
  misc_feature (364)..(364): n is a, c, t, g, unknown, or other
  misc_feature (373)..(373): n is a, c, t, g, unknown, or other
  misc_feature (384)..(384): n is a, c, t, g, unknown, or other
tcaccgcggtggcggccgctctagaactagtggatcccccgggctgcaggaattcgcacgagaccattacctagaacatcctaatcgaaaaacaaacacgtgacacctccgcccacccntcgccccctccctaccggcaccgcccagatggcctgctcccacatcgccgccgcgggggtctcctcccccgccgcagcggcggctcgttccccggcgcattctcccgcttccgccttcgcgcgcctccggtcgacgcctcgtttcgcgagcgctggcttgtcggttaagggaaacggagcggcgttcccgttggtcgccgncgcggggccggccgcggcggcaccgntgggccgacctggacggncgcccgggncacggagaagnagcccatcatcgtcatcgaaaactacgaagggttcacctacaaccctcctgcagaaaatgggggaacttggaattgaacttcaaaagttacccgcaggggtgaactggccccataaaaaaggggaaaaggaaaaaacccggggggaaaatctttttttctccggaacccggggggaaaccccaaaaattcggaaaaatcttttgggaaggg

SEQ ID NO: 14536 - protein, 51 aa, Zea mays
  misc_feature: Ceres CLONE 1376293-F
MGELGIELQKLPAGVNWPHKKGEKEKTRGENLFFSGTRGETPKIRKNLLGR

SEQ ID NO: 14537 - DNA, 666 bp, Zea mays
  misc_feature: Ceres CLONE 1376298-F
  misc_feature: Translation starting site: 208
aaagctggagctccccgcggtggcggccgctctagaactagtggatcccccgggctgcaggaattcgcacgagaccattacctagaacatcctaatcgaaaactatcttcctatggtcgtcgtcgtcgtcgtcggcggagacgtcctcgagtccccctcccctcccctcgcccccgggcccgccgaataggagcagcgcagcgcgtgatggaccgcgtgcagctcgtgctgctcgggctccgcatcctcctcttctggtccgacgtcgttaccctcttggcgcctctcccgccgccgggacccgggaccgacaggtgaccgcacgcttttcggtcgggggacgaatcttcctccgccgccgacgcttccgctcatgggcagactgaggtggacgtgactgtatccgaagccagcgtgaactgtaagtcctgcgtctcctgctcgtagaggtgaactgcaagagagctgatgcgaagtgatgagggacggaatctttggcaggggtggagtaccgtgcagcagtatactgctataccatggtactggagaacgaacttgtggctactgcgtttgccaaccgggagctgtgctggttgcggctgaggtaggggcccaaggctcttgttgatgctccaccgtgcaaaggatacgccctcgttgggcaaa

SEQ ID NO: 14538 - DNA, 794 bp, Zea mays
  misc_feature: Ceres CLONE 1376312-F
  misc_feature: Encodes the peptide sequence at SEQ ID NO. 14539
tggagctccccgcggtggcggccgctctagaactagtggatcccccgggctgcaggaattcgcacgagaccattacctagaacatcctaatcgaaaaagctatttcctgtattctcttcctgccggccgctagagagattggcatcgcactgctctctgtgtttggccgctctatgtttggcggagtccctttcgtttctgtcggcttcgtctgtttctgtacgccgcctccgtacaagaacagcttcctgtttatcgatctgtctctctgcactgaaaacacgggccccgcagacctcgccgccaacgagcacatccctttgggcgggcgagctgctgtctgctgggagctgacggtggtccgagcacgacaggtcgggtgtgtgtaagatcagtcggtctcttgaccgtcttcgacttttaaaactcgtatctagtcctcatttacccgaatccctcgttgtgtaatgaatgtatggatctaatgtaatattcgggatcgagttatgagttgatagaacgtagatttttctgggataattttctgtacctttactaatctgttctgtcatcaaggccgtggatgcaaaagatcccgagccactgtgatctctgttgacatatatttaaaactcatttttggggtagggtattaaaccctaaccctaaaaacaaaaaaaaaaaaaaaagcttatcgataccgtccgacctcgaggggggggcccggtacccaattcgccctatagtgagtcgtattacgcgcgctcactggccgtccgtttaccacgtcgtgg

SEQ ID NO: 14539 - protein, 71 aa, Zea mays
  misc_feature: Ceres CLONE 1376312-F
MFGGVPFVSVGFVCFCTPPPYKNSFLFIDLSLCTENTGPADLAANEHIPLGGRAAVCWELTVVRARQVGCV

SEQ ID NO: 14540 - DNA, 852 bp, Zea mays
  misc_feature: Ceres CLONE 1376316-F
  misc_feature: Encodes the peptide sequence at SEQ ID NO. 14541
  misc_feature (574)..(574): n is a, c, t, g, unknown, or other
  misc_feature (575)..(575): n is a, c, t, g, unknown, or other
  misc_feature (658)..(658): n is a, c, t, g, unknown, or other
  misc_feature (714)..(714): n is a, c, t, g, unknown, or other
  misc_feature (775)..(775): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (834)..(834): n is a, c, t, g, unknown, or other
tccccgcggtggcggccgctctagaactagtggatcccccgggctgcaggaattcgcacgagaccattacctagaacatcctaatcgaaaaacacaaacaagaagcttgcattgttcgtttgctcgatcgttgcagataatggagaaccctgctccgagtatcgtagtgccccccattgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggccggcaggctcaagggctccacgctccttaccgaaggagtggtgacggatggatcagatgaatgggcaatctacggcgggacccggagagtttgctatgggcgagaggtgtcgtcaaaagaaggtaccttgcccgatagnngatggcgccgggaacactgacgagtcagccatgcagttttcttgtgcgccgggtggtttggctcatcacagcaaccaaacagncagcatctcgtccccagaattggggttatggggggggggggaaaaaaagagagagncccccggccaggaacattccggaaacgacggagcccaccgcagcgctgcacagcctcccgntttttgtttnnnnnnnnnnngnnnccggcgcacctcccctccgggttcccgaaaaatanggtggggggggggggggg

SEQ ID NO: 14541 - protein, 151 aa, Zea mays
  misc_feature: Ceres CLONE 1376316-F
  misc_feature (145)..(145): Xaa is any aa, unknown, or other
  misc_feature (146)..(146): Xaa is any aa, unknown, or other
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGRLKGSTLLTEGVVTDGSDEWAIYGGTRRVCYGREVSSKEGTLPDXXWRREH

SEQ ID NO: 14542 - DNA, 801 bp, Zea mays
  misc_feature: Ceres CLONE 1376318-F
  misc_feature: Encodes the peptide sequence at SEQ ID NO. 14543
tggagctccccgcggtggcggccgctctagaactagtggatcccccgggctgcaggaattcgcacgagaccattacctagaacatcctaatcgaaaaatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcgaggtgcgctcgctcaacagccgcgcgtcgtcgacggcggaccggcaggccacctgcaactgcctcaagagcatgacggaccggctcggcggcggcgtcagcatggccaacgccgccaacatccccggcaagtgcggcgtctccgtcggggtgccatcagccccaccgtcgactgcaccaagatcaactgatcgatgcaccagtagtggaggtaactatgcctctgcatgctccgtggatggaaagcgtgcccatcaacagaatgggggcggccgcggcggcctaacagatggcctagctacctgtgtgccctcagaatggcactggggcacctaataaggaaggaaatcaggcccccctaatcttccccttgccctagccccccgtttcgctggcggggacgacaataaagta

SEQ ID NO: 14543 - protein, 174 aa, Zea mays
  misc_feature: Ceres CLONE 1376318-F
  misc_feature (36)..(116): Pfam Name: Tryp_alpha_amyl Pfam Description: Protease inhibitor/seed storage/LTP family
MAARSSSQQLVAAAVLAAALLLLAAGAGTASAAVSCGEVTSSVAPCLGYAMGSAASPSAACCSEVRSLNSRASSTADRQATCNCLKSMTDRLGGGVSMANAANIPGKCGVSVGVPSAPPSTAPRSTDRCTSSGGNYASACSVDGKRAHQQNGGGRGGLTDGLATCVPSEWHWGT

SEQ ID NO: 14544 - DNA, 763 bp, Zea mays
  misc_feature: Ceres CLONE 1376319-F
  misc_feature: Encodes the peptide sequence at SEQ ID NO. 14545
  misc_feature (342)..(342): n is a, c, t, g, unknown, or other
  misc_feature (522)..(522): n is a, c, t, g, unknown, or other
  misc_feature (523)..(523): n is a, c, t, g, unknown, or other
  misc_feature (525)..(525): n is a, c, t, g, unknown, or other
tccccgcggtggcggccgctctagaactagtggatcccccgggctgcaggaattcgcacgagaccattacctagaacatcctaatcgaaaagaagtctatctttttctcctcctgccgtacgtccgttccagcttgcaaagcgctcgcgagctgctgccatggcaggcgccggtgcgcccgcagttccccaggccggtcgcccagcccccaacttcgacgtcatcgtggtgggcgccggcatcatgggcagctgcacggcgcacgcggcggcgtctcgcggcgcccgcgtcctgctgctggagcgcttcgacctgctccacccgctgggctcctcgcacggngactcccgcatcatccgcgacgcctacgcgcagccgcggtaacctccgcatggtgcgcctcgcccggcgcctctgggcccgccgcgagggcgaaggctggctaccgcgtgctcaccccgaaacgcgactctcctgggcccgggggaggagggcctcgctcgcccgcgcatcgtacatcgnngncccaaagaggggggaaaaaagacacctcaccgccggggggggggggggggccttcaactcaccgtccggggccggggggaaaaggggggggtaaccgggctaaggaacccagggggggtgggttcagggcaccaaggccgcgggacatggtcccaatccttctgccggcccaaaaaaggcccccggggtaaggaacaaaaccccggggcccaaaaattttttaaagggggccctaaac

SEQ ID NO: 14545 - protein, 74 aa, Zea mays
  misc_feature: Ceres CLONE 1376319-F
  misc_feature: SWISSPROT Homolog: EC 1.5.3.1 Sarcosine oxidase
MAGAGAPAVPQAGRPAPNFDVIVVGAGIMGSCTAHAAASRGARVLLLERFDLLHPLGSSHGDSRIIRDAYAQPR

SEQ ID NO: 14546 - DNA, 789 bp, Zea mays
  misc_feature: Ceres CLONE 1376322-F
  misc_feature: Encodes the peptide sequence at SEQ ID NO. 14547
gctctagaactagtggatcccccgggctgcaggaattcgcacgagaccattacctagaacatcctaatcgaaaaaaaagtcaaaacccaacctttattttgtttctgccaaacacttctcttcctcttatccaatggcttccttatccttcgtctcatcctctcacctcactctccgcactccttctctcaccctacgcagaacctctccctcttcctcctccgtttccttctccgtcaaggcccagtccgtcgcactctcccaagacgatctcaaaaaactcgcggcggagaaagccgtcgaagccatcaaaccggggatggtcctcggcctcggaaccggatccaccgccgccttcgccgtcgaccaaatcggaaaactcctcgcctccggcgagctccacgacatcgtcggcatcccgacgtcgaaacgcaccgaggagcaggcccggtccctagggatccccctcgtggccctcgacacgcaccctcggatcgacctggccatcgacggagcggacgaggtggatccgaatctggacctggtcaaggggcgaggaggcgcgcttctcagggagaagatggtggaggccgtggccgagagatttatcgttgttgcggatgatacgaagctagtgaaaggctggggagggagtggtttagcgatgccctgtggaggttgttcagttctgctggaagtttattttgcggaggctgaggatcttggtttaaggaatttgggtgcgatgcaaacctgacgtttgggaagggtggggcaaaggcctatgtc

SEQ ID NO: 14547 - protein, 207 aa, Zea mays
  misc_feature: Ceres CLONE 1376322-F
  misc_feature (92)..(200): Pfam Name: Rib_5-P_isom_A Pfam Description: Ribose 5-phosphate isomerase A (phosphoriboisomerase A)
  misc_feature: SWISSPROT Homolog: EC 5.3.1.6 Ribose-5-phosphate isomerase
MASLSFVSSSHLTLRTPSLTLRRTSPSSSSVSFSVKAQSVALSQDDLKKLAAEKAVEAIKPGMVLGLGTGSTAAFAVDQIGKLLASGELHDIVGIPTSKRTEEQARSLGIPLVALDTHPRIDLAIDGADEVDPNLDLVKGRGGALLREKMVEAVAERFIVVADDTKLVKGWGGSGLAMPCGGCSVLLEVYFAEAEDLGLRNLGAMQT

SEQ ID NO: 14548 - DNA, 790 bp, Zea mays
  misc_feature: Ceres CLONE 1376323-F
  misc_feature: Encodes the peptide sequence at SEQ ID NO. 14549
  misc_feature (311)..(311): n is a, c, t, g, unknown, or other
  misc_feature (353)..(353): n is a, c, t, g, unknown, or other
  misc_feature (702)..(702): n is a, c, t, g, unknown, or other
  misc_feature (765)..(765): n is a, c, t, g, unknown, or other
ggagctccccgcggtggcggccgctctagaactagtggatcccccgggctgcaggaattcgcacgagaccattacctagaacatcctaatcaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcancgcgatggcgagggcgagggcaagggcaaagcatcagcttcncgacgaggagaagccgtggggggaatgctgcgacttggccgtatgcgtcaagacgtacccgctaacttgctcgtgctttgatccgggtgagcgctgctccgacgcctgtaaggagtgcgtggaaacggaggactcgcggcacgtctgcgtcgaaaggtaccgtggcgaccccgggcccaggtggcaccaccaagaccggaggagcggcggacccgctgacgaagaccctggtggcaaacgacgccgacggcagtgatggcagatgacaagaaagcaggccggcggcgacgacgaacagaagaagaagccgtggaattgctgcgacgtgcccatctgcaccagtcctggncctccggtgtgccgctgcccggacccggtggagcgttgcgccagcacctgccacactgcgagnagggggaaggagggccgcccccgcc

SEQ ID NO: 14549 - protein, 142 aa, Zea mays
  misc_feature: Ceres CLONE 1376323-F
  misc_feature (44)..(44): Xaa is any aa, unknown, or other
  misc_feature (58)..(58): Xaa is any aa, unknown, or other
MAMGAASILLMMVSLEALLLAAAAGGGTIRLPSDVGGVAADLVXAMARARARAKHQLXDEEKPWGECCDLAVCVKTYPLTCSCFDPGERCSDACKECVETEDSRHVCVERYRGDPGPRWHHQDRRSGGPADEDPGGKRRRRQ

SEQ ID NO: 14550 - DNA, 810 bp, Zea mays
  misc_feature: Ceres CLONE 1376327-F
  misc_feature: Encodes the peptide sequence at SEQ ID NO. 14551
  misc_feature (421)..(421): n is a, c, t, g, unknown, or other
  misc_feature (493)..(493): n is a, c, t, g, unknown, or other
  misc_feature (557)..(557): n is a, c, t, g, unknown, or other
  misc_feature (810)..(810): n is a, c, t, g, unknown, or other
ctccccgcggtggcggccgctctagaactagtggatcccccgggctgcaggaattcgcacgagaccattacctagaacatcctaatcgaaaaaaattagcaaggcgatagataagaggaaggaaagaacataggcagccgaagcgactgtcgcgaggcaaggccatcgtccgccatgacgctctccctctccacctctttcctccccatccccgccgccgcgaggaccaccgcccgcactttacgctccgtcgtcccctcccaggggatgcgctgctcgatgcgcaagaagggggaggacagcggcgaccgctgcccttgcgagaagcagtgcgagggccaccacgaccgggaaagcaggcagcagtgcgtccaggcttgcgagcgccggcgacagcagcgcggcggcagccgtgactccnacgtcgacgaggacgacagcgaccggcggtgccagatgaaatgccggcgccacagcgatcggcaggcgaggncagtggtgcgtgcagcgctgcgagcgtaagcaacaggaggaggacgccgccgccgacgacgacnacagcgggcggtgccagaagagatgccagcaccacagcgatcgcaggcgaagccagtggtgcgtgcagcgctgcgagcgtaagcaacaggaggacgccgccgcccgacgacgacgagaacagcgaccggtgccagaaaagatgcagcagacagcgactggatgaaaaaggctgcgtgcagggcaacggtgcgggaaaaaaaagggaggagggcgcgcacgcgacgacctttgacgacactcagcacgggacgn

SEQ ID NO: 14551 - protein, 115 aa, Zea mays
  misc_feature: Ceres CLONE 1376327-F
  misc_feature (83)..(83): Xaa is any aa, unknown, or other
  misc_feature (107)..(107): Xaa is any aa, unknown, or other
MTLSLSTSFLPIPAAARTTARTLRSVVPSQGMRCSMRKKGEDSGDRCPCEKQCEGHHDRESRQQCVQACERRRQQRGGSRDSXVDEDDSDRRCQMKCRRHSDRQARXVVRAALRA

SEQ ID NO: 14552 - DNA, 825 bp, Zea mays
  misc_feature: Ceres CLONE 1376329-F
  misc_feature: Translation starting site: 157
  misc_feature (825)..(825): n is a, c, t, g, unknown, or other
gctctagaactagtggatcccccgggctgcaggaattcgcacgagaccattacctagaacatcctaatcgaaaaccattcccttcgtgcttgtttgctctagggtttttgccacgccgccgccgctctgccccttccaccccaccgatataccaagatgacggcgcaggctgcggaggagctcgccgcccagatcgagcagcagaagctcgaggagcagaagaccgaggcagaagaggttgtggtggaggaggatgacgaggatgatgaggatgacgatgatgatgacaaggatgatgatgaactggatgcacaagaaggggatgggagtggcaagtcgaagcacagcaggagggagaagaagagccgcaaggccatgctgaagcttggcatgaagcccatcactggtgtcagccggggtcactgttgaaaaaaagcaggaatatgctttttggcatctcgaagccagatgggttcaagagccccaactcggacccctatgtcatattcgggcaaaggcgaaaatcgaggaccctcagctccccagtgggagacccaaggttggaaaaggaagttcaagggctccctggcccgggacccaaaagggcccccaaaccctggaaaacttcgggcctggggccgggggaggacacaccgggggggggggggggtgtggacaaaaactggggggcccagggcccaaagggagtcgccaagtgtgggggatgaaccccagggtatctgtgtttccggaggccccgggggggcgggcacaggggccctccaaaagttttttaaagggggaaaacattcgcccccccgcccn

SEQ ID NO: 14553 - DNA, 783 bp, Zea mays
  misc_feature: Ceres CLONE 1376333-F
  misc_feature: Encodes the peptide sequence at SEQ ID NO. 14554
  misc_feature (230)..(230): n is a, c, t, g, unknown, or other
  misc_feature (359)..(359): n is a, c, t, g, unknown, or other
  misc_feature (376)..(376): n is a, c, t, g, unknown, or other
  misc_feature (509)..(509): n is a, c, t, g, unknown, or other
  misc_feature (602)..(602): n is a, c, t, g, unknown, or other
  misc_feature (603)..(603): n is a, c, t, g, unknown, or other
  misc_feature (610)..(610): n is a, c, t, g, unknown, or other
  misc_feature (612)..(612): n is a, c, t, g, unknown, or other
  misc_feature (637)..(637): n is a, c, t, g, unknown, or other
  misc_feature (638)..(638): n is a, c, t, g, unknown, or other
  misc_feature (670)..(670): n is a, c, t, g, unknown, or other
  misc_feature (671)..(671): n is a, c, t, g, unknown, or other
aagctggagctccccgcggtggcggccgctctagaactagtggatcccccgggctgcaggaattcgcacgagaccattacctagaacatcctaatcgaaaaattccgtcgtcgtcatcagcagcttctgcttgctctgggggggaaggagagagagagagcgagagagagatctagtagagaggctagctaggtggtcctcgaacgaagatgttggcggtgttcagcggncaggtggtggaggtgccggcggagctggtggcggcgggcagccggacgccgtcgcccaagacgaaggcgtcgcagctggtggggcgcttcctggccgcctccgagcccggcgtgtccgtgcagctcggngaccacggccacctcgnctactcccacaccaaccaggcgctcctccgcccccagtcgttcgcgacgaaggacgaggtggtctgcctgttcgagggggtgctggacaacctgggtcgtctgagccagcagcacgggctgtcaagcaagggncgccacgaggtgctcctcgtcatcgaggcctacaagacgctgcgcgaccgcgcgccctacccgggcagcttcatgctcgcccagctcacgggnntctacgncnttcgtctcttcgacaagtccacaannctcctgctcgtcgcatccgtaagcctgctcgnnctcctttctttctttcttcccagcgctgactggctggctggctggctggctggctggcggcaggacccccgaggcagggtgcgctcttctgggggatcccgccgacggtggg

SEQ ID NO: 14554 - protein, 191 aa, Zea mays
  misc_feature: Ceres CLONE 1376333-F
  misc_feature (56)..(56): Xaa is any aa, unknown, or other
  misc_feature (132)..(132): Xaa is any aa, unknown, or other
  misc_feature (134)..(134): Xaa is any aa, unknown, or other
  misc_feature (135)..(135): Xaa is any aa, unknown, or other
  misc_feature (143)..(143): Xaa is any aa, unknown, or other
  misc_feature (154)..(154): Xaa is any aa, unknown, or other
MLAVFSGQVVEVPAELVAAGSRTPSPKTKASQLVGRFLAASEPGVSVQLGDHGHLXYSHTNQALLRPQSFATKDEVVCLFEGVLDNLGRLSQQHGLSSKGRHEVLLVIEAYKTLRDRAPYPGSFMLAQLTGXYXXRLFDKSTXLLLVASVSLLXLLSFFLPSADWLAGWLAGWRQDPRGRVRSSGGSRRRW

SEQ ID NO: 14555 - DNA, 805 bp, Zea mays
  misc_feature: Ceres CLONE 1376338-F
  misc_feature: Encodes the peptide sequence at SEQ ID NO. 14556
  misc_feature (491)..(491): n is a, c, t, g, unknown, or other
  misc_feature (805)..(805): n is a, c, t, g, unknown, or other
aagctggagctccccgcggtggcggccgctctagaactagtggatcccccgggctgcaggaattcgcacgagaccattacctagaacatcctaatcgaaaaagttcgttcgcgttgcccgagactctctccgtcctcctactggccacccgactcacacgattggcacgcgcgtgcttccacccgtccgtcgcctctctctcggctgcctgattgatttggatggcccgggtccagcaatggcggttcaggcggagtatcaccaccactactaccgcgagtcctctttcctcgtcagcggcggggcggaggggagccgcatgtctgcaccgatagagctgcatcatcaagcgcagaaggaggctatgggggcgcaccagggtcaagctccgaccctcttctttgtacttctcgcatggcaattactgcggggggaggaagcggaagcgcagagcggagcccatgacgacgcagatcttatctctgcagcancaaccgcaaggggatggccacagggtgatcaaactgtggaaacttcagaagcggacggccatggtgctccccttctatttcgacgagggataagaagctcggggcgtgtccgccgcccgccctcgggctcaagcgtctgtttccatctcagagaacttccccgggcaggcgcgatctgggaccggaactttaaggttccgcctgataaaccgaacaaggctccacgacccccgcgggccgcctggtcccacaccccaaaagggttaacaacacttcccccgaagggggtccccaacacggggttgcccaaaaan

SEQ ID NO: 14556 - protein, 188 aa, Zea mays
  misc_feature: Ceres CLONE 1376338-F
  misc_feature (85)..(85): Xaa is any aa, unknown, or other
MAVQAEYHHHYYRESSFLVSGGAEGSRMSAPIELHHQAQKEAMGAHQGQAPTLFFVLLAWQLLRGEEAEAQSGAHDDADLISAAXTARGWPQGDQTVETSEADGHGAPLLFRRGIRSSGRVRRPPSGSSVCFHLRELPRAGAIWDRNFKVPPDKPNKAPRPPRAAWSHTPKGLTTLPPKGVPNTGLPK

SEQ ID NO: 14557 - DNA, 810 bp, Zea mays
  misc_feature: Ceres CLONE 1376339-F
  misc_feature: Encodes the peptide sequence at SEQ ID NO. 14558
aagctggagctccccgcggtggcggccgctctagaactagtggatcccccgggctgcaggaattcgcacgagaccattacctagaacatcctaatcgaaaaatcatcatccaatccagatcagcaaagcggtagcgtgtacagaggatcgtcgaacagaacagcatgaagatggccatcgttctcgtcgtgtgcctggttctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagcagctgctggcagcccagggtctcaaccccatggccatgatgatgccgcagaacatgccggccatgggtggactctaccaggtacagctgcccagctaccgcacaaacccctgtggcgtctccgctgccattccgccctactactgattcatgaaaatttgggaaatcccctctatccatctctctctatctataaatggaataatggcggtaagacgacacccttatccttgggtgggatgaccaattatatatg

SEQ ID NO: 14558 - protein, 178 aa, Zea mays
  misc_feature: Ceres CLONE 1376339-F
MKMAIVLVVCLVLSAASASAMQMPCPCAGLQGLYGAGAGLTTMMGAGGLYPYAEYLRQPQCSPLAAAPYYAGCGQPSAMFQPLRQQCCQQQMRMMDVQSVAQQLQMMMQLERAAAASSSLYEPALMQQQQQLLAAQGLNPMAMMMPQNMPAMGGLYQVQLPSYRTNPCGVSAAIPPYY

SEQ ID NO: 14559 - DNA, 785 bp, Zea mays
  misc_feature: Ceres CLONE 1376340-F
  misc_feature (237)..(237): n is a, c, t, g, unknown, or other
  misc_feature (317)..(317): n is a, c, t, g, unknown, or other
  misc_feature (347)..(347): n is a, c, t, g, unknown, or other
  misc_feature (464)..(464): n is a, c, t, g, unknown, or other
  misc_feature (653)..(653): n is a, c, t, g, unknown, or other
  misc_feature (671)..(671): n is a, c, t, g, unknown, or other
  misc_feature (680)..(680): n is a, c, t, g, unknown, or other
  misc_feature (726)..(726): n is a, c, t, g, unknown, or other
ggagctccccgcggtggcggccgctctagaatagtggatcccccgggctgcaggaattcgcacgagaccattacctagaacatcctaatcgaaaaagacggtggagagcaacaccagctcaaaaccctagcgtccaactcatatacctgctgctcgccccgacgcgcatcaactcccgccgccgccccttcctctccgtcgctcgcctcgcgcctacgccaccacctctgccatgancccgaagaaggataaggccccgacgccgtcgtccaagccggccaagtcctgaggcgggaagcagaagaagaagaagtggnagcagggtaagcaaaagggagaagtcaacnacgctgtgctcctccaccaagccaactatgacgaggtgctcttcgaggtggccaagtaccaggagatcaacccatccggtctctcccaagcgtctcaggattaaatggatcattggncacggaagggcatctaaagatctgatggcaaggggattcctaaaggatgatctctcggtcattcccagcccgcagatattcacccagggcaacctacccatggagggctggttttgcatcttggttcggcgggtctctagacggccttaaatggtgctaataatatcatgcttaatttccatcatggcntcagtcaagcctaactgnttgggtcgnatggttgaataatttttagactactgtactgtttaaagctcatggntgctatcccaaatatccatcgtgagggattaaaacaagaaaaaaaaagctcatcgatcc

SEQ ID NO: 14560 - DNA, 777 bp, Zea mays
  misc_feature: Ceres CLONE 1376342-F
  misc_feature: Translation starting site: 195
  misc_feature: SWISSPROT Homolog: EC 5.3.3.2 Isopentenyl-diphosphate Delta-isomerase
  misc_feature (502)..(502): n is a, c, t, g, unknown, or other
tccccgcggtggcggccgctctagaactagtggatcccccgggctgcaggaattcgcacgagaccattacctagaacatcctaatcgaaaaacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttcgccatgagtcaaagtacaactgccatttgatggagaagattgattctgagaatctgctacatagggcattcagcgtgttcccttttcaactcaaaatatgagctgctacttcagcaaaggtccgcgacaaaggttacctttcctttagtttggaccaatacctgctgcagccaccctctgtaccgtgagtctgagcttatccagnagaactacctttggtgtgagaaatgcagcacagaggacgctactgtatgagctgcgcatcccagcaaagatgcccagttgaccatttcaccctctggggcgaatgttttaaaggcaccatctgacgggaaatggggggagcatgagcttgactacctgctggtcatcgccgggaacgtgaaggggcagcccaacccagatgaagtccttgacgtgaagtaccggaaccgggacgagctcaaggactcattccggaaggttaccctgccaggaagg

SEQ ID NO: 14561 - DNA, 889 bp, Zea mays
  misc_feature: Ceres CLONE 1376343-F
  misc_feature: Translation starting site: 207
  misc_feature: Pfam Name: Tetraspannin Pfam Description: Tetraspanin family
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
nnttttnnnnnnnnnnnnncccccacccccgccgggagaggaaaaaaaagctggtgctccccgcggtggcggccgctctagaactagtggatcccccgggctgcaggaattcgcacgagaccattacctagaacatcctaatcgaaaaatcggcattcagcacagcagccacctcttaccacgccccacggcaccaccccaacgtgatggcggtgagcaacaacatcacggcatgcgtgacgctgctggcgctgatctgcgcggtgcccgtgatcgcgtcgggggtgtggttcgcgtcggcgcagggcgaggagtgcgcgcgcctggcgcggtggcccgtggccatcctgggcgggctgctcctgctggccgcgctggcgggcttcgtgggcgcgtactggaaccggcgcgccctgcttgccttctacctcttcgccatggcgtcgctcgtcgtgctcctcatcgcgctcctcgccttcgccttcgccgtcaccccgcgggtccggcgcctaccccgtgctcgggcgcgcctacgacgactaccgcctcgacggcttctccatgtggctccgcgggtacgtctccgacgaccccggggcgctgggacaaggtcagggcctgcctcgccgtctccgacacctgcaagaaagtcgcgcgccaggcccgcctttcaccaacgcagaccagttctataggtcgcacctctccccggttccagccggggtggttcaagcccccggccgggggggggggtttcacttacggaagccccgaaagggggtgggcccgcccccgggggggcgcgatccggccggacggaaccgcggaactggcggggcctggggaaaacaacgaacccggggggccaaacgtggggccctaaacggcg

SEQ ID NO: 14562 - DNA, 783 bp, Zea mays
  misc_feature: Ceres CLONE 1376344-F
  misc_feature: Encodes the peptide sequence at SEQ ID NO. 14563
  misc_feature (388)..(388): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (534)..(534): n is a, c, t, g, unknown, or other
aagctggagctccccgcggtggcggccgctctagaactagtggatcccccgggctgcaggaattcgcacgagaccattacctagaacatcctaatcgaaaaagagaaacacctctgagcattctaaagctcatagccctctccttccagagcatttcacatcgctctcatctccacctgcttgcatccagcgcctcgtcactctgcaaaacaacagcacatacctccaaaggatgagccgcagcaacaggaagagctctaggggccttgacctgaaactgaacctctcacttcctgcaacaggggactcctccaggagggcgatggctgatgaggagtcatccccgagctcctgcctatcgtcagagaacgagcatggcctgcagtgntccaacagccctgaggccacatccatggttcttgctgcctgtcctcgctgcttcatctacgtcatgctcccacaagatgaccctcggtgcccccagtgcaagagccctgttctccttgactttctgcaggacannncacacagtangaacaacagtaataatagcagcaggaagagcaggaggggatgagcaatatgtttcataggcggcacgacatcagaaaaaaagtatatggaggtctagggccaggaagtctaattgcctaggcatttcttcaggggaactgggaataatcattctaaaattggaagctagcacccaaacggtagaatcccaatttgaaatacccagaaaccctgggggaggcggaaccttaaaccctggttcccttcctt

SEQ ID NO: 14563 - protein, 114 aa, Zea mays
  misc_feature: Ceres CLONE 1376344-F
  misc_feature (52)..(52): Xaa is any aa, unknown, or other
  misc_feature (97)..(97): Xaa is any aa, unknown, or other
  misc_feature (98)..(98): Xaa is any aa, unknown, or other
  misc_feature (101)..(101): Xaa is any aa, unknown, or other
MSRSNRKSSRGLDLKLNLSLPATGDSSRRAMADEESSPSSCLSSENEHGLQXSNSPEATSMVLAACPRCFIYVMLPQDDPRCPQCKSPVLLDFLQDXXHSXNNSNNSSRKSRRG

SEQ ID NO: 14564 - DNA, 813 bp, Zea mays
  misc_feature: Ceres CLONE 1376346-F
  misc_feature: Encodes the peptide sequence at SEQ ID NO. 14565
tggagctccccgcggtggcggccgctctagaactagtggatcccccgggctgcaggaattcgcacgagaccattacctagaacatcctaatcgaaaaatcaaaccgctttgtctctttgcgatcagatctcgtcggagagcagttatggcttcaggtttcagcggcgatgaaactggtcctttcttctgattcctcgggggtgtcgccgctctcgttttctcatgcatggcagcagcgtatgggacagcgaagagcgctgtcggcgtgtcgtcgatgggtgtgatgagagcagagcttgcgatgaaatcgattgttcccgaggtcatggctgatgaggtaagaatctatgggctcatcattgctgtcatcatcagtactggaatcatccctaaggacaagtcttactacctcttcgacggctatgctcatctctcttccgatctcgcttgtggtctccgcggtctctccgccgggatgattattgatatcgtcagcgacgctgtagtaagagggaatgcacaatgaccgaagctgtttgcgggaatgattttgattctcatctttggtgagacacttgcgctgtagggcctcattggagggatcatccatctcgtcgcggggctgggcagccaaagagccgagtggaatcagaaaagcctttggggcaagtccctttggaaaagtttaggagatgtatcacttcttgagattcctgtggggggcttggggagtttttggggttactcagggcaaaaaggaaaccaagggcgatgataataatggactttctggggccctaagtaaaaggtttg

SEQ ID NO: 14565 - protein, 99 aa, Zea mays
  misc_feature: Ceres CLONE 1376346-F
  misc_feature: SWISSPROT Homolog: EC 3.6.3.14 H(+)-transporting two-sector ATPase
MAAAYGTAKSAVGVSSMGVMRAELAMKSIVPEVMADEVRIYGLIIAVIISTGIIPKDKSYYLFDGYAHLSSDLACGLRGLSAGMIIDIVSDAVVRGNAQ

SEQ ID NO: 14566 - DNA, 803 bp, Zea mays
  misc_feature: Ceres CLONE 1376348-F
  misc_feature: Encodes the peptide sequence at SEQ ID NO. 14567
  misc_feature (740)..(740): n is a, c, t, g, unknown, or other
aaagctggagctccccgcggtggcggccgctctagaactagtggatcccccgggctgcaggaattcgcacgagaccatacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccaccaagctgacgcgggcgaggacggcgacagcggcgtggacgcctacgtctcccgctcagggaggggcgagtgctggcgccagtgcctgcgccgccacgaggggcagccgtgggagaccccagagtgcatgaggcggggccgcccgcgcggactggccggcgacatggagcaagagtacggtcgcggcagggagagcgcggccaagtgccgggagaggtgcgagcgccaccaccgcgggactggtggagaggcaccctgctgtgtgaaaaaaaaaccgggggggggggagtaatgtgcccccacccgccccccangcgggtcaaaaaagaaaagagaccccccacccccgtccttgggaaaaacatgggagggccccc

SEQ ID NO: 14567 - protein, 168 aa, Zea mays
  misc_feature: Ceres CLONE 1376348-F
MGKGSVGASWWAFLLLAGVLLVVAATAGAEDGVVERDRKEDLRWCKQACEWQYGKDTPRKRECESECRERHHQADAGEDGDSGVDAYVSRSGRGECWRQCLRRHEGQPWETPECMRRGRPRGLAGDMEQEYGRGRESAAKCRERCERHHRGTGGEAPCCVKKKPGGGE

SEQ ID NO: 14568 - DNA, 730 bp, Zea mays
  misc_feature: Ceres CLONE 1376349-F
  misc_feature: Pfam Name: PAE Pfam Description: Pectinacetylesterase
tggagctccccgcggtggcggccgctctagaactagtggatcccccgggctgcaggaattcacacgctagcttcacctatatactccaatccagagattaagcgatgctggcttgttcttagacacacctgatgtgtccggtggccacaccatcaggaagctatataacggcgttgtgcagttgcagggagtgaggaacaatctgccgcatatgtgcacaaatcatctcaatccaacttcttgtttcttccctcaagacttgatcagtcacatgaaaactcctctttttattgtcaatgcagcgtatgatatttggcagattcatagcagtatagctccaacaagtgcagaccctcatgggtattggcatgcatgccgattaaaccatgcaagatggcatgcaacacagctccccttcttgcaacggtttacaaatcccatgttgagagccgtaacaggattctcaaaacaaaaaagaatggtttgtttataaatccatgttttggccctttgccaaacgaaagggaaaaacccttggctcgctaaggaatcccccgggaaaccccaaaaaggcgggggccaaaaaccggttggaaagttggtttttttaataaaccaaaaagggagccctaaaaattgccccccccccgggggaataggggttgcccaattctttgcttcccgaggaaaggggggaattacggggccctcccaatttttttttcccgaa

SEQ ID NO: 14569 - DNA, 789 bp, Zea mays
  misc_feature: Ceres CLONE 1376351-F
  misc_feature: Encodes the peptide sequence at SEQ ID NO. 14570
ggagctccccgcggtggcggccgctctagaactagtggatcccccgggctgcaggaattcgcacgagaccattacctagaacatcctaatcgaaaaaacagcgaagacctctgcttcgcatttcttcccatcccccttcgcaacccaaaccccaactcgctccgcgtcgatggcgcccaaggccgagaagatgcccgcggtgaagaagccggcgcaggaggagcccgcggttgagaaggcgcccgccggcaagaagcccaaggcggagaagcggctcctcgctgtgaagtccgctgccaaggaggacggggagggcaagaggggacggaagaacggcaagaggagcgtggggacctacaacatctgcatcttcaaggagccgaagcatacgcacccgggcattgcactctcgtcccaggccatgtggattatgaacccccttcgtttaccataccttcgaaaagcttcctgctgacggccgccaaggtccgcgggctatgaaaataaatctacccatcatctcctggggagatacagaacttccgtgcggcctcgttctttcccgggggaactccgccaattgacgccggcctccgaaggacatcatggtcccacccccaaaattccaccggcggctttatgtttggggtttgaccgtcagcttgcccagaattggcccccctggggttcaaccgcgcaatgcttgggaagttagggctggctcgccggcctctacagctcctgtttcccccccgccagcgccgtggaacacaaatgtgcgctattccc

SEQ ID NO: 14570 - protein, 101 aa, Zea mays
  misc_feature: Ceres CLONE 1376351-F
MAPKAEKMPAVKKPAQEEPAVEKAPAGKKPKAEKRLLAVKSAAKEDGEGKRGRKNGKRSVGTYNICIFKEPKHTHPGIALSSQAMWIMNPLRLPYLRKASC

SEQ ID NO: 14571 - DNA, 718 bp, Zea mays
  misc_feature: Ceres CLONE 1376352-F
  misc_feature: Encodes the peptide sequence at SEQ ID NO. 14572
  misc_feature (671)..(671): n is a, c, t, g, unknown, or other
  misc_feature (677)..(677): n is a, c, t, g, unknown, or other
  misc_feature (681)..(681): n is a, c, t, g, unknown, or other
  misc_feature (716)..(716): n is a, c, t, g, unknown, or other
ggagctccccgcggtggcggccgctctagaactagtggatcccccgggctgcaggaattcgcacgagaccattacctagaacatcctaatcgaaaaacttcattccggtttccggatagcttacctcccatcgacggtcggtgagccgttggtgagtggcgagacagcgggtgcgctgggcaagaacaggcgacgaagaagatgagcacgctggacacgcggacgctcaaggacgagctgacgagcatggacaggaagtgcctcgtggacctcggccacccgctgctcaaccgcgtcgccgacagcttcatccgcgccgctggggtcggggcggccagggccgtctccagggaggcctacgtcgtcaccgtcgaagggctttcaggagactcgtccgggctagacgccgacggcggctagcggagccatttctccagcatcagaggtgacgacggccagaggtcgctcgacgcagtggtaaaaacggacggcaaggaggtcttccagtgcgggttggcagccggagtctactcagggctcacgtacgcgctgcgagaggccaggggatgccacgactgtaagaaacagcgcatcgcaggcgccatcgctggggcgacggtggcgctcatcggtgacgactggcggcactccgacaagctcgtcatcttcgncatcancggngccgagctctccagcgccgggagcttgctctccgnaa

SEQ ID NO: 14572 - protein, 72 aa, Zea mays
  misc_feature: Ceres CLONE 1376352-F
MSTLDTRTLKDELTSMDRKCLVDLGHPLLNRVADSFIRAAGVGAARAVSREAYVVTVEGLSGDSSGLDADGG

SEQ ID NO: 14573 - DNA, 511 bp, Zea mays
  misc_feature: Ceres CLONE 1376353-F
  misc_feature (196)..(196): n is a, c, t, g, unknown, or other
  misc_feature (198)..(198): n is a, c, t, g, unknown, or other
  misc_feature (199)..(199): n is a, c, t, g, unknown, or other
tggagctccccgcggtggcggccgctctagaactagtggatcccccgggctgcaggaattcgcacgagaccattacctagaacatcctaatcgaaaaacaaccatattattgagaccaacaagcaacatagaaagtggaatccagtagcaacaatagagcaacaatgggcgaccaaagatattttcccctcccttnannagggctccttggtcatttctacaggggtcgctaacggacaattttccctcaaggctccaaaggtccaaaaggttcccttttttcccccataaatttcaaaaaaattaaaactttccaaatgggggaaaaaccccggtttttttaaccaaaaataggggtccaaaaaaaagaaaacgggcgaaaaaaaaaaaaaaaaccttttttattccccccccttttttgtttttttttataaaaaaaagcgcccgcggccccctttttttttttttttgggggggggggaggaaatttttttttgtcaaaacacaaaaa

SEQ ID NO: 14574 - DNA, 723 bp, Zea mays
  misc_feature: Ceres CLONE 1376354-F
  misc_feature (628)..(628): n is a, c, t, g, unknown, or other
  misc_feature (723)..(723): n is a, c, t, g, unknown, or other
tggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcgctctatatagaaagacaggcgggtactagagaggttgcgtggtgtccaagctacacacgggatgctactagctatctgcaggcaagggcgaggaatggcaagcctttcatgtgctcggacgtacggtgttgtccgttccggcgctctgcccgccaagctgttggtgtgcgccagctgctgcttccctacggcggctccagtcacgaacgcagaggtgcatgagcttgcctgccgccagcatctccaccgcttgccgaggcgtcaggatctccgtcgccagcgcccgcgccgtcgccatcctcagttcgtctggctccaccagcagccgagacagtgtgcacttgtagctgtacagcgccgacgtctactcggcgtccgcgggtcctagccggnccgccctgagccgccgccgcgccgcgccgtcgtagcttccgctggcagcagctgcagcttctaacagtgccgccgaagcgatttcgacctgcccn

SEQ ID NO: 14575 - DNA, 733 bp, Zea mays
  misc_feature: Ceres CLONE 1376360-F
  misc_feature: Encodes the peptide sequence at SEQ ID NO. 14576
  misc_feature (155)..(155): n is a, c, t, g, unknown, or other
  misc_feature (553)..(553): n is a, c, t, g, unknown, or other
  misc_feature (598)..(598): n is a, c, t, g, unknown, or other
  misc_feature (666)..(666): n is a, c, t, g, unknown, or other
  misc_feature (693)..(693): n is a, c, t, g, unknown, or other
  misc_feature (703)..(703): n is a, c, t, g, unknown, or other
aagctggagctccccgcggtggcggccgctctagaactagtggatcccccgggctgcaggaattcgcacgagaccattacctagaacatcctaatcgaaaaaatcgagcatcgcagagataggcgtcttcgtactcgcctacctccgcggctcanacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgaggactggcacctaccgccagctcttccaccctgagcagctcatcagtgggaaggaggatgcagccaacaactttgcccgtggtcactacaccattggcaggnagattgttgacctatgccttgatcgcatcaggaagcttgccgacnactgcactggtctccagggcttcctcgtcttcaacgctggtggtggaggaacgggctctggccttggntccctcctcctagagcgcctgtctggntgactacgcnagaagtccaagcttggggtcactgtgtacc

SEQ ID NO: 14576 - protein, 159 aa, Zea mays
  misc_feature: Ceres CLONE 1376360-F
  misc_feature (49)..(160): Pfam Name: Tubulin Pfam Description: Tubulin/FtsZ family, GTPase domain
  misc_feature (113)..(113): Xaa is any aa, unknown, or other
  misc_feature (128)..(128): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGRXIVDLCLDRIRKLADXCTGLQGFLVFNAGGGGTGSGLGSLLLERLSG

SEQ ID NO: 14577 - DNA, 716 bp, Zea mays
  misc_feature: Ceres CLONE 1376363-F
  misc_feature: Encodes the peptide sequence at SEQ ID NO. 14578
  misc_feature (676)..(676): n is a, c, t, g, unknown, or other
  misc_feature (716)..(716): n is a, c, t, g, unknown, or other
tggagctccccgcggtggcggccgctctagaactagtggatcccccgggctgcaggaattcgcacgagaccattacctagaacatcctaatcgaaaaacagacacagacacggacacagcaaccaacaagtcgtccagcgtccaggcttttctgttttgtttctctctcacgcaagtcgcaaagcaaagcgtcccccaccatggcttccacgacgacgacggcatccaacaacctggagggcgtgagggtcggcgagctctcgtccgcgctgcatgggacgtggcaggcggtggacgtggccgccacccacgggctcggagaggacgacgacccgcggctgccgtgccagcagaagcagaggccgtgatgaggcgacgacaggagcagcagcaacaacaaggcgttgcgaggagccgcggcggccgttacgtacaggcaggagggggacgtcacgaggtgcggcgacgacatgctcgacaccacgctctagctcctactcgaccggttcgcgcccagctgagcgggccccttgctcacccgccgctgccgccgacgccgccgagatcgatcggcgcgtgctgtactgtacaggcgtaataactgcacgtctgcacgacatggtttctgtaaataatgctgtatataaactgcaatggcatcttgtgttgctttcanatgaggactaaaacaatgacagcttatcgataccgccgan

SEQ ID NO: 14578 - protein, 55 aa, Zea mays
  misc_feature: Ceres CLONE 1376363-F
MASTTTTASNNLEGVRVGELSSALHGTWQAVDVAATHGLGEDDDPRLPCQQKQRP

SEQ ID NO: 14579 - DNA, 691 bp, Zea mays
  misc_feature: Ceres CLONE 1376365-F
  misc_feature: Encodes the peptide sequence at SEQ ID NO. 14580
  misc_feature (534)..(534): n is a, c, t, g, unknown, or other
  misc_feature (569)..(569): n is a, c, t, g, unknown, or other
aagctggagctccccgcggtggcggccgctctagaactagtggatcccccgggctgcaggaattcgcacgagaccattacctagaacatcctaatcgaaaaattcgcaccaccgccgcgccgcccaaatcacagccaccgccgccatggccgcctccagccgccctctcgtctccgtgaaggccctggagggcgacatggtcacggacgcccccggcatcgccttgccgcccgtcttcggtgcgccgatccgcccggacgtggtccgcttcacccacaagctgctgtcctgcaacaagcgccagccttacgcagtctcccgccgcgctggccaccagacgtcggccgagtcctggggtacgggccgcgctgtgtcccgtatcccccgcgtccccggcggcggcacccaccgcgccggtcagggagcattcggcaacatgtgccgcggcggacgcatgttcgcgcccaccaagatctggcgcaagtggcaccgccgcgtcaacgtcaacctccgccgcgtcgccgtcgcctcggngctcgccgacactgccgtcccggtcctcgtccagntgagcggacagcgcatcgagaccgtcccagagatgcccctggtcatctctgactcggcggagtccatcgaagagaacctccaggggctccagatcttcaagcagggcggagcctaaaccgac

SEQ ID NO: 14580 - protein, 179 aa, Zea mays
  misc_feature: Ceres CLONE 1376365-F
  misc_feature (23)..(180): Pfam Name: Ribosomal_L4 Pfam Description: Ribosomal protein L4/L1 family
  misc_feature (130)..(130): Xaa is any aa, unknown, or other
  misc_feature (142)..(142): Xaa is any aa, unknown, or other
MAASSRPLVSVKALEGDMVTDAPGIALPPVFGAPIRPDVVRFTHKLLSCNKRQPYAVSRRAGHQTSAESWGTGRAVSRIPRVPGGGTHRAGQGAFGNMCRGGRMFAPTKIWRKWHRRVNVNLRRVAVASXLADTAVPVLVQXSGQRIETVPEMPLVISDSAESIEENLQGLQIFKQGGA

SEQ ID NO: 14581 - DNA, 720 bp, Zea mays
  misc_feature: Ceres CLONE 1376366-F
  misc_feature: Encodes the peptide sequence at SEQ ID NO. 14582
  misc_feature (485)..(485): n is a, c, t, g, unknown, or other
aagctggagctccccgcggtggcggccgctctagaactagtggatcccccgggctgcaggaattcgcacgagaccattacctagaacatcctaatcgaaaaattcttccttccttcttttcttcaccaatggccacgagaatagccttgtgtcttctcggccacgtcctcctcgccgtcgcgtctatggcagtggcggcggcggccggtgacgcgggcaagatcggcatctgccacggccgcgttggcagtaacctcccgccgccgtcggccgccgcggcactgctcaagcgtaacgggatcaccaaggcgcggctcttcctgccggacccggccgtgctcccggccttcgccgcggaggacatcgacctcatggtgggcgtgcccaacgagaacctcaccttcctggacgcggcggagcccgaggtcgcggcgcattggctgcggtccgcggtcctgagccacccccccgacgagcgcgcccgntgcctcgccgtcgtaaacgaggtgctgtaacacaacgcagtcaatgagcctcacctcgggccgggccatgcaggaactggacgccgcgctcgcggccctggggattggacggtaaagttaaaggtttcctcccgagaggctgtcctcggggatggccctcctctaaccccccccccccggggtggtataccaaggtctacctgaccgctaccgggctcctggttggcggatcctg

SEQ ID NO: 14582 - protein, 128 aa, Zea mays
  misc_feature: Ceres CLONE 1376366-F
  misc_feature: SWISSPROT Homolog: EC 3.2.1.39 Glucan endo-1,3-beta-D-glucosidase
MATRIALCLLGHVLLAVASMAVAAAAGDAGKIGICHGRVGSNLPPPSAAAALLKRNGITKARLFLPDPAVLPAFAAEDIDLMVGVPNENLTFLDAAEPEVAAHWLRSAVLSHPPDERARCLAVVNEVL

SEQ ID NO: 14583 - DNA, 773 bp, Zea mays
  misc_feature: Ceres CLONE 1376370-F
  misc_feature: Encodes the peptide sequence at SEQ ID NO. 14584
aagctggagctccccgcggtggcggccgctctagtactagtggatcccccgggctgcaggaattcgcacgagaccattacctagaacatcctaatcgaaaactccgtgctttctcagaggtgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagggccgtcgagggcatgaacggcaaggagctcgacggtcgcaacatcaccgttaacgaggcccagtcccgcggtggccgtggaggcggccgtggcggatacggtggtcggagccgttgtggaaggctgcctaccgccggggagtaggaggcttagggtgttggacctggtaggctacgggcggtggtcgggggattaggtgggtgcaatccgaggctggcgccttatggaaaaatccacgggaaactggagggaaactgtatcgcgggggcacccgattaaaggccttattttactttgggtcccttcgctgcaaccgtgttttacgcttagcttataagggccggtttattctttcgccctggcagggtccccctcttagatccggattcgtttttg

SEQ ID NO: 14584 - protein, 111 aa, Zea mays
  misc_feature: Ceres CLONE 1376370-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLNNAFSTYGEVLESKIILDRETQRSRGFGFVTFSTEDAMRRAVEGMNGKELDGRNITVNEAQSRGGRGGGRGGYGGRSRCGRLPTAGE

SEQ ID NO: 14585 - DNA, 730 bp, Zea mays
  misc_feature: Ceres CLONE 1376372-F
  misc_feature: Encodes the peptide sequence at SEQ ID NO. 14586
  misc_feature (645)..(645): n is a, c, t, g, unknown, or other
  misc_feature (655)..(655): n is a, c, t, g, unknown, or other
aagctggagctccccgcggtggcggccgccctatgactagagaagcgcacggcatgatccactacaaggggccgacttagctacaagatgctgaaggagaagacgctgttccctctgggcggactgctcctggtgctgtcgggcctggcgctggcggcctccacggtggggctggccctggccacgcccgtgttcctgctcttcagccccgtgctcgtccccgccgcgctgctcatcggcacggccgtcgcggggttcctcacgtcgggcgcgctggggctcggcggcctgtcctcgctcacgtgcctcgccaacacggcgcggcaggcgttccagcgcaccccggactacgtcgaggaggcgcgccgcaggatggcggatgccgcggcgcacgcggaccacaagaccgcgcaggccgggcacggcatccagagcaaggcgcacgaggccggtgctggcactggcgccggcggcggcaggacttcctcgtaaataagcaaatcatccatgtatgcgtgcgtgtcaatgtcagcagggtcgtcgtggaatgctcttctctgtacgagggaaccgtcttttggtcgtcgtccccgagtgcgtgataatatccctggtgtcgccgggtgtgggctgccctagctgggnctggagccgnctgtgtaccgtatctgttcatcgcgctccgtccgttggaaatgtaataactgagtggaggttaagtccagctcaa

SEQ ID NO: 14586 - protein, 134 aa, Zea mays
  misc_feature: Ceres CLONE 1376372-F
  misc_feature (1)..(114): Pfam Name: Oleosin Pfam Description: Oleosin
MLKEKTLFPLGGLLLVLSGLALAASTVGLALATPVFLLFSPVLVPAALLIGTAVAGFLTSGALGLGGLSSLTCLANTARQAFQRTPDYVEEARRRMADAAAHADHKTAQAGHGIQSKAHEAGAGTGAGGGRTSS

SEQ ID NO: 14587 - DNA, 759 bp, Zea mays
  misc_feature: Ceres CLONE 1376374-F
  misc_feature: Encodes the peptide sequence at SEQ ID NO. 14588
  misc_feature (486)..(486): n is a, c, t, g, unknown, or other
  misc_feature (666)..(666): n is a, c, t, g, unknown, or other
  misc_feature (682)..(682): n is a, c, t, g, unknown, or other
  misc_feature (687)..(687): n is a, c, t, g, unknown, or other
  misc_feature (709)..(709): n is a, c, t, g, unknown, or other
  misc_feature (739)..(739): n is a, c, t, g, unknown, or other
ggagctccccgcggtggcggccgctctagaactagtggatcccccgggctgcaggaattcgcacgagaccattacctagaacatcctaatcgaaaagatctatgccgccgcctctcctactgcatttccctcggtctcgtcgactagttcgattcgactccgacccgatacgcccctagtagagcgcatccctatccgtagctggtatgacggacgcgaagtagcagaagtagcagcagctgcttcagccatatcaggggtcagtcgaaaccaccggcgtgtgtaagatggtaaagtgcttcgttaactgcgtggcctctgggacgatcgcgacctgcggcgtccagcctatggacctgttccaggcgacgaatggaagatgggttgagggctctgctgggcaggtcacaaggaacattattgcaagaggagggggggccggtaaccttgttcctaaggatttctcccccggccttcgcccgggtnagaccacggtgaccaactggttcgcccttggatctgtttaggggtccttcccctaacagaggccgttgtcaaaaggaaatggaaggggggaggccttttgcccccttgttttcggaaaagccttttttttttgagggagaaaagcggcgcccgaaaaacaaagtgtgggccccggggggncggtcctaaacagatnatggnggggtgctctctcccccagggnggaccgtttcacccatggacgccggcggcnggcgcggtagatcggcgctg

SEQ ID NO: 14588 - protein, 79 aa, Zea mays
  misc_feature: Ceres CLONE 1376374-F
  misc_feature (67)..(67): Xaa is any aa, unknown, or other
MVKCFVNCVASGTIATCGVQPMDLFQATNGRWVEGSAGQVTRNIIARGGGAGNLVPKDFSPGLRPGXTTVTNWFALGSV

SEQ ID NO: 14589 - DNA, 719 bp, Zea mays
  misc_feature: Ceres CLONE 1376376-F
  misc_feature: Encodes the peptide sequence at SEQ ID NO. 14590
  misc_feature (504)..(504): n is a, c, t, g, unknown, or other
  misc_feature (585)..(585): n is a, c, t, g, unknown, or other
  misc_feature (614)..(614): n is a, c, t, g, unknown, or other
  misc_feature (656)..(656): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcgaaaaattccccacacgcgcccacctcctctgctctctcctctcccccacctctgcgtccgtgcgttgtgtttgtttaggcggcaaccgcgaggcgcaatggcgtccgggcgagagctggtggtgagtttcggcgagatgttgatagacttcgtgcccaccgtggcggaggtctcgctggcggaggcgccggccttcctcaaggcgcccgggggcgcgcccgccaacgtcgccatcgcggtctcgcgcctcggcggcggggccgcctttgtcggcaagctcggcgacgacgagttcagccgcatgctcgccgccatcctccgcgacaacggcgtcgacaacagcggcgtcttcttcgactccggcgcgcgcaccgcgctcaccatcgtcaccctgcgcgccgacggngagcgcgagttcatgttctaccgcaaccccagtgctgacatgctcctcaccgccgacgagctcaacgtcgagctcatcagnaagggctgcggtcttgcactacggatcantaaagctagattgctgagccttgccggacgcacatctcgtgnccaagnagattgccaaggagcaggtgcactgctctctatgaccaaacctgagggagcactatg

SEQ ID NO: 14590 - protein, 174 aa, Zea mays
  misc_feature: Ceres CLONE 1376376-F
  misc_feature: SWISSPROT Homolog: EC 2.7.1.4 Fructokinase
  misc_feature (130)..(130): Xaa is any aa, unknown, or other
  misc_feature (140)..(140): Xaa is any aa, unknown, or other
  misc_feature (154)..(154): Xaa is any aa, unknown, or other
  misc_feature (156)..(156): Xaa is any aa, unknown, or other
MASGRELVVSFGEMLIDFVPTVAEVSLAEAPAFLKAPGGAPANVAIAVSRLGGGAAFVGKLGDDEFSRMLAAILRDNGVDNSGVFFDSGARTALTIVTLRADGEREFMFYRNPSADMLLTADELNVELIXKGCGLALRIXKARLLSLAGRTSRXQXDCQGAGALLSMTKPEGAL

SEQ ID NO: 14591 - DNA, 771 bp, Zea mays
  misc_feature: Ceres CLONE 1376377-F
  misc_feature: Encodes the peptide sequence at SEQ ID NO. 14592
  misc_feature (663)..(663): n is a, c, t, g, unknown, or other
tggagctccccgcggtggcggccgctctagaactagtggatcccccgggctgcaggaattcgcacgagaccattacctagaacatcctaatcgaaaaaactcccccggccgtcctgctcgccggcttctggctggcccctgcatccgcccagtgtgtgtgacctcagggaatcgattcgttcatccaagtgaaggcaaccagactccaggatggagttcaaagccggcgttttcaccgtggcaatgctagacatcgtcgtgctctccacaccagcagccccgcagaagcccaagagccctcccgctccgcgatccccagtcgtcctggggccggcgccagcgcccgcaccggcggcgccgcaccacgtgtacctcgcggacctcctcagcgtggccgggccgttccacacgttcctgtactacctgcagaagaccggcgtcatcgagaccttccagagccaggcgaacgacacgaagcggcgcggaatcaccgtcttcgtggccaaggactcggccgttcgccggcgctaaaacaaaccacgtttccccaaccctcccccaggacccagcctacaggcccctgcttgcttgtggccacgcgctgcccaaagtaactactccgctgggccgcatttccaacccggtttggaccgcgcctccggncccggatgtcccaccccttcgctcggggttctctaagaacacgttttgaaaccctctcccttaacgaacatgggggcaaccggatcccggggatggaatgttccttgg

SEQ ID NO: 14592 - protein, 106 aa, Zea mays
  misc_feature: Ceres CLONE 1376377-F
MEFKAGVFTVAMLDIVVLSTPAAPQKPKSPPAPRSPVVLGPAPAPAPAAPHHVYLADLLSVAGPFHTFLYYLQKTGVIETFQSQANDTKRRGITVFVAKDSAVRRR

SEQ ID NO: 14593 - DNA, 749 bp, Zea mays
  misc_feature: Ceres CLONE 1376378-F
aagctggagctccccgcggtggcggccgctctagaactagtggatcccccgggctgcaggaattcgcacgagaccattacctagaacatcctaatcgaaaaatcgatccagtgcaaacaagctcgctcgcaagcgcaacccacccacgtctacggtctaccacacgaagcatcgtagccagccagccagctaaacccacaccacacatggccgggatcggggtgggagttcgacttcgacaagacgatcatccacgtggacggcgacaactggaatggtggacagcctcggcctcaacgacctggttaaagcgcctcctccccaccaaggccctggaaaccgcttcatggacaccaatgatgggggaaacttccaccccccggggcagggacccttggccaaaagtgaccaaaggggtttaaggggggcccccattaaaccccccggggccccccgcctatggggccggggaagcccctggttgggactgggggggggtaaaaaaacaaaagcttttttttccaaaacaggggggaaacaaagggggggggcgcctggttttccccgggaaaaaccaccccccgggcggtaaaatcccagagggaaattcccctttggggcgctaaaaaaaacccggggggggggccaaagaggtgtggtcctataaaagcgcccccccaaaaaaaaggagagggggcctctgaggaaaaaccaccccccccgagggggggggggggggtgggggtcta

SEQ ID NO: 14594 - DNA, 719 bp, Zea mays
  misc_feature: Ceres CLONE 1376383-F
  misc_feature: Translation starting site: 247
  misc_feature: SWISSPROT Homolog: EC 1.1.1.1 Alcohol dehydrogenase
  misc_feature (258)..(258): n is a, c, t, g, unknown, or other
  misc_feature (363)..(363): n is a, c, t, g, unknown, or other
  misc_feature (364)..(364): n is a, c, t, g, unknown, or other
  misc_feature (368)..(368): n is a, c, t, g, unknown, or other
  misc_feature (412)..(412): n is a, c, t, g, unknown, or other
  misc_feature (422)..(422): n is a, c, t, g, unknown, or other
  misc_feature (430)..(430): n is a, c, t, g, unknown, or other
  misc_feature (432)..(432): n is a, c, t, g, unknown, or other
ggagctccccgcggtggcggccgctctagaactagtggatcccccgggctgcaggaattcgcacgagaccattacctagaacatcctaatcaaaaaacaggctcatctcgctttggatcgattggtttcgtaactggtgagggactgagggtctcggagtggattgatttgggattctgttcgaagatttgcggaggggggcaatggcgaccgcggggaagtgatcaagtgcaaagctgcggtggcatgggaggccgncaagcactgtcgatcgaggaggtggaggtagcgcctccgcagttcatggaggtgcgcgtcaaagatctctttcactcgctctgccacaccgacgtctacttctgnngagncaagactcccccgtgtccctcggatcttttggcacgaggctggnagtatcatanagagtgtngnagaaggtgtgactgacgtagctccgggcgacccatgtcctttcctgtgttcactggggaagtgcagggagtgtgcccactgcaggtccgcagagaacaacatgtgtgatctgctcaggatcaacacccaccggggttggatgattgcccaatggcaatcccggttttcaatcatgggaaacctaattaccacttttgtgggacttccaccttcagcgagtacacgtcatggcatggggttgggtttgacaaatcaaccctcagctcccccttgaaagagttgcgcct

SEQ ID NO: 14595 - DNA, 736 bp, Zea mays
  misc_feature: Ceres CLONE 1376384-F
  misc_feature: Encodes the peptide sequence at SEQ ID NO. 14596
aaagctggagctccccgcggtggcggccgctctataactagtggatcccccgggctgcaggaattcgcacgagaccattacctagaacatcctaatcgaaaaatcacctataatattttgagcattcacaaacacaccaagcgaagcacattatcaacaacctaacaacaatgggtaccaagatattatccctccttgcgcttcttgcgctttttgcgagcgcaacaaatgcgttcattattccacaatgctcacttgctccaagttccattattacacagttcctcccaccagttacttcaatgggcttctaacacccatctgtgaaagcctatacgctacaacaagcaatagcgtcgagcgtattacaacaaccaatttcccagttgaaacaacaatccttggcacatctaacaatacaaaccatcgcaacgcaacagcaacaacaattcctaccagcactgactcacctatccatggtgaaccctgccgcctacttgcaacagcagttgcttgcatcagacccacttgctctggcaaacgtatttgcaaaccagccacaacaacagctgcgacagtttctgccagcgctcagtcaactagccatgttgaaccctgtcgtctacctacaacagcaacaactgctatcatctagcccgctcgctgtggccaatgcacctacatacctgcaacaacaattgttgcaacagattgtaccagctctgactcagctagg

SEQ ID NO: 14596 - protein, 86 aa, Zea mays
  misc_feature: Ceres CLONE 1376384-F
MVNPAAYLQQQLLASDPLALANVFANQPQQQLRQFLPALSQLAMLNPVVYLQQQQLLSSSPLAVANAPTYLQQQLLQQIVPALTQL

SEQ ID NO: 14597 - DNA, 730 bp, Zea mays
  misc_feature: Ceres CLONE 1376385-F
atagctggagctccccgcggtggcggccgctctagaactagtggatcccccgggctgcaggaattcgcacgagaccattacctaaaacttcctaatcgaaaaaccgagcttcgacgaccatttcgctaccgccagcgccgatgtgattactgctctctccgacaggggcagtgggacgtccctaccaggactgaaccatgggcggcggcgcgatccttgccaaccttcgcgagccgtcgcctctgcggctcacagagtagctacacctgacaacagaaaaagaagctcaagagtcgcgacagagataggaaggcgctctattctcggtgagatgacgatgaggactacgaggccgactttgaggtcttcgaggccgactcctgcggttgatatttctagctcagggagtcgactgactacgatcctcgcgatatcaagcccttcactgccacgaggactatatccagtaatgcgttatgcaccgtgactagtgctggatctagttcctcaagatcgacatactgaatctatacgggggtatccgcccaccgcccttgggcaagtgccatgttgacatctgagatcctcagaggctgttcccgtttgctttgctaccttcatagcccggaggaaactgcactagttatgatgccggactgcaagggatcccgtcagaaggcccgggtatgttcctgatggacaggaggcgtcaaaataccgtcccgttcag

SEQ ID NO: 14598 - DNA, 683 bp, Zea mays
  misc_feature: Ceres CLONE 1376386-F
  misc_feature: Encodes the peptide sequence at SEQ ID NO. 14599
  misc_feature (535)..(535): n is a, c, t, g, unknown, or other
aaagctggagctccccgcggtggcggccgctctagaactagtggatcccccgggctgcaggaattcgcaagagaccattacctagaacatcctaatcgaaaagcactcatccattccatcatcccctttgcaagtatagtctctctgctaagcgaagcgaagcttcaagctagtctcggcggctctagaagacgatgggcaagaacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcgggcggatgatcttcgtcctcgtctactgcaccgccggcatctcggggggccacatcaaccccgncgtcaccttcggactcttcctggcgcgcaaggtctccctggtgcgcgcgctgctctacatcgtgggcgcagtgcctcgggggcatcctgcggcgtcggcctccgtcaaggcgttccagagcgcctactcccaacgggtacggggggcg

SEQ ID NO: 14599 - protein, 163 aa, Zea mays
  misc_feature: Ceres CLONE 1376386-F
  misc_feature (34)..(163): Pfam Name: MIP Pfam Description: Major intrinsic protein
  misc_feature (114)..(114): Xaa is any aa, unknown, or other
MGKNDVIESGAGGGEFAAKDYTDPPPAPLIDAAELGSWSLYRAVIAEFIATLLFLYITVATVIGYKHQTDASASGADAACGGVGVLGIAWAFGRMIFVLVYCTAGISGGHINPXVTFGLFLARKVSLVRALLYIVGAVPRGHPAASASVKAFQSAYSQRVRGA

SEQ ID NO: 14600 - DNA, 738 bp, Zea mays
  misc_feature: Ceres CLONE 1376393-F
  misc_feature: Encodes the peptide sequence at SEQ ID NO. 14601
tggagctccccgcggtggcggccgctctagaactagtggatcccccgggctgcaggaattcgcacgagaccattacctagaacatcctaatcgaaaaatcggctcttctcgctttggatcgattggtttcgtaactggtgcgggactgaggctctcggagtggattgatttgccattctgctcaaatatttgcggaggcggctaatgccgctcgcggcgaaggtgatcaagtgcttcgctcgcgctgccatgggaggtcggcatgtcactgccaatgctggaggtggaggtaccgcctccgcaggacatgcaggtgcgcgtcatgatcctcttcacctcgctctgccacaccgacgtctacttctgataggacaaggggcagactctcgtgtcccctcgaatcttgtgacacgatgctggagctttcatacagagtgctggagaggatgtgactgacgtagctccggtcgaccatgcccttcctgtgtgcactgctgagcgaaagcactgtgcccactgcaaatcccctgagagcaaaatgtgtgatctggtcaggaccaacaccgaccgcgttgtgctgattgcccatggcaaccgcgtcttgcactcattggagaacctatctaccgcttttgtgggaactccttcctaaacccagggcaccgtcttgcatttggatttgtgtgaaaagataaaaccctcaggcttcccttggtaaaattttgccgaccctagctg

SEQ ID NO: 14601 - protein, 34 aa, Zea mays
  misc_feature: Ceres CLONE 1376393-F
  misc_feature: SWISSPROT Homolog: EC 1.1.1.1 Alcohol dehydrogenase
MSLPMLEVEVPPPQDMQVRVMILFTSLCHTDVYF

SEQ ID NO: 14602 - DNA, 719 bp, Zea mays
  misc_feature: Ceres CLONE 1376394-F
  misc_feature: Encodes the peptide sequence at SEQ ID NO. 14603
  misc_feature (574)..(574): n is a, c, t, g, unknown, or other
  misc_feature (668)..(668): n is a, c, t, g, unknown, or other
tggagctccccgcggtggcggccgctctagaactagtggatcccccgggctgcaggaattcgcacgagaccattacctagaacatcctaatcgaaaattcgggatcgggacgcggagaggggaaaggcgagtcgtcgactcgtcgtccgggcagcttccctccctctcctctccgcccccgcttacctaggccggccccgcctacgcccccctcccgccgccgcacgatgagcacttctcccgccgccgccgacgtttcgcctttgccgcctactgctgccgccgacgaggccgcgcgggcgacagagacggtggtggtcgatgagagggtcgcctcacacgtggacccgttcctcgtcgaggcgctcgacaaccctcgccaccgtctcatggttctacggatggaactggatatacaaaactttatgcagaaccctcagctgcaggagtttgaattccagaactttccgacttcttacctccgctgtgctgctcatcgtgttgcacaacattatggcttagagactatagtagcagatagtttagtagaaggctcagttagcaggattgttgncagaaaacagcagaaagcaggtatcctggcatttttttatcagaaagtcccctagcatcagcaagaaatgatcatgaaacagctgagaagcttnaagttgtcatttatcaaaggcccaaagcattccaaaatggaagcgctgatt

SEQ ID NO: 14603 - protein, 133 aa, Zea mays
  misc_feature: Ceres CLONE 1376394-F
  misc_feature (116)..(116): Xaa is any aa, unknown, or other
MSTSPAAADVSPLPPTAAADEAARATETVVVDERVASHVDPFLVEALDNPRHRLMVLRMELDIQNFMQNPQLQEFEFQNFPTSYLRCAAHRVAQHYGLETIVADSLVEGSVSRIVXRKQQKAGILAFFYQKVP

SEQ ID NO: 14604 - DNA, 705 bp, Zea mays
  misc_feature: Ceres CLONE 1376395-F
  misc_feature: Translation starting site: 190
tggagctccccgcggtggcggccgctctagaactagtggatcccccgggctgcaggaattcgcacgagaccattacctagaacatcctaatcgaaaaatactcatccttttcatcatcccctttgcaagtgtagtctctctggtaagcgaagccacggttcacgccattctcgtggtttctagaggacgatggggaagaacgacctgatcaagagcgacgctgccgccggtgagttcgctgcgaaggactacagaaaccctcccccggcgacgattatcgacgtggagaagctgcggtcctggtcgctgaactgcgccgcgatcgccgagatcatcgccacaatgctgttcctgtacatcatggtgccaacggtgatgcgttaccagcccacacgtacgcgtcggcgtcgcctgcccatgcggtgcgtggcggtgtgggtgtgctgcgattcgcctgcgacttcggcggtgtgatcttcgtccacgtctactgagacggcggtatcgcgggcgacgacatcagccccgcgggcatctgcgacctcttcctgtggcgcaaggtctctgtgagaggcgcgctgctctacgtcgcggcggagaggcttcggtccatctgcgttaaaggcctcctttggtggtgccaaacggcctacttcaaacggttacggacgtggccccacctctgttcacctccgtttaatcccg

SEQ ID NO: 14605 - DNA, 609 bp, Zea mays
  misc_feature: Ceres CLONE 1376419-F
  misc_feature: Encodes the peptide sequence at SEQ ID NO. 14606
ggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccaggtcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctcatgatcttcctctgcctcctcgctgcgccgtgccccgcggggcgggcaggacggtttgcgatgaacgccaccgcgccgacgagcgtccaaatgccatgcgctctgatcctaccgccgcccaaagagaagccagtaccagcctgttcggagtaggaggagtaatacctggtggcacccccaggtccctcccgatggccatggtgatggagtatacatgccggcca

SEQ ID NO: 14606 - protein, 62 aa, Zea mays
  misc_feature: Ceres CLONE 1376419-F
MAPLPASLTPCLMIFLCLLAAPCPAGRAGRFAMNATAPTSVQMPCALILPPPKEKPVPACSE

SEQ ID NO: 14607 - DNA, 651 bp, Zea mays
  misc_feature: Ceres CLONE 1376430-F
  misc_feature: Encodes the peptide sequence at SEQ ID NO. 14608
  misc_feature (651)..(651): n is a, c, t, g, unknown, or other
cgcggtggcggccgctctagaactagtggatcccccgggctgcaggaattcgcacgagaccattacctagaacatcctaatcaaaaaacccaggacgaggcccagggaggatcctcccgactccgacgctgcgtaggactccccgactccgacggcgtccgcccgcgtcgcgtgccacgcccacgccacgccggccgccgcgaggaaagaacaccgggtacttccccttcccttacgctccagtttcacaagtcgcgagccgtgcgtcgcgtcgacgcgagttccgcgtgagggagcaggcagttgcagttggaggcggtgacgaaaccctaggacttgagctccagcgcacggctcgggtcctcctcaccgttcccggcgatggaccggcggcaggagctctgcaggaacttccagcgcggcagctgccagtacggatcgcactgcaggtttgtgcacgccctctctcagaagcagcaggaggcgaagcccaaccccggttggggtccggcttaagggggaaggcgcgcgcaacacggcgcagtctttcggttccgggggggaagttccccgcccgcggacgaggcaccgaaaagccccaaccccctttgggtttgggggggggcaggggccggcggggttggccccacn

SEQ ID NO: 14608 - protein, 44 aa, Zea mays
  misc_feature: Ceres CLONE 1376430-F
  misc_feature (3)..(28): Pfam Name: zf-CCCH Pfam Description: Zinc finger C-x8-C-x5-C-x3-H type (and similar)
MDRRQELCRNFQRGSCQYGSHCRFVHALSQKQQEAKPNPGWGPA

SEQ ID NO: 14609 - DNA, 672 bp, Zea mays
  misc_feature: Ceres CLONE 1376433-F
  misc_feature: Encodes the peptide sequence at SEQ ID NO. 14610
  misc_feature (460)..(460): n is a, c, t, g, unknown, or other
tccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggntccgggacgaaggagttcatggaagcccttgctgccggcgctgatgtgtccatgattggccagttcgggcgtcggtttctactctgcctacctcgtcgcccgataggagttgtcgtgaccaccaagcacaacgatgacgagcagtaacggtgtgggagtcccaagggggggcggggtccgttcactgttactcggtggacacgtcaggggga

SEQ ID NO: 14610 - protein, 114 aa, Zea mays
  misc_feature: Ceres CLONE 1376433-F
  misc_feature (101)..(101): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLVNNLGTIARXRDEGVHGSPCCRR

SEQ ID NO: 14611 - DNA, 665 bp, Zea mays
  misc_feature: Ceres CLONE 1376436-F
  misc_feature: Encodes the peptide sequence at SEQ ID NO. 14612
cgcggtggcggccgctctagaactagtggatcccccgggctgcaggaattcgcacgagaccattacctagaacatcctaatcgaaaagttgtttgttttaatataatcttcgtttacctctctctttctctctctgtgtgtgtgtgtgtgcaggaaaaagaagggagctgtgctaaaatttcttggaggggagggggtagatgacgtttggtagcgccgacatggaggccggcggcggcgagcaccgccacgcacaacaggaggaacagtcatcatccgacgagcggcgcgcgcggttcgcggaggactggggctgctgcgcctgcgcctgcgcggggttattcctggggcccaacccgatggtggcgcgctacctgtacgcgctcatcttcctcggcaccaacctcctcgtctggacggtccgcgaatacggcgaatccgcgcccgccgagctggagggcctggaggtcggccagggggcgcgctaatgcctgggcgggggagggggggcggggaacaagccccggtgggtacgtcttctttcttgggaggggccggggcccccgggaaacgagggaagggggaaaacgccccaaatcgggggccccccggggggggggggacgggagggggaggagagctggacgccccgggccgcagcaaca

SEQ ID NO: 14612 - protein, 95 aa, Zea mays
  misc_feature: Ceres CLONE 1376436-F
MTFGSADMEAGGGEHRHAQQEEQSSSDERRARFAEDWGCCACACAGLFLGPNPMVARYLYALIFLGTNLLVWTVREYGESAPAELEGLEVGQGAR

SEQ ID NO: 14613 - DNA, 2238 bp, Zea mays
  misc_feature: Ceres CLONE 1376443
  misc_feature: Encodes the peptide sequence at SEQ ID NO. 14614
aaggcttcgttctgctctccggctctcccgcatccaccccgtctcatccccaatccgaccacctcatccctcgcctccatggccctacccctcgcgtcaccggcgggggcatgagccggtgactgctcacgcggcctcgtctgtctgcgcacgcgcgcggggtcggcgagtgagcattgcggcggtccgcgatcgcccgtgggggagcatggcgtcggcggcggggtcggccggcggggccggcgcggggtctggcgggctgaagacctacttcaagacccccgaggggcggcacaagctgcagtatgagaagacgcactcccccgccgtcgtgcactacagccacagcggcaagaccgtctcccagatgacagtggcatatttgaaggagaagccagcaggccagggttccacgccttcaacaccaagtgctggtagtgggatgcggtctgcagctgcaagacttctcggcactgggaatgggagccgggcacttagcttcgggagcaatggtaccagcagggctgtctcaggaagcagccgcatgggtggaggaattggtgtgtcgactagtgcaagtggatcgcaaggcatggcaaactatgatggaaagggcgcgtacatcatatttaatactgcagatacactcttcatcagtgatctcaactcacatgacaaagatccaataaagtccatccacttcagtagctcaaacccgctttgccatgcatttgacccagaggccaaggatgggcacgatctgcttgttggggtgttctcaggagatgtctattcaatgtcactgaggcagcagctgcaagatcctggaaagaagcccgtttcatatcagcattttgttaatagagacaaagataaagacaaagatccaagtcaaggtggcgctgccagcagtcggagcacttgtgttgcatgggttccagagcgtgaaggaatttttgttgttagtcatgctgatgggaatctgtacgtgtatgacaaatgcaaggatggaaatactgattggacatttccaactgtaaaggatcaaagtcaggtgctgatttcacatgcaaagtcgagtaagagcaatccaattgcaaggtggcacatctgtcaaggtgcaatcaatgacatttccttttcaccggatggtgcttacttggcaactgttgggcgtgatggccatttaagagtatttgactttgctaaagaacaactaatatttggtgggaaaagttactacggtgcactgttgtgttgctcttggagtgcggatggcaaatatttgttatcaggtggtgaagatgatcttgtgcaagtatggagcatggatgatagaaagatagttgcatggggtgaagggcataattcatgggttagtgcagtttcttttgatccgtattggtccccaccaaattctgatgaaacggaagaaaatgtcatgtatcgctttgggtcaattggacaggatacccaactgcttctctgggatctggcattggaagagattgctgtccctctacgccatccgtctggtggctcaccgacattcagtagtggaagcccatctgcacagtgggataatgcgtgccctccagccggtgttctacagccttctccacggatgcgagatgtgccaaagctctcacctctcgttgcacaccgggtacatgtagatcccctatccggcctggaattcactagtgaatcaatcctcactatatgccgcgaggggctgataaaaatttgggcccgacccatccatagcgaaagcaaccagcagccggattcttctgaacaggttgtaggcaatgccactgctaaggataagatgttaacatcgtcaaataaagcaggtgcttccagccccagcttcaagcaaccaccacctgttcttttcacataattgaagaggctttgctagcatttttgttatgcttgcttggccatggctattcatctatctttagtcactaacatgaggttaaatggagcggaataacttggggaggctggcacggaaggcttgaagaggctttgctagcatttttgctagacattttcttttcctgcttcatcggcgacgtcttagttacagaagtgtcattgttgccatcgatgttggcaaaagaaaataacggaacttgctcctgtacatatacagacattgctgtaagatgaaatattacaagcttactggtttgatatttttttgttcttttaaaaaaaaaaaaaaaa

SEQ ID NO: 14614 - protein, 565 aa, Zea mays
  misc_feature: Ceres CLONE 1376443
  misc_feature (293)..(331): Pfam Name: WD40 Pfam Description: WD domain, G-beta repeat
  misc_feature (335)..(373): Pfam Name: WD40 Pfam Description: WD domain, G-beta repeat
  misc_feature: SWISSPROT Homolog: EC 2.3.1.48 Histone acetyltransferase
MASAAGSAGGAGAGSGGLKTYFKTPEGRHKLQYEKTHSPAVVHYSHSGKTVSQMTVAYLKEKPAGQGSTPSTPSAGSGMRSAAARLLGTGNGSRALSFGSNGTSRAVSGSSRMGGGIGVSTSASGSQGMANYDGKGAYIIFNTADTLFISDLNSHDKDPIKSIHFSSSNPLCHAFDPEAKDGHDLLVGVFSGDVYSMSLRQQLQDPGKKPVSYQHFVNRDKDKDKDPSQGGAASSRSTCVAWVPEREGIFVVSHADGNLYVYDKCKDGNTDWTFPTVKDQSQVLISHAKSSKSNPIARWHICQGAINDISFSPDGAYLATVGRDGHLRVFDFAKEQLIFGGKSYYGALLCCSWSADGKYLLSGGEDDLVQVWSMDDRKIVAWGEGHNSWVSAVSFDPYWSPPNSDETEENVMYRFGSIGQDTQLLLWDLALEEIAVPLRHPSGGSPTFSSGSPSAQWDNACPPAGVLQPSPRMRDVPKLSPLVAHRVHVDPLSGLEFTSESILTICREGLIKIWARPIHSESNQQPDSSEQVVGNATAKDKMLTSSNKAGASSPSFKQPPPVLFT

SEQ ID NO: 14615 - DNA, 605 bp, Zea mays
  misc_feature: Ceres CLONE 1376446-F
  misc_feature: Encodes the peptide sequence at SEQ ID NO. 14616
  misc_feature (470)..(470): n is a, c, t, g, unknown, or other
  misc_feature (471)..(471): n is a, c, t, g, unknown, or other
  misc_feature (565)..(565): n is a, c, t, g, unknown, or other
tccccgcggtggcggccgctctagaactagtggatcccccgggctgcaggaattcgcacgagaccattacctagaacatcctaatcggaaaaatatctttttctccccaagaaaaaaaaggcggcgagagcataagaagaaaaaaaacacacacacacacacacaaagcgcacttttcaaatcgacaaaggggaaaggttcgcttcttgtggcatcttgctttccttcgagtgccatggccgatccggcggaggagaacgttgtctcgccgccaccgacccctgcggccccagccgtgggcgcctcagacccgcccctgcagcctgctgctgacagcgcctcaacggagaaggtgtctgctccggcgccggaggtaaggtcccggggattcaggcttcttggagaggacacttccgtgcacaaatcccttgggggcggtaaaactgctgacgttctgttatggaaagacnnagaaacttctgctgttgtaaatagcgcgcactgggtcatctgggtcctggtcgaaatgcttgattacccactcctgaccctgatatccatgcanctgattggtgtgcttgcaccttaatcctgtgggccaagca

SEQ ID NO: 14616 - protein, 117 aa, Zea mays
  misc_feature: Ceres CLONE 1376446-F
  misc_feature (79)..(79): Xaa is any aa, unknown, or other
  misc_feature (110)..(110): Xaa is any aa, unknown, or other
MADPAEENVVSPPPTPAAPAVGASDPPLQPAADSASTEKVSAPAPEVRSRGFRLLGEDTSVHKSLGGGKTADVLLWKDXETSAVVNSAHWVIWVLVEMLDYPLLTLISMXLIGVLAP

SEQ ID NO: 14617 - DNA, 673 bp, Zea mays
  misc_feature: Ceres CLONE 1376454-F
  misc_feature: Encodes the peptide sequence at SEQ ID NO. 14618
tggagctccccgcggtggcggccgctctagaactagtggatcccccgggctgcaggaattcgcacgagaccattacctagaacatcctaatcaaaaaaccatcaccgcctcgtgtgcagcgtgctcgcccacctcctctgtcgacactcagggtactgacgcaccaccccgaagccctcccgccgcgctcgcagggtgttcgacccttcgcccgcgcgccctcacgacatgcctcctccgtctccgccgccgccaaggccgccgcggcgttcgcgcacaaggtccagaaggagctggccgcgccggcgcagcgccgcgcgggcttgacccgccggaccaagccggtgcagcgtgcgcgccgtcgcttcgcccgcgcgggccctgtcgtccaccgggctcggtgaagagcgcgatgaccatgcacggagaagatactgggcgcgggcgaaccgagagcgcaggagcaggaaggcgggggagaggaggggggccaaaaactaaccctccctcaaccccccaaataatagggagcacccgttgttttcggccccgcgccccactgcgccgcaggcacgctggcgcccatacgccccgcggtcgtgcgcgcgcctggcgtggggttctcccttcgactgagctatcacccaccatcacctagcccgtgccctaccag

SEQ ID NO: 14618 - protein, 81 aa, Zea mays
  misc_feature: Ceres CLONE 1376454-F
MTMHGEDTGRGRTESAGAGRRGRGGGPKTNPPSTPQIIGSTRCFRPRAPLRRRHAGAHTPRGRARAWRGVLPSTELSPTIT

SEQ ID NO: 14619 - DNA, 627 bp, Zea mays
  misc_feature: Ceres CLONE 1376458-F
  misc_feature: Encodes the peptide sequence at SEQ ID NO. 14620
  misc_feature (627)..(627): n is a, c, t, g, unknown, or other
ggagctccccgcggtggcggccgctctagaactagtggatcccccgggctgcaggaattcgcacgagaccattacctagaacatcctaatcgaaaacccgtcctcggtcctccatcagtagtaaccactcctcgtcgtctctctcgcggtctcgcctcctgcagctagcgctcgccagaaagggaaaccgcatctgctccagcctcccgtcccgtctcggcgccgccgcctgatcgaccagagcccagcgcggggcgtcgaggccgtacggggcgggtccggcgctcacatctgaggcgagtagcaagcgaagaacatgcagatgcaggtcggaggaggcgcgaccgacagcccgggcgctgcggcggcggcgggcgcggaggcgcctcgcccgacccgctacgagtcgcagaagcggcggaactggaacacgttcggtgagtacctgcgcaaccaccggccgccgctggagctggcgcggcgcatcggagcacacgtgctcgagttcctgagctacctcgaccagttcggaaagacctcggtccagcgcgccgggatgccccttcttcggtcatccgacgccgtccgcgccgtgcccgtgccaactgcgtcatgtactggatgaan

SEQ ID NO: 14620 - protein, 102 aa, Zea mays
  misc_feature: Ceres CLONE 1376458-F
  misc_feature (10)..(103): Pfam Name: DUF640 Pfam Description: Protein of unknown function (DUF640)
MQMQVGGGATDSPGAAAAAGAEAPRPTRYESQKRRNWNTFGEYLRNHRPPLELARRIGAHVLEFLSYLDQFGKTSVQRAGMPLLRSSDAVRAVPVPTASCTG

SEQ ID NO: 14621 - DNA, 636 bp, Zea mays
  misc_feature: Ceres CLONE 1376459-F
  misc_feature: Encodes the peptide sequence at SEQ ID NO. 14622
  misc_feature (471)..(471): n is a, c, t, g, unknown, or other
  misc_feature (495)..(495): n is a, c, t, g, unknown, or other
aaactggagctccccgcggtggcggccgctctagaactagtggatcccccgggctgcaggaattcgcacgagaccattacctagaacatcctaatcgaaaagggacaggacttccccttcacttcacctcgctcttcatcttcgtttctgctcgcaacctagctgcccctccggtcctccacctcccgtccccgtgcgcagaccatgcctcgcgcagccaccgaggccgtcgtccacggcgagggaggcacgatcaaagtaggcacaacgggcaccatcggctccctcatgacaagagaactggacgccgtcaaggtcgcgccgccgccaccggcagccgcgggcaacccgcgcctgaggcgccaccaaggctgtcctgtctcggtgccgtgcggagccgctactcctcggaagaccgtgctgaggaaaagctcctcggacatctccggcggcagcagggccgaccgcggnagcgccgaagatgcctgctgaagncccaggagggtctcccgggaggaacacgttcgactcgccgatgcttcgctcggacgggggtttttcgtggacgtcgggaccccgaagtggaggcagggcgaaaaaaaaaaagggggggcgtggtacggcgttccagatttt

SEQ ID NO: 14622 - protein, 95 aa, Zea mays
  misc_feature: Ceres CLONE 1376459-F
MPRAATEAVVHGEGGTIKVGTTGTIGSLMTRELDAVKVAPPPPAAAGNPRLRRHQGCPVSVPCGAATPRKTVLRKSSSDISGGSRADRGSAEDAC

SEQ ID NO: 14623 - DNA, 715 bp, Zea mays
  misc_feature: Ceres CLONE 1376468-F
  misc_feature: Encodes the peptide sequence at SEQ ID NO. 14624
tggagctccccgcggtggcggccgctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaaccctaaccgccgacggtggccatgatggccaccgagcccttgtccccggggaatctcgtcgaggacgtcgaaacactacccctggactcctcctccactctcgcggctacgacggacccgctgctccgcccacctcccccctcgtccaccttctctcccaccgccggtgagaaccatggcgcttttctggacgaggaggatgaggacgctgctggatgacttcacgactccgctggctccccgtgccgctacggccggcgaccgaagtccccgcgagcgcccccccgtggcctcgactggattcaatgtcctcccagtccaacgaaagtgacgcgcaaccccagcggcccgcggaagtcagggaccaccctcttcccgctctcggtcgggacccagggacatccgtacgcgcctgcagtcactcgattgcctctctccaccttggacccccaccttaccccggcgcgtcggaagaccgcccaagtatcgcg

SEQ ID NO: 14624 - protein, 65 aa, Zea mays
  misc_feature: Ceres CLONE 1376468-F
MMATEPLSPGNLVEDVETLPLDSSSTLAATTDPLLRPPPPSSTFSPTAGENHGAFLDEEDEDAAG

SEQ ID NO: 14625 - DNA, 677 bp, Zea mays
  misc_feature: Ceres CLONE 1376474-F
  misc_feature: Encodes the peptide sequence at SEQ ID NO. 14626
  misc_feature (460)..(460): n is a, c, t, g, unknown, or other
tggagctccccgcggtggcggccgctctagaactagtggatcccccgggctgcaggaattcgcacgagaccattacctagaacatcctaatcgaaaaattttcctggggctgctgcgccgcgcttctctctctcgccttctccctcttcgcggcgatccgggttccgctgcaacggcccctgtcgactgtcgtcttctcttctccctcacggcgctcgatccctccggattgccgcgtagcgggatcagtgattcagctggttgaacagaactagtaaagatgtcatcagaagggaacaaagatgtgcctaatgaagctttgtccgtggatctgtcatcgatttctggtgcaaagcgcaagcgtggccgcccaaggaaatatgagcatcctgcatatgaactaccacagaaggtacagcccctccaaagcgccccgcctcttcactgctcacaagatggnctcaagtatggccagccatacatcaggcggctatgcctcatgggtagttggtccgcacaacctaggaattcggttaatgcttctattcaaggtaattctggccaaggatgacgttctcggcaaggcattttgctggcaagctgaccaagaaacacccctgggttttccctcattacggtaaaagggaaggacaatcaggggctcccaagggatggcg

SEQ ID NO: 14626 - protein, 96 aa, Zea mays
  misc_feature: Ceres CLONE 1376474-F
MSSEGNKDVPNEALSVDLSSISGAKRKRGRPRKYEHPAYELPQKVQPLQSAPPLHCSQDGLKYGQPYIRRLCLMGSWSAQPRNSVNASIQGNSGQG

SEQ ID NO: 14627 - DNA, 718 bp, Zea mays
  misc_feature: Ceres CLONE 1376481-F
  misc_feature: Encodes the peptide sequence at SEQ ID NO. 14628
  misc_feature (315)..(315): n is a, c, t, g, unknown, or other
aaagctggagctccccgcggtggcggccgctctagaactagtggatcccccgggctgcaggaattcgcacgagaccattacctagaacatcctaaaaaaaaaccaaaacctccactcttcctcccaccaaggcaccaacccgacgcaaagccgccggctttccccgatggcgacgacgatgtcagtttcggcggtgtccccgcccgccgcggctgtcacgcggccccggacgatggtctgcgtgccggcgacggcgcgggcgccgcgggagatggcggctaagctggccgcagccgccgcgctcggcgccgacgnggcagagcttcgactctactgcctcggcgtcttcgcgccgactggcgaacccgtgcgtggtcctcgctcagccatctatcttccttagacgatgctccattacagttgactattgctgcagattgatgagagtgcgatgggatttccaataatttgaatggagtgtgtggagaaaaggtactcggacagatcgcaagaccacaagctcccctctgcactctaataaggacgcataacaacactaatctgcaactatatgttgttacattctccatctacaattcttttctaccataatttatcttcttgaaaccaatgtcgggagggcagctgacctcccggggtttgttacttcactcatttcatccccctctattattccccctattatagcaatgtcgtc

SEQ ID NO: 14628 - protein, 78 aa, Zea mays
  misc_feature: Ceres CLONE 1376481-F
  misc_feature (50)..(50): Xaa is any aa, unknown, or other
MATTMSVSAVSPPAAAVTRPRTMVCVPATARAPREMAAKLAAAAALGADXAELRLYCLGVFAPTGEPVRGPRSAIYLP

SEQ ID NO: 14629 - DNA, 666 bp, Zea mays
  misc_feature: Ceres CLONE 1376485-F
  misc_feature: Encodes the peptide sequence at SEQ ID NO. 14630
  misc_feature (477)..(477): n is a, c, t, g, unknown, or other
ggagctccccgcggtggcggccgctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaacctaaccggccgacggtggccatgatggccaccgagcccttgtccccggggaatctcgtcgaggacgtcgaaacactacccctggactcctcctccactctcgcggctacgacggacccgctgctccgcccacctcccccctcgtccaccttctctcccaccgccggtgagaaccatggcgcttttctggacgaggaggatgaggacgtggtggatgacttcacgcctccgctggctccccatgccgctacggncgcgacgaagtcccgcgaggcgtccccgtggttcgctgagaccactgtctcccagcctaggaagcacgcggcatccccgaccggaagacgtgttcggcattccccggctcgggccagctaactcctacaatctcatcgccacgcaggggccgagagggggcgattcccgcgcgcgccaccgaacccaag

SEQ ID NO: 14630 - protein, 117 aa, Zea mays
  misc_feature: Ceres CLONE 1376485-F
  misc_feature (78)..(78): Xaa is any aa, unknown, or other
MMATEPLSPGNLVEDVETLPLDSSSTLAATTDPLLRPPPPSSTFSPTAGENHGAFLDEEDEDVVDDFTPPLAPHAATXATKSREASPWFAETTVSQPRKHAASPTGRRVRHSPARAS

SEQ ID NO: 14631 - DNA, 676 bp, Zea mays
  misc_feature: Ceres CLONE 1376487-F
  misc_feature: Encodes the peptide sequence at SEQ ID NO. 14632
  misc_feature (374)..(374): n is a, c, t, g, unknown, or other
  misc_feature (415)..(415): n is a, c, t, g, unknown, or other
  misc_feature (418)..(418): n is a, c, t, g, unknown, or other
  misc_feature (420)..(420): n is a, c, t, g, unknown, or other
  misc_feature (430)..(430): n is a, c, t, g, unknown, or other
  misc_feature (475)..(475): n is a, c, t, g, unknown, or other
tccccgcggtggcggccgctctagaactagtggatcccccgggctgcaggaattcgcacgagaccattacctagaacatcctaatcgaaaaataggacgaactaccgatgcaagctgcgatcgatcagtcaccgcatctccggttccgcgcaggcatggacgacaagtcctgctacgtggccaccggcctctccctggcggccatcctcctcgtcctccaccgcctcgtggtccgtgctggcggcaaggggaacgccgccgcgcggcggctgcctcctagccctcccgccgtcccgttcctcgggcacctccacctgctagcatcggagtgccctctccactcgtcgctggcccgcctcgcggcgcgccacggncccgtgctctcgctgcgcctgggctcccgcgccgccggggnggngncgccgccggngggccccccgcgccgcctccctgcgcgccccgtggctgccgcccncctgcccgggctgggctcccttgccgctgtcctccctgcggtggtttgctgtcggtcctggcggggcggccgccctgcggggggccgtcgtggggtgtgcgccggctgtggcgggccccttccgctgcgcgcgctgtcgctctccggtgggggcgcgcgccggtcgcgcccggggccgccttcgctcgcccgccctccccg

SEQ ID NO: 14632 - protein, 173 aa, Zea mays
  misc_feature: Ceres CLONE 1376487-F
  misc_feature (87)..(87): Xaa is any aa, unknown, or other
  misc_feature (88)..(88): Xaa is any aa, unknown, or other
  misc_feature (89)..(89): Xaa is any aa, unknown, or other
  misc_feature (92)..(92): Xaa is any aa, unknown, or other
  misc_feature (107)..(107): Xaa is any aa, unknown, or other
MDDKSCYVATGLSLAAILLVLHRLVVRAGGKGNAAARRLPPSPPAVPFLGHLHLLASECPLHSSLARLAARHGPVLSLRLGSRAAGXXXPPXGPPRRLPARPVAAAXLPGLGSLAAVLPAVVCCRSWRGGRPAGGRRGVCAGCGGPLPLRALSLSGGGARRSRPGPPSLARPP

SEQ ID NO: 14633 - DNA, 706 bp, Zea mays
  misc_feature: Ceres CLONE 1376499-F
  misc_feature: Encodes the peptide sequence at SEQ ID NO. 14634
  misc_feature (359)..(359): n is a, c, t, g, unknown, or other
gctctagaactagtggatcccccgggctgcaggaattcgcacgagaccattacctagaacatcctaatcgaaaagatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtcctgactacgggagtgggcggcggaggcggcgctccctcgaccatcgcggccatcgtcacctcactcggcggagcccttgcagcggntggggaaaccgtgcgggatctccggccccgaggggcgtcggccgtcgcccgaaccgcggttttccgccccagccggggacccagggagggcggttcaaggccggtgggcaacccgcgcagcccccttttgggtggaggtacgggactcccggcttcgaagcggtaacggcaggggtaatttgggcggagggttttgtggggggggctcaatgcgtccggcccggcggggctcaacgcgccgggaggggggtgcgcgaggaaacacttttatgggcagtgggccaaagaaggtccacgaccacgggggccacacgagcaccaaagggtgcgtctccccgcagaccccg

SEQ ID NO: 14634 - protein, 208 aa, Zea mays
  misc_feature: Ceres CLONE 1376499-F
MARAAARLLPIFLPWRRPPPPCLLRRGFLNPSSPRTSARVDTLVLPGDERLPFPSPPRLPNQLRPDYGSGRRRRRSLDHRGHRHLTRRSPCSGWGNRAGSPAPRGVGRRPNRGFPPQPGTQGGRFKAGGQPAQPPFGWRYGTPGFEAVTAGVIWAEGFVGGAQCVRPGGAQRAGRGVREETLLWAVGQRRSTTTGATRAPKGASPRRP

SEQ ID NO: 14635 - DNA, 553 bp, Zea mays
  misc_feature: Ceres CLONE 1376504-F
  misc_feature (192)..(192): n is a, c, t, g, unknown, or other
  misc_feature (193)..(193): n is a, c, t, g, unknown, or other
  misc_feature (206)..(206): n is a, c, t, g, unknown, or other
tccccgcggtggcggccgctctagaactagtggatcccccgggctgcaggaattcgcacgagaccattacctagaacatcctaatcgaaaaagcaaccgtgctcggttcctcctccctcgaaacggctcccacccccgcgccgcgataagaaaacccaccaaaccctaaccctagcagcggtgccacaaccnngcccgcgttcccnggccgggagaaaggaagccggaggcaggcaagggatggcccgccccgggagtccgggggaaccgaatttttcggaaacggaaaaccccgggcccaagggggggggggtttttctggaaaattggcccgggggggaggggcccccccccccagggaggaagaaaaaggttgttggtcaaaacccattctgtgggggaaaaaaacactttttgtttgcgctcccggggggggggtaaaaaaaaaacatttggggtggggggagtttcgtgtgtttctctcacccccaccacacacacattttttgggggggtgggggggaggagagaaaaaccccctcttttttttttt

SEQ ID NO: 14636 - DNA, 723 bp, Zea mays
  misc_feature: Ceres CLONE 1376506-F
  misc_feature (690)..(690): n is a, c, t, g, unknown, or other
tggagctccccgcggtggcggccgctctagaactagtggatcccccgggctgcaggaattcgcacgagaccattacctagaacatcctaatcgaaaactgaccgcctccctcgcctggtattcctggaggccgccgcctccaagcttctccctcccacgtgtgcttctctccctcccttcccttctctctgctgcgcacgtcggcctctagctcgtggagctccctcctctccctccacctctcctcccatggcgcgtcctctagctctggtgccgcgcgcactccttccctattgccgcgcgtgccccatctccctccacgcgcccctggctcggaccccggctcggccttctccccagtgcccggccggagctccctggctcgcccctgcgctcgcccagcccctgctcctcgctcctcccggcgcccagccgagctcgcccccggccccttgctcctccatggccggcgtttccccggcttgggtctcaccaaggtcgcccgccgtttccctgtgccgaggtctcgcccagccacaaccccgctcgacttggccgcgacctcgccgtggatgccgtcctcgcctcgccctacggccaacttcgccggtcgagttcctctgccctctcccacgaccgccgtcgattctctctagccggtgcgcggaccgcgcccctgctcctgctcgncatggctgccatgccctcccagcagcagagctc

SEQ ID NO: 14637 - DNA, 622 bp, Zea mays
  misc_feature: Ceres CLONE 1376514-F
  misc_feature: Translation starting site: 269
  misc_feature (622)..(622): n is a, c, t, g, unknown, or other
tccccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggccaccgactcctcctcctcctcctcctcctcgccggcggcggcgccgctgtcctccatcggccgctccatccgctcgctccgccgtgaccagaaccagatccactccttcccgccgccgccagacgccacagacgccttccagcgccgcgccgcccaactcctggccgacctcccggcagccgacgacgtcctctccctcgcctggacgcgccgcctcctcgaatccttcctcctctggcctcgaggagttccgcgccctgctcttcggctccggggactcgcccgctgctcggcccccgctcgaccgcctcgtcgccgacttctccgaccgcgccgtcaaggcgcn

SEQ ID NO: 14638 - DNA, 767 bp, Zea mays
  misc_feature: Ceres CLONE 1376518-F
  misc_feature: Encodes the peptide sequence at SEQ ID NO. 14639
  misc_feature (7)..(7): n is a, c, t, g, unknown, or other
  misc_feature (12)..(12): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (53)..(53): n is a, c, t, g, unknown, or other
aattttnttttnccccccnnncccgcgccgcccgccggccggccctcccgcantaaagccgctccccgcggtggcgggcgctctagaactagtggatcccccgggctgcaggaattcgcacgagaccattacctagaacatcctaatcgaaaaacacgcacaccgcgacccagtccagagccagtacgtgcgaagcagcacgcacgctgctggtccgcgtacgcgagactacggtcaggtcggccggtgcttttcagtttggaataatgacggcgacgacgacgacagccgccggcggcggcaaggtgcagccgcgcggcctgcccgcggcgctgtccctgctgctgctcctggtgttggcagcggggctgggcggtggcgccgaggcgcagcagacgtgcgcggggcagctgcgcgggctggccccctgcttgcgctacagcgtgccacccttgcacggggcaggttccgccggtgaccgtgcgcggagcgctgatccgccgcggtgcaaaccgtccaggcgccggggccctgacgcaacacttcagtctgagtgaggacgcgtgagggcgggaggtgtagatggtgggacatattttttgctgagacaacggcccactattctatccccacacgtctttcgcccacccgcccccacgaaaatagccgcttccaccccgccaccctatcctcaggtcccccccgcaccgcacacctcgactccgccgcaccttgcctctccccccccacccgcccgcccgcctccc

SEQ ID NO: 14639 - protein, 96 aa, Zea mays
  misc_feature: Ceres CLONE 1376518-F
MTATTTTAAGGGKVQPRGLPAALSLLLLLVLAAGLGGGAEAQQTCAGQLRGLAPCLRYSVPPLHGAGSAGDRARSADPPRCKPSRRRGPDATLQSE

SEQ ID NO: 14640 - DNA, 696 bp, Zea mays
  misc_feature: Ceres CLONE 1376526-F
  misc_feature: Encodes the peptide sequence at SEQ ID NO. 14641
  misc_feature (595)..(595): n is a, c, t, g, unknown, or other
agagctggagctccccgcggtggcggccgctctataactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcgtctcatcggcgtggagtacatcgtgtcgaggaagatcttcgactcgctgccggcggaggagcagcggctgtggcactcgcacgcgcacgagaatcaaaaggtccagggggcccctgggggggggggaacacccctcaaaaagacttntccccctgttcgcgcggaccagccctccttgttctgcggttgtcgcgagacggcgccgccgcctatcctctcgcgcctgtctcctttggcccgctttctcg

SEQ ID NO: 14641 - protein, 180 aa, Zea mays
  misc_feature: Ceres CLONE 1376526-F
  misc_feature (26)..(155): Pfam Name: DUF1264 Pfam Description: Protein of unknown function (DUF1264)
  misc_feature (147)..(147): Xaa is any aa, unknown, or other
MASSDGKPLPTPASVGGGGGSSTAPPGQPTTVASKVLDMGAAAMQSLRPVKQAKQHMCTFALYAHDPKRQVETHHYVSRLNQDFLQCAVYDSDKADARLIGVEYIVSRKIFDSLPAEEQRLWHSHAHENQKVQGAPGGGGTPLKKTXPPVRADQPSLFCGCRETAPPPILSRLSPLARFL

SEQ ID NO: 14642 - DNA, 507 bp, Zea mays
  misc_feature: Ceres CLONE 1376531-F
  misc_feature (183)..(183): n is a, c, t, g, unknown, or other
  misc_feature (231)..(231): n is a, c, t, g, unknown, or other
  misc_feature (232)..(232): n is a, c, t, g, unknown, or other
  misc_feature (246)..(246): n is a, c, t, g, unknown, or other
tggagctccccgcggtggcggccgctctagaactagtggatcccccgggctgcaggaattcgcacgagaccattacctagaacatcctaatcgaaaagacgacgcttcccgagctctctccttcccgcgaccctctcctctgccccgctccgctagggttttgccgcagacctctcgctcgcnttccgggtttcccgcgaggcaaccgtccgaccggtcggaatgtggatnngtgagagaccgggnacaggtggcatcgcagatgcggctccccgcgggagccggaggacgaagcccgccgaacctcccccttcccggcgccccttttaaatagggggggcccggggggtctcccccgggcccgggggcccctacggttccccccccttggaaaaggggggggggatccccccccgggggggtgtcccccttggggcgggccccgctctctataaatgaagggtgagcacaaagaattgtgcgtccccctcttctctccccccccgt

SEQ ID NO: 14643 - DNA, 796 bp, Zea mays
  misc_feature: Ceres CLONE 1376532-R
  misc_feature: Pfam Name: Transketolase_C Pfam Description: Transketolase, C-terminal domain
  misc_feature: SWISSPROT Homolog: EC 1.2.4.1 Pyruvate dehydrogenase (acetyl-transferring)
ttccaattgggtaccgggccccccctcgaggtcgacggtatcgataagcttttttttttttttttttagatggtcgaaccatcgtattcggtcttgcgtaaacgctgatttaggcaacaagagagatcgagtccgtgcacctacaaagctgggttctccttctgataccaagacctaaactactattagcctactcccttggtctccgaagaatcgcttgttacatccccatagaacttcaaacggaaggctctttcatggccaccactatctctcctacctcctatggcacgatctatgagactagttgttccactgccgacacaatctgggcaagctgcacaacggttgcatccgtcaaagccccagaacttggcgtgcgcgcttcccgagatcacacggacatgatgggggcgtctaggcattccctcaaattgtctaccatagccgacctaatgctagcgcccatgccacccctgcacatgcgatgctccgcgataaacacgcggtgcgtcctcctgatcgcagtggcaatagagtggagatcaaaccgctgtcacaacatgatgccgatgacctctgaatcggtacctctgttcaacagactcttcgcagcactcatcacttgggtagctcatgcacccagtatgtgtagtatagttcatgctcatccgggccgtcccagtctaagctgcctcctgaatgagcacgtaatcctcgggccggaattttatcctgttaagttgtacagaattgacttgcccaaagcccaccaaagggtttgtcgaagcatgat

SEQ ID NO: 14644 - DNA, 675 bp, Zea mays
  misc_feature: Ceres CLONE 1376538-F
  misc_feature: Translation starting site: 144
  misc_feature: Pfam Name: Peptidase_M22 Pfam Description: Glycoprotease family
  misc_feature (372)..(372): n is a, c, t, g, unknown, or other
  misc_feature (428)..(428): n is a, c, t, g, unknown, or other
  misc_feature (675)..(675): n is a, c, t, g, unknown, or other
ggagctccccgcggtggcggccgctctagaactagtggatcccccgggctgcaggaattcgcacgagaccattacctagaacatcctaatcgaaaaaattcgtcttcttccacaaactccaaaaccctagcgccgccgccgccatgtcctcgtctccgtccccggcgaaccgccgtccccagggcccgcttgcgctggggctggagtcctcggcgaacaagatcggtatcggcgtggtctccctctcgggtgacatcctctccaacccgcgccacacctacgtgaccccgccgggccatggcttccttccccgggagaccgcgcagcaccacctcgcgcacctcctccctctcctccgcgccgcgctcgctnggagtccggtgtggcccccgctgacctcgcatgcgtctgctacactaaaggccccnggcatgggcggccctctccaggtcgccgcagcagccgcccgcgcgctctccctggttatggaggaaactcctcgtggcggtcaaccactgcgttgcgcacatcgagaggggccgcgcggtcactgggggccggggaccccgttgtactctacgtctccggcggaaacacgcaggttatcgcctacggcgaggggcggtacaggatcttcggggaaacgattgatattgccgtcgggaactgccttgn

SEQ ID NO: 14645 - DNA, 633 bp, Zea mays
  misc_feature: Ceres CLONE 1376543-F
  misc_feature: Encodes the peptide sequence at SEQ ID NO. 14646
aaagctggagctccccgcggtggcggccgctctagaactagtggatcccccgggctgcaggaattcgcacgagaccattacctagaacatcctaatcgaaaacttttttccccgctcttctcccacacaaacgccaccgccgcatcgaatccgagacgccgatctcggattcgccgtcaccacacgctgccctcgtcgcgctctcccgccgccgccgctcgtctcgtcagccatggcaggattggcaccagaagggtcgcaatttgatgacaagcagtatgacaagaaaatgcaggagatattaactgaagacttcttcacttcatatgatgatgtttgcgaaagttttgacagcatgggactgcaagagaaccttctgagaggcatctatgcctatggttttgagaagccatcggctattcagcaaaggggaatagttcccttctgcaaggggcttgacgtgattcagcaagctcagtctggaactgaaataacacctaccttctgctctgcgatcttgcagcaacttgattatggattggttgaatgccatgcattggttcttgctccaacccgtgagcttgctcagcaaattgagaaggttatgcgtgctcttgaggactatatgagggc

SEQ ID NO: 14646 - protein, 133 aa, Zea mays
  misc_feature: Ceres CLONE 1376543-F
MAGLAPEGSQFDDKQYDKKMQEILTEDFFTSYDDVCESFDSMGLQENLLRGIYAYGFEKPSAIQQRGIVPFCKGLDVIQQAQSGTEITPTFCSAILQQLDYGLVECHALVLAPTRELAQQIEKVMRALEDYMR

SEQ ID NO: 14647 - DNA, 647 bp, Zea mays
  misc_feature: Ceres CLONE 1376545-F
  misc_feature: Translation starting site: 227
  misc_feature: SWISSPROT Homolog: EC 1.1.1.1 Alcohol dehydrogenase
  misc_feature (647)..(647): n is a, c, t, g, unknown, or other
agagctggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaggcatccggagtagtagagagtgtcggtgaaggtgtgaccgagttccaagtcggtgaccacgttctcactgtcttcattggggaaatgcagagctgcaagcactgcgtctcagggaagagn

SEQ ID NO: 14648 - DNA, 627 bp, Zea mays
  misc_feature: Ceres CLONE 1376549-F
  misc_feature: Pfam Name: RNA_pol_L Pfam Description: RNA polymerase Rpb3/Rpb11 dimerisation domain
  misc_feature (435)..(435): n is a, c, t, g, unknown, or other
  misc_feature (462)..(462): n is a, c, t, g, unknown, or other
  misc_feature (627)..(627): n is a, c, t, g, unknown, or other
aaagctggagctccccgcggtggcggccgctctagaactagtggatcccccgggctgcaggaattcgcacgagaccattacctagaacatcctaatcaaaaatatcctccaaacctaaccctagcaacacatttcgctccccacagcggcggcggccacagccacacgttctcgcgcgggatctaattccaaacagcactgcccttgcttctaccgttccccaagtgcgctccctctctcgccatccatctcgtgcacgactgggcaaccgttgccgctgtcgaggtccccaggtcttcatcggtccctcgtcagttcttctccggcccttcgccgccgacaagctcccccagctactgaagagacaggagcaaagagttaacaggagatgaatacccctgaccgttatgagcgtttcgtcgtggcagagggcancaggaaagtgtcctatgagagggatancaagatgtgaatgctgcatcattcactgtcgaacgcgagggtcacactgtaagcaatatcctccgcatgcaggtggacagagacccaaatggtctctttgccggggaatagcttcctcacccactcagtacaagatcctgggtaggatccacccacgagccagcn

SEQ ID NO: 14649 - DNA, 669 bp, Zea mays
  misc_feature: Ceres CLONE 1376554-F
  misc_feature: Encodes the peptide sequence at SEQ ID NO. 14650
tggagctccccgcggtggcggccgctctagaactagtggatcccccgggctgcaggaattcgcacgagaccattacctagaacatcctaatcgaaaaacaactcgaagtacgagtacctccggagtccggatggctgcagcgatggacgtcgacgaagccggcggcgaggagaggcgaccgtcggagaaggagctcttccgcgccgccgagtccggcgacgccgccgcgttcgcctccctcgcccccgccgacctctccctgcgcaacgaggacggccgctccctcctccacgtcgccgccgctgccggccatccccaggtggtgctcgcgcttgcccagtgcggtggtgatcccccgattagcgtgctgggtgggcaagacgaagaagggtgggcgccccccctctcccctgcgaggtccggggagttctgatctcgctcacattctggttgacgcgaaacggctggagaaaccccggtttcctggtggcgggccccactctgatcgtccctttcgctggctcccgctgccccgccccccccccccctgaagtgctagtcatcccatggccgcttcgtgtctcgcgtcctcctaacaagtctccctctgcccaccccccccttgtccgttctctttttatcgggttacttccgtcccgtcctcggccg

SEQ ID NO: 14650 - protein, 100 aa, Zea mays
  misc_feature: Ceres CLONE 1376554-F
MAAAMDVDEAGGEERRPSEKELFRAAESGDAAAFASLAPADLSLRNEDGRSLLHVAAAAGHPQVVLALAQCGGDPPISVLGGQDEEGWAPPLSPARSGEF

SEQ ID NO: 14651 - DNA, 630 bp, Zea mays
  misc_feature: Ceres CLONE 1376557-F
ggagctcaccgcggtggcggccgctctagaactagtggatcccccgggctgcaggaattcgcacgagaccattacctagaacatcctaatcaaaatcttcccaacaactccctccatcgtcttgaggcgtgcgcagccatggctgtcctcggcacgcggccggttgaggtgctcatcccggtagcgggattggttggaatcgctttcccgttgtgaaacggaaagggggggccaaagtcccctggctttcaaccccgcgaagaacggggggggagaaggaaaaaaaaaacggggggaggcgggcgggcccttgtggaaaagcaccccctagggacaaccttctccgggagagccccgggggcccacaataaagggggcctcccccgccgggggacaaaaggccctctcggtaaacaggggaaaacaaccccggcgcggggtccaatgcgcgcggccccgcggggggggtccattcggctgctctgcggggccggcgcaccgccatattcgccggcagcccgcggcggcggggggccccaccacctccgcggcggggagagcctcgccccccgcccgcggagccaccccccgattctcccccagcggggctaagttcccccccccgggcga

SEQ ID NO: 14652 - DNA, 641 bp, Zea mays
  misc_feature: Ceres CLONE 1376561-F
  misc_feature: Encodes the peptide sequence at SEQ ID NO. 14653
  misc_feature (641)..(641): n is a, c, t, g, unknown, or other
gctggagctccccgcggtggcggccgctctagaactagtggatcccccgggctgcaggaattcgcacgagaccattacctagaacatcctaatcgaaaacttgtgaacatcgcagtgctgtagcctccttcgtcttgagcgagcatggagatgtcagccatggaggaagccctccccaaggcgatggagaggaggaagggaggcctcagaaccattccgttcatcatcttaaacgagatattcgagaaggtggccacgttcgggctgtcggacaacatgatcctgtacctcaccgagcggtatctcatgaccaacgcctttgccaccgtcgtcctctacttctggcatgccttctccaacttcctgcccatcttaggcggcgtgctcgccgacgcccgcctcggccggttccgggtcatcaccctcggctcctgcgttagcctcttcgggatgtgcctgctgtggctgacggcgatcccttctggtgtacaagaacaccccggaagtgcgcgccggggcggcccgtcagggtgcgcggggctgcccggcaatctgccgctcctcttcacggtgtttagcgttcatgtcccctcgggtcgggcggcatcccggccctgcccgctgggggttccggggccgan

SEQ ID NO: 14653 - protein, 165 aa, Zea mays
  misc_feature: Ceres CLONE 1376561-F
MEMSAMEEALPKAMERRKGGLRTIPFIILNEIFEKVATFGLSDNMILYLTERYLMTNAFATVVLYFWHAFSNFLPILGGVLADARLGRFRVITLGSCVSLFGMCLLWLTAIPSGVQEHPGSARRGGPSGCAGLPGNLPLLFTVFSVHVPSGRAASRPCPLGVPGP

SEQ ID NO: 14654 - DNA, 664 bp, Zea mays
  misc_feature: Ceres CLONE 1376571-F
  misc_feature: Encodes the peptide sequence at SEQ ID NO. 14655
  misc_feature (375)..(375): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacgganaagaaggacgacgcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagcctacccgggttcagcttgcccggcagcggagctgccctccttttttcggggcgggctccccgggcttcagcgggcttcggcggcaatgcccgggtcgcccaccggccggctccgtccccgagcacgccaacaagccctn

SEQ ID NO: 14655 - protein, 130 aa, Zea mays
  misc_feature: Ceres CLONE 1376571-F
  misc_feature (34)..(34): Xaa is any aa, unknown, or other
MARSSKMMVAAALLALALAVSTAEARNIKTTTTXKKDDAVVQPQTFPPFDRLGGGASPAFGGLPGGSIPGSSIPGFSMPGSGSSLPGFSLPGSGAALLFSGRAPRASAGFGGNARVAHRPAPSPSTPTSP

SEQ ID NO: 14656 - DNA, 689 bp, Zea mays
  misc_feature: Ceres CLONE 1376582-F
  misc_feature: Encodes the peptide sequence at SEQ ID NO. 14657
  misc_feature (365)..(365): n is a, c, t, g, unknown, or other
tggagctccccgcggtggcggccgctctagaactagtggatcccccgggctgcaggaattcgcacgagaccattacctagaacatcctaatcgaaaaatcggctgtcgagtcgtcgcaaggtgttgctcgccgtatctcctttccccctcctccctgcgtcccccggctccggcgatccgccgcacctgaacccttctccacgtcgcctcgccggttgggttgaggtgagccgatcagatccgatcggggccggtccttgcgccactgctgcgtgagctcatctcggtcgaccgcctgcttggctcgatcggccggggacggcggcggccagatctgcaatggagggcaacaaggacgacgcggncaagtgcctgcgcatcggcaagggcgcgctcgacgccggcgaccgcgggcgggccatcaaggtcctgtccaaggaaaagcgccggaacccctcgctggcccttcgaagaacttccttaacttccttctcaaacccggaaggggatcccagggtttcttcccccccgccggtttcccacccaaaaatggcggagaaagggtactcggaggcacttcaaatatgatgcgcataaaacaagaaaaaactcgaggccagaaaacgcgagcaaggggggcttctgagaaaaccccgagaggaagcttcctgggtcggggctcgttctag

SEQ ID NO: 14657 - protein, 82 aa, Zea mays
  misc_feature: Ceres CLONE 1376582-F
  misc_feature (9)..(9): Xaa is any aa, unknown, or other
MEGNKDDAXKCLRIGKGALDAGDRGRAIKVLSKEKRRNPSLALRRTSLTSFSNPEGDPRVSSPPPVSHPKMAEKGYSEALQI

SEQ ID NO: 14658 - DNA, 636 bp, Zea mays
  misc_feature: Ceres CLONE 1376584-F
  misc_feature: Encodes the peptide sequence at SEQ ID NO. 14659
  misc_feature (262)..(262): n is a, c, t, g, unknown, or other
  misc_feature (360)..(360): n is a, c, t, g, unknown, or other
tccccgcggtggcggccgctctagaactagtggatcccccgggctgcaggaattcgcacgagaccattacctagaacatcctaatcgaaaaatctcgtccacgaaacgtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctnctcgccagaggaggtggccccgcccccgcccccgccttatcacgccgccaccgccgcgccgtccgcctacggaggcaacccctacatctactcccccngccggcggcgccgccacctccccgaagaatacgatggactccggtgaaggacgtgctcggcaaatggggggaagaggtttgggcgaggccggcccgcaagaccgagaccatcaccggcaatttctgggagcactgtgagcttttcgatttcgttgccgtatttcacgaaatcgggtttccgaaggtggtttctgtggcgctttcctcacatcgcgaatcggggtgggcctttttcaggcacattttggttttggtaacaggaaatgaagggtgccg

SEQ ID NO: 14659 - protein, 155 aa, Zea mays
  misc_feature: Ceres CLONE 1376584-F
  misc_feature (64)..(64): Xaa is any aa, unknown, or other
MNPPAAAASTGAGGHAAAPAAAREYVHYPRLLARGGGPAPAPALSRRHRRAVRLRRQPLHLLPXPAAPPPPRRIRWTPVKDVLGKWGEEVWARPARKTETITGNFWEHCELFDFVAVFHEIGFPKVVSVALSSHRESGWAFFRHILVLVTGNEGC

SEQ ID NO: 14660 - DNA, 713 bp, Zea mays
  misc_feature: Ceres CLONE 1376587-F
  misc_feature: Encodes the peptide sequence at SEQ ID NO. 14661
tggagctccccgcggtggcggccgctctagaactagtggatcccccgggctgcaggaattcgcacgagaccattacctagaacatcctaatcgaaaaaaaacacctccgatccgtccccgatcatctcaccacctgtagaccacctcgctctcgagactcgacccagcgacgatatggccgcgctggatctgaccccaaggacgcccaagaaggcctacggtgtggacggcggcccctactacgatgggagccccgccgacctgactatgctcggcgccgcctccttcggcgccgcctagctctcactcgccgccggggggctctccctccccagctactcctactccgccaagggcgcctacgtcctacaaggcgtcagaacctgcggtctcgtcctccccaaggcgacaaaagacaaggtgtcgtcgttgaaggagggcgacgcgactggcgctgcccttctgcgcggtagacgatggagtgacacacgagtcgccgccgggcagaggcgactctcacgatgctcttcctctgcgacacctccaagggccacaagtggcggaagttcagcaacttccagatcacggcgatcgcgttgatcttcactgtcctgtccaccgagatcgggactcgcgagtgcgatctgcacgagcccgacgccgctagactgatgtctagacaggcggcctcagaaatcctccagctgcgcgcc

SEQ ID NO: 14661 - protein, 41 aa, Zea mays
  misc_feature: Ceres CLONE 1376587-F
MAALDLTPRTPKKAYGVDGGPYYDGSPADLTMLGAASFGAA

SEQ ID NO: 14662 - DNA, 733 bp, Zea mays
  misc_feature: Ceres CLONE 1376589-F
  misc_feature: Encodes the peptide sequence at SEQ ID NO. 14663
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (603)..(603): n is a, c, t, g, unknown, or other
  misc_feature (604)..(604): n is a, c, t, g, unknown, or other
aagctggagctccccgcggtggcggccgctctagaactagtggatcccccgggctgcaggaattcgcacgagaccattacctagaacatcctaatcgaaaaaccgagaaacaaaaattgaaggaaattgaaggggccgcagtgcagcaggacgatggtcagaacagtgaagacgggtggacctggttcagtagacccagcgtgagtactctcgcgccactcgcctccgcgtccgccaccgccttctccaccacacgccccactgcgtacaggccttgcttggactggtactgcatccaaagcaatgttagtagaacacacacacacacacgcatatgtgtatccgttacgtgctagtagcatgcagtacagtacctgagaggtgtatcttggaacgacccacgtctcgagcttgagcttgtggagcctgttggcctcggacctgaaggcggtccgggtccggccgaggagcgcggccagcgggcacgccaccgccgccgccagaagcctgctgctgctgctgctgcaggcgccgtagcgggacgcgggcggcgccggcgcggcggcgaggaccaccaannnnnnggggggggggggnnnnnanncacccccgcccccttcacggcccccgagggggaacaacacccggccgcgcccctccccgaatgcgggtcctgctccgctcgcttcctacagggtcggtcgctcgattttgctccgccgtgtccgataaa

SEQ ID NO: 14663 - protein, 117 aa, Zea mays; identical to SEQ ID NO: 12563
  misc_feature: Ceres CLONE 1376589-F

SEQ ID NO: 14664 - DNA, 710 bp, Zea mays
  misc_feature: Ceres CLONE 1376596-F
  misc_feature: Encodes the peptide sequence at SEQ ID NO. 14665
  misc_feature (362)..(362): n is a, c, t, g, unknown, or other
  misc_feature (533)..(533): n is a, c, t, g, unknown, or other
  misc_feature (568)..(568): n is a, c, t, g, unknown, or other
  misc_feature (584)..(584): n is a, c, t, g, unknown, or other
  misc_feature (597)..(597): n is a, c, t, g, unknown, or other
  misc_feature (607)..(607): n is a, c, t, g, unknown, or other
ggagctccccgcggtggcggccgctctagaactagtggatcccccgggctgcaggaattcgcacgagaccattacctagaacatcctaatcgaaaaattccgtcgtcgtcgtcagcagcttctgcttgctctggggggaaggagagagagagagcgagagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggncacctcgcctactcccacaccaaccaggcggctcctccgccccaggtcgttcgcgggcaaggacgaggtggtctgcctggtcgagggggtgctggacaacctgggtcgtctgagccagcagcacgggctgtcaagcaagggcgcccacgaggtgctcctcgtcatcgaggncctacagaggctgcgcgaccgcgcgccctaccggnccaggttcatgctcgnccagttcaccggntcctacgctncgtcctctttcgaaagtcacaactccctgctaagcgatccgaccccgaggggaaggtgccgtctttcgggggatcaccggcgaaggttggggcgccttccccg

SEQ ID NO: 14665 - protein, 169 aa, Zea mays
  misc_feature: Ceres CLONE 1376596-F
  misc_feature (122)..(122): Xaa is any aa, unknown, or other
  misc_feature (132)..(132): Xaa is any aa, unknown, or other
  misc_feature (135)..(135): Xaa is any aa, unknown, or other
MLAVFSGQVVEVPAELVAAGSRTPSPKTKASQLVGRFLAASEPAVSVQLGDHGHLAYSHTNQAAPPPQVVRGQGRGGLPGRGGAGQPGSSEPAARAVKQGRPRGAPRHRGPTEAARPRALPXQVHARPVHRXLRXVLFRKSQLPAKRSDPEGKVPSFGGSPAKVGAPSP

SEQ ID NO: 14666 - DNA, 630 bp, Zea mays
  misc_feature: Ceres CLONE 1376605-F
  misc_feature: Encodes the peptide sequence at SEQ ID NO. 14667
  misc_feature (569)..(569): n is a, c, t, g, unknown, or other
  misc_feature (578)..(578): n is a, c, t, g, unknown, or other
ggagctccccgcggtggcggccgctctagaactagtggatcccccgggctgcaggaattcgcacgagaccattacctagaacatcctaatctaaaagacaaccagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctgatcatgcctccacgtgatcaggttgctcgagtggctaagatgttaggtgatgaatatggtactgcttcaaacatcaagagtagagttaatcgtcaatctgtgttggctggcatcacctcagctcagcagaggttgaagctctacaacaaagtgcctcctaacggattggttctgtacactggaactattgttactgaagacggaaaggaaagaaagttactattgattttgagccattncagcctatncatgtatcactctaccttttgtgacacaagtccacactgaggcttttaatgt

SEQ ID NO: 14667 - protein, 131 aa, Zea mays
  misc_feature: Ceres CLONE 1376605-F
  misc_feature (6)..(130): Pfam Name: eRF1_1 Pfam Description: eRF1 domain 1
  misc_feature (116)..(116): Xaa is any aa, unknown, or other
  misc_feature (119)..(119): Xaa is any aa, unknown, or other
MSDSHETDRNIEIWKIKKLIKALESARGNGTSMISLIMPPRDQVARVAKMLGDEYGTASNIKSRVNRQSVLAGITSAQQRLKLYNKVPPNGLVLYTGTIVTEDGKERKLLLILSHXSLXMYHSTFCDTSPH

SEQ ID NO: 14668 - DNA, 671 bp, Zea mays
  misc_feature: Ceres CLONE 1376608-F
  misc_feature: Encodes the peptide sequence at SEQ ID NO. 14669
tccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgccggtgttcctgatcttcagccccgtgctggtccccgccgcgctgctcatcgggacggccggtcatggggttccctcacgtccggcgcgctgggggctccggggacccggccaccggctccggggactcggaaaacagggcccggtagggcgttccgcgcccctcctggattaagcggcggcagccccccccccgcatttgcgcggcggcctgtccccaaggcctccccaccaatcg

SEQ ID NO: 14669 - protein, 137 aa, Zea mays
  misc_feature: Ceres CLONE 1376608-F
  misc_feature (44)..(133): Pfam Name: Oleosin Pfam Description: Oleosin
MADRDRSGIYGGAHATYGQQQQQGGGGRPMGEQVKGMLHDKGPTASQALTVATLFPLGGLLLVLSGLALTASVVGLAVATPVFLIFSPVLVPAALLIGTAGHGVPSRPARWGLRGPGHRLRGLGKQGPVGRSAPLLD

SEQ ID NO: 14670 - DNA, 794 bp, Zea mays
  misc_feature: Ceres CLONE 1376617-F
  misc_feature: Pfam Name: Thi4 Pfam Description: Thi4 family
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (794)..(794): n is a, c, t, g, unknown, or other
nnnccccccccccccccccccccccccccgcccgcccattccttttttctcaaactggggctccccgcggtggcggccgctctagaatagtggatcccccgggctgcaggaattcgcacgagaccattacctagaacatcctaatcgaaagatcccctcagtcctcagtccctcacacactcactatacactgctctgctgcagcaagaaggaagaagctagcgcctccctagctctcgttgtcaggcaatggccaccaccgccgcgtccagcctcctcaagtcctccttcgcgggctcccggctcccttcggccacgcgcaccaccaccccgtcgtccgtggccgtgggcaccccgcgcgccggcggcggccccatccgcgcgtccatctcctcctcccccaccccgcccaacgacctgacgtcctgtcgggggcagccccatcaaggagtccatcgtgtcccccgagatgacccggcgctacatgacggacatgatcacccacgccgacaccggacgggggtgatcggggggcgccccggtcccggggggctgggcctggggcgtacgaagctgtccaagggaccccaaccgtgagggggcgccacccccggcgggcatccccgtggggcccgcggggcggcggggcgcggaggtgtggggacggcgaacagcggggtggagcgggccgggggggggggggggcgcggggagcggcgcggccacggcgggtgcgcgggcgcggcagaccccagggagcgcggcgccgccggcggggggcggaggccgggacn

SEQ ID NO: 14671 - DNA, 629 bp, Zea mays
  misc_feature: Ceres CLONE 1376629-F
  misc_feature: Translation starting site: 186
  misc_feature (387)..(387): n is a, c, t, g, unknown, or other
  misc_feature (391)..(391): n is a, c, t, g, unknown, or other
  misc_feature (392)..(392): n is a, c, t, g, unknown, or other
  misc_feature (445)..(445): n is a, c, t, g, unknown, or other
  misc_feature (486)..(486): n is a, c, t, g, unknown, or other
  misc_feature (509)..(509): n is a, c, t, g, unknown, or other
  misc_feature (515)..(515): n is a, c, t, g, unknown, or other
  misc_feature (532)..(532): n is a, c, t, g, unknown, or other
  misc_feature (533)..(533): n is a, c, t, g, unknown, or other
  misc_feature (536)..(536): n is a, c, t, g, unknown, or other
ggagctccccgcggtggcggccgctctagaactagtggatcccccgggctgcaggaattcgcacgagaccattacctagaacatcctaatcaaaaatcatcagtcatcacataccaccaagaccacatcggcacatcgacgtgagctcgtgcgtgagtgccctggtcgacgaccgctcgcgcgccatggactcaacgacgacggcgccgctgctgcagccgtccgccgcctcgagcaaggaggggccggggccggcgccggctcagcacggtgagggcagccgggagctggaggcgatcctggccgacgcgtccaagccgtgggcttggcgggcctgggaaggcgcccgcctggagctgccgctgctgctgcgggtggcgctgccgnccgnntgccgtctacatgatcaacttcgtcatgtccatgtccacgcagatcttctgcnggcagctcggcaacctcgagctcgccgcctcctcgctcggnaacaccgggatccagcccttggnctacgncctctggctggcatggnncancgcgggggatacccttgtgcggaaggggtacgggcgcacaaccccgaatgggggggggtgtcctggacggccccaggggtttcttcgggcccc

SEQ ID NO: 14672 - DNA, 687 bp, Zea mays
  misc_feature: Ceres CLONE 1376642-F
  misc_feature: Encodes the peptide sequence at SEQ ID NO. 14673
  misc_feature (248)..(248): n is a, c, t, g, unknown, or other
  misc_feature (262)..(262): n is a, c, t, g, unknown, or other
  misc_feature (335)..(335): n is a, c, t, g, unknown, or other
aaagctggagctccccgcggtggcggccgctctagaactagtggatcccccgggctgcaggaattcgcacgagaccattacctagaacatcctaatcgaaaagccaaggaaacagtcacgtctcccagatctaactccccccgactcacgaatcccagagagcctccatggcgacgcaccgccactgcctcccacttcctcctcgtggccgccgccctcgccctcgccgccgtccctgctcgcgcggncgctgggcggcggncgcggcccggctgctgggcgggtggaacccgatccctgacgtgagcgactcgcacatccaggagctaggcggntgggcgctggggcaggcgaagcaccagaacctgggcggggagggggtgcgtttccggccgcgtggtgagcggccagccgcgaggtcgtggcggggaggagattgggggttcgacggggaggggggcgaccgcgcgagggcggacgcgcgcgctgggggggggggtggtcaccccagcccccgcgcccgcggctccgcgcggtggaggaacaacccgcacagcggccactgtagctgtcgcgagcctaccccgcaacgacgagcccccacacacacgccgcagacggagggcgggggtgcgggggtgggagcgcgacgtgatgcggccagccctgacaccctcgacatgccag

SEQ ID NO: 14673 - protein, 173 aa, Zea mays
  misc_feature: Ceres CLONE 1376642-F
  misc_feature (32)..(32): Xaa is any aa, unknown, or other
MATHRHCLPLPPRGRRPRPRRRPCSRGRWAAXAARLLGGWNPIPDVSDSHIQELGGWALGQAKHQNLGGEGVRFRPRGERPAARSWRGGDWGFDGEGGDRARADARAGGGGGHPSPRARGSARWRNNPHSGHCSCREPTPQRRAPTHTPQTEGGGAGVGARRDAASPDTLDMP

SEQ ID NO: 14674 - DNA, 650 bp, Zea mays
  misc_feature: Ceres CLONE 1376647-R
  misc_feature (650)..(650): n is a, c, t, g, unknown, or other
ccgattgggtaccgggccccccctcgaggtcgacggtatcgataagcttttttttttttttttttatttttttttttttttttttttttttttttttttttttttttttttttttttttttttaggacgggaacaaaaaaggttttaacagcttatacgtccagcacactgattaatgacaatacatctcagtaagactatactacaccgtctgacaagtcgaaacagccccccctaggggaactaaacaagaattacccccggatgtgccaaagcagctgaaggggatcataattactctacgaagcccttacaatatattacccgaaaacaatagaacaacagaaaaagggccccttatatctaaaatatgaagctaggttaaaaatcatggggggctcggaaccggatcggtgacaaaaatttgggagggggcgtcttctttggctgttgctgtcaaacccacaggggccgttgcagctgcactgttcccaggaaatgctgtcttcgccggggctttcttgctatccttccctccagacctgacgccatggccaccaccgttctgttggccactgattgagagccttctgtttggaggagtgccgtttgagacgctgccattcaactttgggccaatgggcttcttn

SEQ ID NO: 14675 - DNA, 643 bp, Zea mays
  misc_feature: Ceres CLONE 1376657-F
  misc_feature: Encodes the peptide sequence at SEQ ID NO. 14676
  misc_feature (361)..(361): n is a, c, t, g, unknown, or other
  misc_feature (362)..(362): n is a, c, t, g, unknown, or other
gctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtcacctgcccgccgccggtccactggccaccgccgggtcatgggnncgccggccggttcatctgccgccgccaccatgccactaccctactcaaccgccccggcctcagcctcatccccagccacaccccatgcccgtgccaacagccgcatccaagcccgggccagctgcagggaacctgggggcgttgccagcacccgatcctgggccggtggggtcgaggttctgaggcatcagggcagcccgacggcgacgcctactgctcgctcaggggcaggcgttgcggcagcagtggtgcagcagctcagggagggggggccgaacccc

SEQ ID NO: 14676 - protein, 32 aa, Zea mays
  misc_feature: Ceres CLONE 1376657-F
MPVPTAASKPGPAAGNLGALPAPDPGPVGSRF

SEQ ID NO: 14677 - DNA, 662 bp, Zea mays
  misc_feature: Ceres CLONE 1376669-F
  misc_feature: Encodes the peptide sequence at SEQ ID NO. 14678
  misc_feature (275)..(275): n is a, c, t, g, unknown, or other
  misc_feature (373)..(373): n is a, c, t, g, unknown, or other
tggagctccccgcggtggcggccgctctagaactagtggatcccccgggctgcaggaattcgcacgagaccattacctagaacatcctaatcgaaaaaaaccgcgtctcgcgcgaagaatccgcatttccccttccccgcaccgcaccgcacccaacccccgtcggagagagagatggcatcggtggcggagatgcagcccctcgcgccggcggggtaccgccgcgcgccggagatgaaggagaaggtggaggcgtcggtggtggacctggaggncgggaccggggagacgctgtacccggggatctcgcgcggggagagcgccctccgatggggcttcgtccgcaagggctacggcatcctcgctggggagntggtcctcaccaccggcgtctccggcctcaccgttttcaccccaccctcaaggccaggttctccggattcccggggcctcgggctcgggggtcgccggcctggcccttcctccgggagggtccccttgtgggtctttttgcgggcggaggcccccccacaattttgcttttccgcgggcgtcggtcccgggtgaggagtggaggttccggaccgtcggggggggtttcggggaagaagcccccgggagaaaacgcgcgtcggggggggcgtaagcgcgtggaggggtgg

SEQ ID NO: 14678 - protein, 130 aa, Zea mays
  misc_feature: Ceres CLONE 1376669-F
  misc_feature (34)..(34): Xaa is any aa, unknown, or other
  misc_feature (67)..(67): Xaa is any aa, unknown, or other
MASVAEMQPLAPAGYRRAPEMKEKVEASVVDLEXGTGETLYPGISRGESALRWGFVRKGYGILAGEXVLTTGVSGLTVFTPPSRPGSPDSRGLGLGGRRPGPSSGRVPLWVFLRAEAPPQFCFSAGVGPG

SEQ ID NO: 14679 - DNA, 644 bp, Zea mays
  misc_feature: Ceres CLONE 1376671-F
  misc_feature: Encodes the peptide sequence at SEQ ID NO. 14680
  misc_feature (485)..(485): n is a, c, t, g, unknown, or other
  misc_feature (497)..(497): n is a, c, t, g, unknown, or other
  misc_feature (505)..(505): n is a, c, t, g, unknown, or other
  misc_feature (514)..(514): n is a, c, t, g, unknown, or other
tccccgcggtggcggccgctctagaactagtggatcccccgggctgcaggaattcgcacgagaccattatctagaacatcctaatcgaaaacttgctcataccgcaacgctctatctctttcgccgagctcctcgaaaccctaggagcgtgcttgaccggcggcggcgaggtgatggcgatggaccctgacgcggtagcgaaggccttcgtggagcattactaccgaacgttcgacaccaaccgcgcggcgctggttgggctgtaccaggagacctccatgctcaccttcgagggccagaagttccagggcccctccgccattgccggcaagctcggatctctccctttccaggcctgcgagcatcagatcgtcaccgtagactgccagccatcgggtccccagggaggcatggctcgtcttcgtctccggttccatacgcaccgggccccgaggagcaccccatcaagttctccaggcattcantttgtgccgggncggctggntccttcttncctgcagaaatgacatgttccgcctgaactatggctaaagccccgatactcttggggatgaagatttgttgataagggggtttcatgttgaacgagaaatacttaatgtgcccgtactctgggtctcttt

SEQ ID NO: 14680 - protein, 117 aa, Zea mays
  misc_feature: Ceres CLONE 1376671-F
  misc_feature (8)..(113): Pfam Name: NTF2 Pfam Description: Nuclear transport factor 2 (NTF2) domain
  misc_feature (104)..(104): Xaa is any aa, unknown, or other
  misc_feature (111)..(111): Xaa is any aa, unknown, or other
  misc_feature (114)..(114): Xaa is any aa, unknown, or other
MAMDPDAVAKAFVEHYYRTFDTNRAALVGLYQETSMLTFEGQKFQGPSAIAGKLGSLPFQACEHQIVTVDCQPSGPQGGMARLRLRFHTHRAPRSTPSSSPGIXFVPGRLXPSXLQK

SEQ ID NO: 14681 - DNA, 637 bp, Zea mays
  misc_feature: Ceres CLONE 1376678-F
  misc_feature: Encodes the peptide sequence at SEQ ID NO. 14682
  misc_feature (586)..(586): n is a, c, t, g, unknown, or other
ggagctccccgcggtggcggccgctctagaactagtggatcccccgggctgcaggaattcgcacgagaccattacctagaacatcctaatcgaaaataccttcaataagaatggctccatgatatttctggatttgtcatttaatcagcttgactcagagatcccaaaggagcttgggaacatgtactacctcatgatcctgaatcttggccacaacttgctgtctggcgtcatcccaccagaactagctggtgccaagaagcttgctgtactcgacctgtcacacaaccagttggaagggcctattcccaactctttctcgacgttgtccttgtcggagatcaacctttcaaataatcagttgaatggttcaattccagagctcggttcgctgttcacattcccgaagatttcatatgagaataactctggtctttgtggcttcccactgttgccatgcgggcacaatgctggctcaagttcttccgatggccaccgatcccaccggaaccaggcttcacttcgcgggtagtgttgctatgggactcttgttctcgctgttctgtatagtttggattgtcatcantagttgttgagtgcaagaagcggaagcagatcaaatgaagaggcagtactt

SEQ ID NO: 14682 - protein, 137 aa, Zea mays
  misc_feature: Ceres CLONE 1376678-F
  misc_feature: SWISSPROT Homolog: EC 2.7.11.1 Non-specific serine/threonine protein kinase
  misc_feature: The sequence is a functional homolog of SEQ ID NO 2 in US patent 7135625
MIFLDLSFNQLDSEIPKELGNMYYLMILNLGHNLLSGVIPPELAGAKKLAVLDLSHNQLEGPIPNSFSTLSLSEINLSNNQLNGSIPELGSLFTFPKISYENNSGLCGFPLLPCGHNAGSSSSDGHRSHRNQASLRG

SEQ ID NO: 14683 - DNA, 610 bp, Zea mays
  misc_feature: Ceres CLONE 1376682-F
  misc_feature: Translation starting site: 166
  misc_feature (340)..(340): n is a, c, t, g, unknown, or other
  misc_feature (381)..(381): n is a, c, t, g, unknown, or other
  misc_feature (382)..(382): n is a, c, t, g, unknown, or other
  misc_feature (410)..(410): n is a, c, t, g, unknown, or other
aagctggagctccccgcggtggcggccgctctagaatagtggatcccccgggctgcaggaattcgcacgagaccattacctagaacatcctaatcgaatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttccccataccttccatcaatgatagcttcagtatgtgaaaacccagctcttcagcccctatagctccnaacaagcatcgcagcaagcaacatacctttatcacccttgnntgttcacaatcgccagccctatctttgntgcagtcattggtacaaaccatccaggcaagcagctgcagcaactcgtgctaactgtgatcaacaagtagttctggaaaacctttctccctactcccagaaaaaacattttcttccattcaacaactttctaacctggaaccctgggtggttaatttgggaaaaaacttttacactttcacgcccggtggggtggggggg

SEQ ID NO: 14684 - DNA, 632 bp, Zea mays
  misc_feature: Ceres CLONE 1376688-F
  misc_feature: Translation starting site: 216
  misc_feature: Pfam Name: SecY Pfam Description: eubacterial secY protein
  misc_feature (528)..(528): n is a, c, t, g, unknown, or other
aaagctggagctccccgcggtggcggccgctctagaactagtggatcccccgggctgcaggaattcgcacgagaccattacctagaacatcctaatccaaaaatttctctctctcctctcatctccacctctcctccggctagggtgttcacgcctgccgcggcgaagcttctgccctccccggcgtcgcgctctggtcgtcgtcggccgggaagatggctggcggcttcagggtacttcatctggtcaggccctttctggctttcttgccagaggtgcagagcgcggataggaagataccattcagagaaaaagttatctacactgttatttctctcttcatttttctggtgtgcagccagctcccactctatggcattcattcgacgactggagctgatcctttctactggatgcgtgttatccttgcatcaaaccgtggcactgtgatggggagtggtattactccaattggtgacctctggtatggtaatgcaacttcttgtcggatcgaagatcattgaagtngacaacagtgtgagagaagatcgtgctctgctgaatggtgcacaaaagttgctcggtatcttgatcgctattggggaagctggtgcatatgtcctgtctggaag

SEQ ID NO: 14685 - DNA, 650 bp, Zea mays
  misc_feature: Ceres CLONE 1376696-F
  misc_feature: Encodes the peptide sequence at SEQ ID NO. 14686
gctctagaactagtggatcccccgggctgcaggaattcgcacgagaccattacctagaacatcctaatcgaaaactctaatctctttgcctctttggctccctccaccaccagtccaccaccactgctacccaacccttgcttccccaaaccctagccaagggacacggtggccgacgatggacggcgacggaggaggcgctggtgcgctgcaccaccacacgcgctcacccgaggacgtcttccgcgatttccgcgcgcgccgagccggcatcgtcaaggcgctcaccacggattgtggagaagttctatcagcagtgcgatccagagaaagagaacttgtgcccttttatggtttgccaaatgagaacttggggaggtcactcttccaggctggaggaagtacctcctggagcttccagaaccagcactgggggataaactttgcccggggatgggatggtcgaaaaaggactgtttgtccctaggtgcaggtcatagggagggatgccttcctggccggtggattctaacttgggagctccggtttgggattggaaaagaaggccagaaaaaggcttcttccccaggaataaacacctgcccccgggttaataaggcgcggcaccgcggtgtggaaaaaaagaaacc

SEQ ID NO: 14686 - protein, 102 aa, Zea mays
  misc_feature: Ceres CLONE 1376696-F
MDGDGGGAGALHHHTRSPEDVFRDFRARRAGIVKALTTDCGEVLSAVRSRERELVPFYGLPNENLGRSLFQAGGSTSWSFQNQHWGINFARGWDGRKRTVCP

SEQ ID NO: 14687 - DNA, 669 bp, Zea mays
  misc_feature: Ceres CLONE 1376699-F
  misc_feature: Encodes the peptide sequence at SEQ ID NO. 14688
  misc_feature (9)..(9): n is a, c, t, g, unknown, or other
  misc_feature (669)..(669): n is a, c, t, g, unknown, or other
cactttgtnactttattaggtggcggccgctctagatatagtggatcccccgggctgcaggaattcgcacgagaccattacctagaacatcctaatcgaaaaatcatagtgagtttgaggacattggaccgcaccctgcagaggccaagcgtcgaacacatggcgtgcaccttcctccgccgcgcgttctccctcaccgccgccggcacccacgcgaccccccgagttgccgccgccttcgcttccacttcctcctcatcctccgtcgtcgtgcctctgcgctccccactagaccaccggcttctccgccacctccgctccgagatcacctacctcgcggagcgccgccctccccacgtggcgccgagtagcttcaaggcggtcggcgtggaggaccgcccgggggagcagtgggtgcgcctccgcgccagcgcgggagggggaggcgaggaggtgaaggtccaggccaccatgttcgacggcgctgcggagcctggcccggacgacgcgcccctcttccgccgcggggagtcgctcgagcgcgggccccgcctccacctcagcctcatcggcgagggcgcccggggcgaccgcgtcctcgggttcctctggtccgcctgggccgagcacctcgccgggcggcacgtggtcacgctcgcagctgggggn

SEQ ID NO: 14688 - protein, 170 aa, Zea mays
  misc_feature: Ceres CLONE 1376699-F
MACTFLRRAFSLTAAGTHATPRVAAAFASTSSSSSVVVPLRSPLDHRLLRHLRSEITYLAERRPPHVAPSSFKAVGVEDRPGEQWVRLRASAGGGGEEVKVQATMFDGAAEPGPDDAPLFRRGESLERGPRLHLSLIGEGARGDRVLGFLWSAWAEHLAGRHVVTLAAGG

SEQ ID NO: 14689 - DNA, 684 bp, Zea mays
  misc_feature: Ceres CLONE 1376703-F
  misc_feature: Encodes the peptide sequence at SEQ ID NO. 14690
  misc_feature (294)..(294): n is a, c, t, g, unknown, or other
  misc_feature (305)..(305): n is a, c, t, g, unknown, or other
  misc_feature (307)..(307): n is a, c, t, g, unknown, or other
  misc_feature (308)..(308): n is a, c, t, g, unknown, or other
  misc_feature (310)..(310): n is a, c, t, g, unknown, or other
  misc_feature (380)..(380): n is a, c, t, g, unknown, or other
  misc_feature (381)..(381): n is a, c, t, g, unknown, or other
tccccgcggtggcggccgctctagaactagtggatcccccgggctgcaggaattcgcacgagaccattacctagaacatcctaatcgaaaaagcggcaactacacgccagagagagggaaggggaggttggccagagagccgagagcagccctgcagtcgagagcatccgactgctagctactagcaatagcataggcagataagctcgggccgggccggggcacgcgcacaatgaggtcgcggcggtggcacagcgtggtcgccgtagcgctggcagcggcggcgtgggtggntggtgcgccgncnncncaggcgcaggcgcaggcgcagctgagccagagctactacgcgtcgacgtggccgcgagggggagacgctnntcccgcgccgccgtcacccagaagctgccgggagaccttccccgcggggggcggggcacgctccgcctgtgtcttccgcgactgccttcggcgaggagttgggcactcgtcccgtggttgctgccccgggcccgggggcgagcccgggcggggtgcggcgccggggggggggcgcagggagggggtgggggcggggttgcccatctagcgcgggcgtcggccagccccgggggcgcgggcgcgggggcacctgcgcgtgtcgcgcccgcacccaagggggcggcggccgcccactgcgcgcgg

SEQ ID NO: 14690 - protein, 118 aa, Zea mays
  misc_feature: Ceres CLONE 1376703-F
  misc_feature (21)..(21): Xaa is any aa, unknown, or other
  misc_feature (25)..(25): Xaa is any aa, unknown, or other
  misc_feature (26)..(26): Xaa is any aa, unknown, or other
  misc_feature (50)..(50): Xaa is any aa, unknown, or other
MRSRRWHSVVAVALAAAAWVXGAPXXQAQAQAQLSQSYYASTWPRGGDAXPAPPSPRSCRETFPAGGGARSACVFRDCLRRGVGHSSRGCCPGPGGEPGRGAAPGGGRREGVGAGLPI
